United States Patent 7,482,117 (GENETIC POLYMORPHISMS ASSOCIATED WITH MYOCARDIAL INFARCTION, METHODS OF DETECTION AND USES THEREOF) - sequence listing, part 8

SEQ ID NO: 17730 - DNA, 561515 bp, Homo sapiens
  misc_feature (1)...(561515): n = A,T,C or G, or insertion/deletion polymorphism (see Tables 1-2)
cccaatctgattgcaaaatgggcaaaagacttgaatagacatttccccaaagaagatatacaagtggacaacaagcacttgaaaggatgctcaaatcactaatcattagagaaatgcaaattaaaaccacaccacagtgagataccacctcacatccattaggatagctattaggaaaaaagaaaaaagaaaccccaaaccccaaaataacaagtgttggtgaggaagtggggaaattgaaaccctggtgcactgctgatggaaatgtaaaatggggcaactgctatggaaaacagtagaatagttcctcagaaaatcttaaaagaattaccacatgatccagcaattccacttatgggtattatcccaaagaactgaaagcagggtcttgaagagatatttgtacactcacgttcatagcagcattattcacaagagccaaaaggtagaaacaacccaagtgtccattggcagatgaatggagaaacacaatgtgatctatacataccatgaactactattccttaaaaaggaaggaaattgtgacatatacttcagcttgaatggacattgaagacattatgctaagtgaaataagccagtcacaaacaaataatgtacaattccacttatatgaggttatatgagagtggtcaaattcataggcagaaactagaatagtggttgccaggaataaagtggagggaagggaggatgggagggggagttgttgtgccatttcatgggtataaagtttcagtttgggaagatgaaaaaagtgctggaggaggatggtggtgatggatgtataacaatgtgaatgtacttaatgccattgaaatgtacactttaaaaatggttacagtggtcaactttctgttatgcacattttaccacaatttttaaaaatgtataaaaaatagaaggtgagcaaatgcaccaactgaatatactaagttcaaatttaagaaagcacttcccaaatcttgttctgtggcttattattcttgaggaatgtgcctcaaaataagggttttgtggttgtttagttattttttcaaaaaatatttaccggtcactgcctgcgtgctaggctctgtactagatgttgagaagtaggtatggacaaacctgatgtggttcctctctttatcaatttgaccatttagcagaataatattcccattcattgaaaaccaaatatagagcaagaagcttaaattcttcattttgttttatctttgtaaagtgggtattatcatcctcttattaaagaagaagaaaccaaggctcagaaaatttaagtaacattctccaagttcacccaactagcaacctgggtccatctggctccagagtcacaataaccaaaagaagaaagcaatccaggatgggcgccgtggctcacgcctgtaatcccagcactttgggaggctgaggtgggcggatcacaaggtcaagagattgagaccagcctggccaacatggtgaaaccctgtctctactaaaaatacaaaaattagctgggcatggtggcacacgcctgtagttccagctactcatgtggctgaggcaagagaataccttgaacccggtaggtggaggttgcagtgagctgagaagtgagctgagattgcgtcactgcactccagcctggtgacagagtgagactcaaaaaaaagaaaacaatccaaaagtccatcagctaaaaccattgaaatgtacacatttaaagtggtaaattgtatggttggtgaactacatttcaataaaaaataatataatcacaatttaacgtattaggaacaacagaccactgaatcctggcacacagaccatttgttctgctatttcgtattgtataattgggggccaatagagctccctggggttgctgtcttcccctcaataaacacagctccctaaattccaagcagagaaaccaaacaggtacaaaagagcaagagcaagcttggaaactgaggagcatcaaagtgtcaatgcaggtggtatcatccctaccgttggacttttatctgctagatctgcttagcctattttgacaacagtcaagaaggcaaagttcctaaatcctttctcttcaccagaagatttacattccaacaattgattatggcatgtatttggcacagaggtctcatttcatttgaatgacgtcagattcacctaggtttaaaggaattataaaatcaatcagccactgaattatagaactttagaacccaaaaggactttggaaggaggtcacctggcctgattctcttattttggttaaatctgtggcttgctcaaaatcacatagccaagcatggctgagcctgctgggtgtcttgcaatatctatcctccccttctttcctggaaatgccattcccttctccctacctttcagctgcggaccttattgtctggttgtctggaataaaggctgtattttctagtgaggtgtggttgcatgactaaattctggccactgggatgtaaatagaagtggtgtgagtaattcctgggaagtacacttaaaggtcagagtttgacgtggacagatcctccttccttcctgcaggctgggctgcagattagatagctagagtttaagcagccatcctggactatgaggtggaaattcttcctggagaatcggagagcaataagatagaattctgggtctccattaattatagaattgtcataccagctctggaatgttaatcgccagactttatgtgaaagagaaataaaattctatttttttcaacaattgttatttcacttctctatcatttacagttgaattgaattctaactgatacagaacgtgaacaaacaagttgggctgagaactcaggtctcccgaatccaagcatggtactctttattattatgttgatcagttttacaaaatgtatttatttatttcagagatggggcctcgctatgttgctcagggtggagtgcagtggctattcatgggcatgatcatagcgtgctgcagcctcaaaatcctaggctcagccttaaactcctgggctcagcctcctgagtagctggcactacaggaacaagccacggagctgggtacttttttttttttttttttgagacggagttttgctctgtcgcccaggctggagtgcagtggcatgatctcggctcactgcaaaatccgcctcctgggttcacgccattctcctgcctcaggctcccatgtagctgggactacaggtgcccaccaccacgcccagctaatttttggtatttttttttagtacagatggggtttcaccatgttagccaggatggtctccatctcctgacctcatgatctgcccgcctcagcctcccaaagtcctgggattacaggcatgagccaccatgcccggcctttgtttttcctttgagacagtcttgctctgttgcccaggctggagtgcagtggcgtgatctcggctcactacaacttctgccttctgggttcaagcgattctcctgcctcagcctcttgagtagctgggaccacaggcgcctgccaccacacccggctaaattttttctattttttagtagagatgggttttcaccatgttggtggtcaggctggtcttgaactcctggcctcaagtgatccactcgccttggcctcccaaagtgctgggattacaggtgtgagccaccatgcccagccactggttgccttattaattttaataataaaagccaaacggtgctaagtgttttgtatataatagttgcttttaatttttgagtacttaatatgtgataatcactgtttaaatactttataaatgtcactaactcacttaatcctcgtgtcaactcactaaaataggtctattattatcaccatttccattttacagacagagaacctgagacacacagagaaggaataattcacccaaggccatatatttagtaagaggtagagctgagatttaaaccctggcagtctggttctagagcctgtgctctttgctcctatgttacactcgctcttatgatggaagcttctcatcactctctctgcccattttacgggggaggaaactaaaacatacacttgtctaatcatttgcataaaatctgccagtcaatgctgaagccagaattagaagccacgttcctaactcccagtccagtgctctctcctcagaccaccctgctgtctctgaggccacctgagcagacacataatccccaccttctacctccctctccaacacacacacacacacacacacacacacacacacacacacacaccccacccagcaggcacccagacatatttgtggccaggatggctacaacctcctttgaaaagcagccagctttgccctccaccaataactttgttttatttatagtctcctgctcagagcttttgaactggctcccattccagggaagatcttgatagcaactgttccttggagaagtttcataggtgaataaacaccacagagctcctgcctgtctagcagagctttgctcctgggggtgtttacaagtcggtattggtgtctgggtgcataagactttaaattcaaaatgacagtttggacattttcactttttttttggttttcattttaaaaagtttaccctttgacttcaacaacctaaaggcagaggcaaaagggagaaactatctttattcagaaggtgactccaacagaagaagtcttctacgacttatcttctggctttctttcctcccatcctggccgggagctaggacgcaggaccagttacgtagaggctatggggtgggggtagggtggggaggcactccatgcatttataagaactaaaatggcagaagtgatgaatggcatttcgggacagaaaattggaaaaaaaaaaaaaaaaaggaaaaaaagcctaatattaaaaatgtctttggacttgtggccaaaggtgccaccttaaagcatgactatgtcacaggtgtctggaatgattcagtctggacactaatcttggcttcttcactcgttgctagttatgtgaccttgggaatgtggctcagtttcctctttgtaaattagggagatgaacacaggattattgtgaggattggcactaatgatgtacggaaatactgtgtctgatgcagaaagggcactcacccgctcattaaagggtggctaatggtagctgtgattattgcttcctttatgatccctctggccctagaggggatgaaattgaggtgttcatggaagtgaatcccaagggggagcaggggtaggtagcaggctggtgatctcggctctcaaatcctttcatttgcattgagttaatctctatcagggactgttgtgttaacaggaggcttcgatgttggagttcccaaaacggctgataaagggaggcagaggtcctcakcgggagggcagagctgagccaccacgtgggtccacgaagcccccaggtggctttcctgtaggtatgtggggtctccttcaagctctaaggggaaaggaagaggaaaggccttcagatggggaagtggacggtgtgatggagaagaggttctgcacggaacttactggaaggtgcgggatgttaaagggaaaacgtgttttcatggaggcctgggcgggggattagctctcygttagagaggctgggtgggaggcctccaatgggaggattggtggcggtttcatcgggagggcttggggtctccatgagaggattagggtctcttcagggcggctgtgagtggaggtttccagcggggcgcagtggggtgcagatgtgtaagggcctgcaacggaacgccagagtcctccggggcccgcgccctgggagacgtgcgggtgaccgcgctcccgccccgcccccaccggccacggccccgcccccgcgagcggactacacttcccagcagccccagcgggcagcggcggcggcagcgcgggcgggaggggcggtggtgagaggcggagggggcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagtgagtgcggccgggccgggcggagccgggccgggcgcggggcggcgaggccgggccagggctgcaggccgcgggccgcgcgggggacttgttgccgagaccagaggggcgccccgcgtgacgccggcacgcggggagggggacggttgctatggcgatccagggaggcgcgggggcggggtgcgcgcggggtggcagggcgccgggggtcaggtgtcccctcctcacctgggggtcggaacagctgagattacagggcggccccctccccgggtttacggagagcccctgaaaatggtccttcaactgtggggaaggggagtgggaaagccccggaagcacctccccatgtttgggcatgtttggggcgcccctgaaagttggcaggtccggagaggttgcagcctggccgcttgaggcctgcggcccccacagaagtcgcgtgaggttcttagagggaggggccgctcatggtgtggccacctaaggtgtggatggccggggaggaaggcctgtctctctatttcccccctcttatctgtgaaaatctccacgcagcaaggtccaaaggctgtgaaggaggatacctctgtgttgtaaccgagcacctgctcttgataatcgttggaaaggctttgtaactcaatctggcgaattccctcactcattcattcacctggagttcccggtggagggttagctttccggggaaattgttgatacatgtaacttcagaatccactgaaacattgttgctgtccttgtagacttagaagttgactttggaaagtgcaactcttaagcggtccaatttgggtgtgtggctttcgactctatctcccctcccagccaggtcctcttgtggcctctcccttcctctgccccagaactggagatgttttatctctaattactaacaaatgttcactttttcctctgtgactaatagaattgtttaagggcattaaaaagcaaagttgacagcataggcttttctgtaaaacaactttcctaggacactttaaaccctcttacaagaaagtttgtggaatgtgtttatttcagcattttgagaattgtactagggaagtttgaaaggagaagggccttaagggtgaaactaataattattcaaacattgcatctcatgtccaggtgatgcccgtgcagtgtgacccttgcccagccttgcagtcccccgtgtggttaggcttctcatttacaaaatatgtatgagatgcgctgcagcagccttgagacatctgctgaatgaaactagaaaagtttgcttatggtaatgaaaatggaagagtcgcatgaacactctgttaaatctttatttttgtggaaatgagaaaaaagttagaagcatgctccaaacaagagcttgagaggcttgggaggtaaaaagatgtcgtttgtgaaacattgggattaaagaggcactcaagtttagctcctgcttccaagtaagagttgtaaacttggatttcaatagcacttagaaacactttccagaagccaacttagagttgcagagtatgcgtgaggacacttacccttcttgttacagaaaagttcagaaacttgcctgacatgaagcagtgagtgtcagaaccagtattaaaatccagcaagtaaaagttcagatggctagccatcaaatctctctgttgctctccaaggtagcaggttgacaaatacatttctcaaatgtgttttgtggaacccatcgctaattctgagcacttgggttagggaatttactaaggcatggaattgtattaagcgtgaaatgagtatgaagaatagccttattgatcttgaaactagactactctgtgataaaaacttaggcttgggaaatatgttagcttgtggtgaaaccgaaagagaatatgaagagagaagttatgaaaagtagttgtgatttatagtgactgttgattatgcaacttctgcctgtagctaggaatggggatggacaggaaattacccacttaagtgctcytctagttgttggagaagacagagctttggttactactggctggctttccctcctggcagggcattcaagatgttctcctggctgtggtgaaatctaagtgtgcaggttccattgaataggacagtcttggaggtagggacaagggggaggggttccttttgttttctcttgcttatctctgatgcagcaagtcagttgactaggtggaatcaggtctaggttcaaattccagctctttttaatgctaattatgaaactttacacagactgccttttcaacctcagtttccctgaaggtaaaatggggaggactgtgtccaggttgtagggttattatgagcattgaacacagtatcaatgtaaatgtcaggtccatgttaaaaactcagtaattgttaggtttttttcttttttttcaccttctgtatcaaaagactaagaacattactgtatattasaaatgtcagagaaaggtatgtttaaggtaatggagaagaaaattttaatgaccaaggaattaggctgttaacatgcagagtagggcttaacattgtctcattattaaaaaataaaagttgatttaaaacaatattgtgtgtaattgtgaagctggtgtctgttgtgtgatcagtggtaaagcacgtgagttgctaggcacaggtgttgagatttcgtgtttgatcagacttctcttttaagtttaagcctggttgaacacaatctctgtcaggtaccgtggaaatccttaatgtgaaccatttcatgaaaccctcactactgtccagtggtggcgatgctatttattaaccacatttttcaaatgagagaatgggagtttataggcctaagatcagatgccatcccccagacgcctgccttgatgccagtttcctgttgccacccccaccccctcctgttccagtctaggccaggtgcccttcatccgtgtttctgtggccccttgtgtttattgcagtcacaatactgaatctcgtttcttgtctgtgtcccgtaccatgctggacataaacttcttgagaggaaggactgtcttatttatctttgagttccctgtgtcagactcaatgcctggcacatggttgtttgagaagagttcatggaacgcatttaagaaatacattaggatctatattaagattctaattaagaccgagttgagtgtttatcgagttaaaaaaaaaacccttgaggaagaaaagttttatattttataaatttctaaggcaaattatatggtttacgcaggccttttactagattatttagttcttttttttttttttttttttgagatggagttttgctcttgttgcccaggctggagtgcaatggcatgatcttggctcatggcaacctccaacccccgggttcaagcgattctcctgcctcagcttccccagtagttgggattacatgcatgagacaccatgcctggctaattttctttatttggtagagacgggtttctcccgtgttggtcaggctggtcttgaactcccagcctcaggtgatctgcctgccttggcctcccaaagtgctgggattacaggtgtgatgtgagccaccgtgcccagcctcatgtttattttaataaaggaacattgtcttgcctcaaatcaacatttaatggacaaaaaaagagaaggtcaccagtatgcaggtagcaccctggaaacctaaatgttacatctgtatggacatttatctagaagaataaaaggagcagtggtaactgacaatcttcaacaggtatttttaaatcttatttagtgtttgaatgatcccagtggactggaatgtggttaatatgaagcaatttaactgataatgcagacacacagcaggaaactatgtggcagtttaatattgcttgtggtgacatcctagaaattgcttccaggcaccaagtgcaggaagtgggctgtaagtaatcgaaggaagttttctaagtgagtttgaagaaacgtgacatttatggactcagagaaaagcatactctaagacttgaggcataggaacagggcagggcaactaatttggccttgtggtggtgattattctacattagcctgtatacctgtcttctgtccctgtcaaactgtgacctctgtgaggttagtgaccaagaaatttatccatttattcatccatttacctactgtagaactaagaagattaagcacatattaaacaataaatgttagccattattatcataattagtggcaatactgtgcctggcagtgtgctaagtactggggacacaaagatgaacaaatatttttctttaaggctttctaaagtagtggacacaaatgtaaaacaaaaacaatcccttccagactccctccccaccaaaacaaaacaaaacaacaaaaaaaacaaaacacaagtataatacagtataagttaattgcaatggtggagatgccgctggtgacgaataggtgagtaagtgaaggagagactgtcttctggggaggagggagggtcaggaaaggaagccttcaccaaggggatcatgtttcagctgagagataggtaggggtggttagcagagggagtagaggcagtagtgatggtggtggtatcagcagagggagcagtacatatgaggacgtggcatattagggaaataaaaatattaccatttattcctggcacttaaatgccaggaattgtgttagacattgggaattacgatggtgaataatacagattcactcctcacggtgcatacagtcttgtggacctgacattaaaaaaaccaggtgaattcacataaagctatgtggatgttctataaaggaagcacatgagttgcctcagagaaaatgatgggagcgactgtcctattttagatagagtggcgagggaaggcctcactgtggagatgacatttgagctgagacttaaaggatgaggaggtattagtcatctaaagagactaggcaagactttttattccaggccttgaggcaagaaaaccctaggcatatttcaggaacggacagaaggccagtgggtttgagtagtgactgatggcagagaggcttgtggtgaggtcagagggagagaccctggacagggccttgtaggttgtggtaatctgaaaactgtttaagatacgaaattttatagtatgtgaatcttataagattacaacataagattcacatactataatatttactttttttttttttttgagacagtttcactctgtcccccaggctggagtgcagtggtgtgatcttggctcactgctacctccgcctcctgggttcaggtgattcttatgcctcagcctcccaagtagctgggactgcaggtgcccgccaccatgcctgactagtttttgtatttttagtttcaccatgttggccaggctagtctcaaactcctgatgatccgactgccttggcctcccaaagtgctgggattacaggcatgagccactgtgcccagccctaaaatttacttttttaagtggttttaagtatattcacaagggtgattgattaccactaattccagaactttttcatcaccccagaaagaaaccccatgcctgttrgacactcctcattcccccaaacccttcagtcctaggcaatcactaatctacttgctatagatttgccttttatgggcatttcatatattaataaatagaatcatatataacccktcctgcgtggcttctttcacttaatgatttcaagatttatccatgttggagcatgcatgagtgtttcattactttttactgctgaataatattccattgtatggacataccacattttactcatccatttgtcagttgttaggtatttgggttgtttccccttttcatcattatgaatgatgttgctatgaacattttgtgtggacatatgtttttatttcgcttgggtatatacttaggagtggaattgctggatcttttggtaactctatgtaacattttgagaaactgttaaaattgtttcctaaagcagctgtaccactttgtgtaaagtggtattttattgtggttttgatttggcccaaatgagttacatagaaaagatcagtgtagayggagataggtttctaggaagaggttggaacttgaactgaaagaaaggggagatttggagaatggagggggattaccaaaggaagacaagtggaagttatatgacttgaaagtgaggataaaccgatctcatttcaagaatagaggagcagtgttggcttatgatagctctgctccagtttgtttaaaggatcccattgccaaaatacacaaaaagtttgctttttcttgaggcctgttgtatagcacaactaacgtatctctctgctttgtgatgagaccaagaattggaatgtgacttccttccaggccttcttcctctaatgcctattcccctcttccctttctccgccacagtgctgtcctccctgtccccaaaggagaatgtagagagacttggagtggtggaataaaagtctctttgaagaccaagctctccatcgttagtgctcagagtcagccacttgaattttcatgacttttctggaaaacatgttggtgctactccatcactcttttcttagccattgtagtcaacttagagggcattgtacagcagataggaaggttgaaacagaaggtaagacctggagtattgctctaggaaagtatgtttgcattgagttattaaatctgtgtaagttcctggctggagttccggttgcagttgcaaaggtccagcctttttcctggccctagggagagctaatctctgggttcgtaacatcctttttgcttaaaggggctttgtagggacatggaaagataaacaaggaagaaaaataaacaaaatgaagttgttttgttctctacttttattggaatccgtacccattctttccgagtattcaggacttgaaaaggagccaaataaagtaagaaaagatatgttaaaatacatatatgttcctatagaaaagagaggtgacattccaaaagttcatttggacgttggttatgacatttagaatgtgtttccctcttcaagatactgttatgtacaaatcagtaactgttgagggcaagggcattccagatatagggaactgtgtatgcaaaagtcatggggagataaaaggtaaagctgaaatacaggatataaggataaagattacaggagaggaagttgatgaagtaggcatgtgccagtgggatatgatgccattgaagggttgaactggggatgtactatgatcagatttgggtttttaggtagattaccctggcagcagcagtttagaacagtgatatctctggcttttacaagatgacgcattggaacgtgagaatatgttagaaattgtatttatttttatatcaaccttcaaagtttgtattttttaatgtatgtgttagtatagtaaggcattattataatttatggatatttatcagatgtatgctcacttttttactgataggaagaatgcatggaaaaaaatgggaggccactggattgtggaactgtgtaaatagtttttactgctgaagatcaaggtccagagcaaggttttggcagtgtaaagaaaaggaatgacaggccgggcgtggtggctcatgcctgtaatgccagcactttgggaggccaaggagggtggatggcttgagtccaggaagttgagaccagcatgggcaacatgatgaaactctgtctttacaaaaaaatacaacaattagccaggtgtggtggcatgtatctstggtcccagctacttgggaggctgaggtgggaggatcacttgagctcccacagagctcaggagacggaggttgcagtgagtcaagatcacgccactgcattccagcctgggtgacagagtgagaccctgtctcaaaaagaaaaaagaaaaaaaaaaaaaaggatggctttgagagattttaagtagaaatgacaagacttggtgacaaattacacgtaagaggcaaaagaagaatcaaagatgacttgccaaggttagcagagttatgttacaaatggagtatttgtgaggtgaggactggttatatgtttgcttttctgaggaaaagtgaaaagttataattgggataaggcattttagtctgcattgagaatggaaggaatctttgagggatccrtagtgaatgtgtgtgctttattgaatgagtaagacttgaagtgggctggactaaattgctgaaggcaaatctgttcatggtagatttagagagggggaaaagaaaaaccaccttttgaattcactttagccacaggaaaggtttgagggtgttgcattgatctcgcataggctgtatgaataaatggaaggaaggaaaccaatctagagaagatactgtttgactccacgctggcagttcttgaactccggggtgtgagaggagccaggggtatgtgagcattggagtactgagttcccagaactatacattctccctctgagttctaaatttctgagcttcaggttaaaaaaataatatttatggaaggaagctaataaattaacctacagggttgttgtgataattaaaagagatattgtgcctagttctcagtggagatatgactgcttattaaatggcagctatcattaatattgcttggagaggagaaaacacagttgtctgaacaacctggagttaaaaaacaagttaaaaaacagcaagtatgttcctttttatagtattacagttttttttggttttgtttttaaaaascaaagtatttgcttcctttcagtaagaatgttaggatgacgtgtagtgtatttcactgaatttgtttgaaagattgagatgctgatatatacaaagcactattgctcttgctggttgggaagaaaggaagcctatagtctactaagacaggtaagatgagcgtgcaaacaattagaattataacatttaagaacrcttatgtccccagccaggcccggtagctcacacctgtaatctcatcactttgggaggctgaagcaggcagatcatttgaagtcaggagttcgagatcagttgggccaacatggcaaaaccccatctctactaaaaaaaaaaaaaaaaattacaaaaattagctgggcatggtggcgcatgcctgtaatcccagctacttgggaggctgaggtgtgagaactgcttgaacccgggaaggggaggttgcagtgagctgagattgcaccactgtactctagcttgggcaacagagcaagaccctgtcttgaagtaaaaaaaccacttaatgttccctttatcataaatattggaaatctattcagttttataaaagatttatacaaataatttatatttatctctgtttaactggtactacttttcagtctttttaaagtgttttttktgtgtgtgtgtgacagagccttgctcttgtcgcccaggctggagtgcagtggcacgatcttggttcactgcaattactacctcctggattcaagcttcctctgcttcagcctcctgagtagctgggattacaggcacctgccaccatgtccggctaatttttcgtacttttagtagagacggatttctccagtttggccaggctggtctcaaactcctgacctcaggtgatccgcccgcctcggcctcccgaagtgctgggattacaggcttgagccaccatgcccggccttaaagtgattttttattctttttcttcttggtgcttgaacctatttttaaactttattttggaaaattttaaacatctataaaagtagaatagtataatgagcccccaaattcccatcaaccagtttcaacacttaatttatgttttacctagttttatttatagataactgactgtaactccctcccctgctctctagtcctggattattttgaagcaaatcccagatgttgtcatatcatccttttttttttttttttttttctgagacagagtctcactctgtcacccaggctggagtgcagtgatgcartctcggcacgctgcaacctccacctcccaggttcaagtgattctcgtgcctcagccaccccagtagctgggattacaggtgtgcaccaccatgcctggctaatttttgtattgttggtagagatgagatttcaccattttggccaggctgatctcaaacacctgacctcaagtgatctgcctgcctccacctcccaaagtgctgggattacaggtgtgagccaccattccaggccscagatgtcatatcattcttaaatacttccatatgtgcctctaaaaggtagatttttctttttaaaaaacataacattttcacacctaaaaagttaaccaaaaaatttaatttttaattttttttttttagttgaagttgtactttgtcacccaagctggagtgcagtggtgtgatctcggctcactgyaacctctgcctcctgggttcaagcgattctcctgcctcaacctccccagtagctgggattacaggtgtgcgccaccatgcccagctaatttttgtgtttttagtagagacagggtttcaccatgttggtcaggctggtttcaaactcctgaccccaagcagtccacccacctaggcctcccaaagtgctgggattacaggcatgagccactgcacccggtcaaaaaattttaatgttattaaatatccagtcagtgttcaaagtttttcagttatgtcaaatttaaaaaaaacggtggattcgtttgaatcagcgaagttcatacattgcaattggttgatatttgctgtctttttcccccatgcagtttattttttgaagaactgggttatttgtcctatatgatttccgttgcatccttaaggtttgtttaatgtattcctctgtcccctttatttcctacaaattggtagttggattaagtgacttgatgagattcaagttcactttcttggcaagaatattttaaaagtggtgataggtacttccatcaagaggtacattatgtctggttatctctctttgatctgttcattaattagaggttataaaatggtgatattttgtttctatcacttcttcttcatactagctgggatacttgtaaaaagaaaccttttccatatcaaccatttggttgctctgagatacagttcatataggaaaggcagggtaaatgcttgattttattaattttttaaacattttcaaaaggtaatttttgagagaggggagtgtcactttaaatggatgtatttaaacttattggctatatttcaatctgctgtagttactgtcctcactgatgtttaatttgtcctatctttgtccagtgggaatttcttctttttttttttttttctgagacggagtctccctctattgcccaggctggagagcagtggcgtgatctcagctcactgcaagctccgcctcccgggttcacgccattctcctgcttcagcctcccgagtagctgggagtacaggcgcccgccgccacgcccggctaattttttgtattttaagtagagatggggtttcaccgtgttagccaggatggtctcgatctcctgacctcatgatctgcccgccttggcctcccaaagtgctggaattacaggcatgagccaccacgcccrgcytgtccagtgggaatttcaagtgaactctgaagtccttttaacaggatcccagtagtttcttttcttttatttatttatttatttwttttttttgagacagagtctcatcctgttgaccaggctggagtgcagtgacgcgatcttggctcactgcaagctctgccttccgggctcacgctattctcctgcctcaggcttccaagtagctgggactacargtgcccgccaccacgcccggctaattttttttttgtatttttagtagagatggggtttcaccgtgttagccaggwtggtctcgatctcctgaccttgtgatctgccygcctcggcctcccaaagcgctgagattacaggcgtgagccactgttcccggccaggatcccagtagtttctaatagctcccttgccttttggtatgacagagtgtcccagrctcatcatctgtgtttcctcctccagacccagtgtttctctaaggagtcctggttccttttggtgggaaatagtattagaaatcacagcctgggatttaggacttttggggatggggtgggtttgctaccaggtcagtcataatttctaggattctccaggggtcagaatttgggaatatgtgtgtgtgtttttaaaggtaaattgcattatgtgttcatattgctttttccagttctagactatagcagttttatttaacctcatcacttttacattggaattttccatacctatatcaaagtcttgatttccaacaacaccaacaccattactcttttgctttatcccgcaatacctagacagctcaacagcagcactaacattaccgtcaacaatgcgattactgaaaatagttatgtttttggctttttaaaacttggcagttcttttggtcgttagggtatatttcactgggactgtagtcaaattactgttttaaagtcagtagaattggtttttttctgtggttgtgtctccaactcaatacaaagttagttttttgttgttgttgttgttttgttttttgagacagggtcttgctcggtcgcctgggctggagtgcagtggcacgatttcggctcactgcaatttctgcctcctgtgttcgagtgattctcctgcttcagcctcttgagtacctgggactacgggtaactgccaccatgcccagctgatgtttgtatttttagtagagacagggtttcacttttttggccaggctggtctcctgacctcaagtgatctgcccactttggcctcccaaagtgctgggattacaggcaggagccaccgtgcctggcccatagttaggtttttataattttttcttttaatctgttggaattactgtttaaaaataatttgatttttaaaacaattacttaaaatatttatattgtttcaaagccaaagctacaaaacaggcatattcataagtctaacttctatccctgcctaccaccgtgttccttccctgacataggtaccgagtttgattttagattttcatttgtccttccattaaaacaaaaaaggcagccgggcacagtggctcacgcctttaatcccagcactctgggtggccaaggcgggcagatcacctgaggtcgggagttcgagaccagcctgacccacatggagaaaccccgtctctactaaaaatacaaaaataagctgggcgtggtggcacatgcctgtaatcccagctactcgggaggctgaggcaggagaactgcttgaacctgagaggcagaggttgcggtgagccgagattgtgccattgtactctagcctgggcaacaagagcaaaactctgtctcaaaaaaaaaaaaaaaaaagcaaatacgtagatatattcacatctcctcttgccaggccctcagataagtgatagcattccatgtatacttttcgccccttaacttttctcattttataatatatcctgtaaagaggtctctcctggaaaaatacagggaatgtggggctcttcctcatttctctgtaggacagcaatagtactctattggatggatggactatggtttattcaacccatctcatactgacgggcacttaggttgcttctagtcttttattattacaaatggtgcagtaatgaatagtcttgtgtatgcacctttttgtatttttaccattataccattgcgatagatttttccaagtggaatttgggtcaaagggtaattttgtatgtaattttgctagatattgtcaaattctcctccatagagattgtgccaattcatattcccacacgagaatgcttgttgtcatacagcttcatcaacagagtgtttgtcaaactttaaaaattatttttatcagttacaagtgcatgcaaagttacaaacatatatggtcacgaatcaaatacttaataagagcctgtgataagcaacaatcctctaccctattcttccctagtcccactctttggagacaaactcttattaactgaccctatttttagtttttctggttgttaactcataaccatagataaatctctctctgttaattaactttagacagtatctgttaactccttgaaatgaaagacaagtaactttatagtacttctctcttctactcatctgatattttatctattttgtgttactttaatttttataatggttattaacttaaacctctttattgttccattaaccctcaacactgtcttttgatttcacactttgtaaggggaagggtattatcctagctcttccttctaccttttcaaagttatgctttaacattatgtggtcattgaaattttgatccatgaccagaatcaaatcttctgtgatttgtcttttggttaattctaaaagtggaatgttattatgaatatttaaatataagtatttaactccactagatcgggtagggtgctaaaataacattttcagcccatttgaaggagaatgttaataacatcagggtcacagtaatttttttcttgcaatccatccagaattgaaaattatgctaaatgtctttggcatcatatatggataagtttgcatatatttgtacaaaacagcaaattatttgtacactagccctgtagagagagcagcccaggagatcatgcaagtgctttcatcctcatgttggcaggatggaaacctctactttgcagcctttgtgggggccttggcctgggtgctagcttttggccagcagaacctggcaactgatgatgttataatcagcatggctcctgagcttgggactcaggttgagatggtttggatgtttgtcgcctccaaatcccatgtggaaatgtgattcccagtgttggaggtgggacctggtgggaggtgattgggatcgtgggggtgggccctcatgaatggcttggcatcatccccttggtgatgactgagttcttgctctagtagttcatgatctggttgtttaaaagagtgtggctcctccccctccctcccttgtttcactctcactatgtgacacgctggctccctgtcaccttcagccatgattgtaaacttcctgaggcctctccagaagcagatgccagcactgtgagcctacagaactatgagccaattaaacctcttttctttatcaattacccagtcttgggtatttctttttttttttttttttttgagatggagtcttgctctgttgcccaggctggagtgcagtggcgcgatctcggcttattgcaagcttggccttccgggttcatgccattctcctgcctcagcctccagagtagctggaactacatacaggcgctcgccaccatgctcggctaatttttttttgtatttttagtagagacagggtttcactgtgttagccaggatagtctcgatctcctgacctcgtgatccacccacctcggcctcccaaagtgctgggattacaggggtgagacactgcgcctggcattgctataaagaagtcgcaggtactttatagcaatggcaggaacagaccaacacaggtgcccttcaagaccttgagcttgacaaaggccttgatggtcttcattttattggcctgtgtcttttgacccttcttgtgtttcttggcaaagtgcatgatccttaagaactaaggttctacccgcttaaaatatatctttatgatcagggcctatcgatgccatttctgtttggaactggttatgtgtggtatagttctcggacctgaccatgtctgcactgctgcctgcagtgcagaaagtgcctgagactggaaaataaaggtccatatctggcttttgattttttttttttttttttgagataggagtttcgagcccaggctggagtgcaatggcgtgatctcagctcaccacaacctccgcctcccgagttcaagcgattctcctgcctcagcctcccgagtagctgggattacaggcatgcaccaccatggctggctaattttgtatttttagtagagacggggtttctctatgttggtcaggctagtctcgaactcctgacctcaggtgatccacccacctcgtcctcccaaagtgctgggattacaggcgtgagccaccatgcccggtcggattttgatattttaaagcagtattctttctcttcttctccctcttccagagtttcttaaatctttttttccctcttgcattatttgcttttattgtatccttaatttttttccacacttgaaattatacttgcagtttttccaggcttccctgtacccctgatggttccctcccaccttcctgttaaatccttataaaattggctctattgttataaccctggaatgtcctctcatcacttttcaaggttgatttgactatttcctggccctgtgtgatcattttgctttaatttgttcgctggagtrcatattcaggttcttataggagatagccccagtagcacccctgcagaaagagtacataaaaagtaaactgtgggttctcgcatgtctgaaaaatgtctgctttctcacaggggattagtagtttgtatgggcatggagttctaggttgacaaaatttcctgctgaactttgaaggtttttttttttttttttttttttttaaactgtctttggtctggctttctctgacactgctctggaagggaaggaggctgctcttctttgcttttcaaagttggggtgtacattcaggttccctactctgcttccgttgacatccaaggtgaaggattccgttactacactgtagggtgggagttctggctccctagtaggcctccatggaaacctccatggctgggtggggtaatgccttattcttgctcccactggggactcaacagacaccacggggtggaggggagtggtcttgtcccatttcatcactgggaggtgataaaaatccttagtctctggtaggtctcctccacatgatccaagtggacgtgggaaaggggaacctcgttactgccagaggcggtggaagtccagggtctccactgaaaccacactgatggggtcattgttactgcctggtgggggatgatgcaatccccagctccctccttagctttctgtagcactactctggcgggggtgggctggatggggttcctcatcacagcccagaaacctaggctttctccttgtcttttatggatttgggtgagggtgggacgacagggtttcctgtggtgtttggtgagtattttcttaaaaaattttttgacttattagctgccctttttggtcctttggctagaagaaagctggcttttgtttgagcatttttgggtctgcatcaattggcatttccaggttgctgacttctctggctccaacaatgtgatacatgaggcaaggaaaaacccaggggactcatctctgctcactccttgggtcctgaggtcactagctgttctgcttctctctctgcctttcagaaccatcttatgtttgtcttatatgtaatgtgcagrgttttttgttatttctaatgtagattttcttctgccattacacatatttttaaacttaaattttttgctgttatatcatttacatacagtaaagtacacagattttaaggataccacttgattaatttttaatggttatatactcgtgtaatcaccatccagatcaagatacaggctatctccagcatagtataaggcttttcatgccccttccagtcaatacctatttaaaaataatcacggcagggcacggtggctcaagcctgtaatcccagcactttgggaggccgaggtgggcggatcaygaggtcaggagattgagaccatactggctaacatggtgaaaccctgttctctactaaaaatacaaaaaaaaattagccgggcatggtggcgggcacctgtagtcccagcaacttgggaggctgaggcaggggaatggcgtgaacccaggaggcggagcttgcagtgagccaagatcgcaccactgcactccagcctaggcgagagcaagactccgcctcaaaaaaaaaaagaaaaaaaaaatcactattctgatttctgtcactgtagcaattttgcccattcttgaacttcayataaatggaatcttgcagtatatgctcatgggtgtggcttcttctgctctacattgtgttggtagaattcatctgtgttgttgtatgtaattgtagttcattgtttttcattgctgcgtagtacgattcccatttttggctattatgaataaagttgttatgaatattcttatagatgtcttacagttaacaaaagtgttcctttctgttaggtttatacccaggattggaattgcttgttcaaaatttataaatatgtttagctttagtagattctgacagttttccaaattgtgtgccaattcatacctcatcagctatatatgacagttccacttgtttcatatccaacactttatattgttagtcttttttagccatattattagccattaatgtcatgttttcgtagctcattgtggttttaatctgcatttccctgatgactgattactcatgttaagcaccttttcatatgcttcttggccatttrgatatcttcttttgtgaggtacctattcaggtcttttcctgtttttcactatgttctctgttcttttcttactgattggtaggcattctttatattattgaatgtgagtactttgtcagacataagtattacaaaaatctttcttcagtctgcagcttgcctttttacacttaatagtgcttgtttttgtttttgtttttgagatggagtcttgcttcattgcccagactggaatgcaatggcttcatctaggctcactgcaacctctgcctcccaggttcaagtgattcttatgcctcaacctcctactgagtagctgggattacaggtgtgtgccaccacgcctggataattcttgtacttttaatagagacagggtttcaccatgttgtccagcctggtcttgaactcctgacctcaaatgatctgcctgcctcagcctcccaaagtgctgggattacaggcgtgagccactgggcccagccacttaatagtgctttttgattaacaagagatcttaagtctattttattgatcctttcctttctttactttttgatgtgttctgtttaagaaatatttgcctaaccaaagaccatgaatatacttttgtttgttttatcctagaagctttgttttacattttaattttagttccgtgatgtgatccatttcatatgaatttttatgtatgatataagttatacatcaaggttaattccttttcttccctcatgtggttgtccatttgacttaacatttatcaagacgattcttttcccactcaatttcaatggcatctttcttgtaaatcaggtatacgtttgtatttctggactctgttctttccattgcattaataccatgcaatcttaattactgtacctttaaagtaagtctcgttatttaatagtggaattctttcaattttgttattcagattgtttgggactattctaggtcctttgcatgaccatatacattttataatcagcttgtgaaattccacaattttgatggaattgcattgcatccctaatttgtagagagttgatattaacaatattgagtcttctagttaatgaagatgacatatctctccttacatatcttcaattttttttcagcagcattttgtagtttttagtgcagggtcctgaacatcttttgttagatttatttgtagttctttgattttttttcccatactattgtaaatggcattgctttttaaatgtcattttctagtttttactagcatatagaaatacagtagatttctcttgtatgttgacattgtatccagcaaccttgctaaatgtacttaattctaatgatgtttttaggttttttttattttatatgtatacagtcaggttttctgtgaatgacaattttacttcctagtttttgatctttatactttttatttcttgccttatttcactgggtaagacctctgatatgatgaataggttcatctgagtacagatatagtggtcttatacctgaattcagaggaaagtgcttaatatcttaccatctcatcagtgtcaaccagtatgttgatagctgtttttcttagatgcccttgatcagtttgagaagtttctgtccatttttacgttgctgagagtttttgtcatgaatggatgttgaattttaccaaatgccttttctgcatctcttgagacgattataatttttcttttttccagtttttttatttatttttattttttattttattttatattttattttatttttttattgttttttttatttttattttttatactttaagttttagggtacatgtgcacattgtgcgggttagttacatatgtatacatgtgccatgctggtgcgctgcacccactaactcatcatctagcattaggtatatctgccaatgctatcccttcccactccccccaccccaccacaggccccatagtgtgatattccccttcctgtgtccatgtgatctcattgttcatttcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgtcacattttcttaatccagtctatcattgttggacatttgggttggttccaagtctttgctattgtgaataatgccgcaataaacatacgtgtgcaggtgtctttatagcagcatgatttatagtcctttgggtatatacccagtaatgggatggctgggtcgaatggtgtttctagttctagatccctgaggaatctccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttctaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacctatgagcatggaatgttcttccatttgtttgtatcctcttttatttccttgagcagtggtttgtaattctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgactttctcttttcctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattatatttattgatttgcgtatattgaaccagccttgcatgccagggatgaagcccacttgatcatggtggataagctttttgatgtgctgctggattcgttttgccagtattttattgaggatttttgcgtcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctkctatcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcattgcgttatgtatccagtagtcattcaggagcaggttgttcagtttccatgtagttgagcggttttgagtgagattcttaatcctgagttctagtttgattgcagtgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtttgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctttgtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatggktcttgactctttatccaatttgccagtctgtgtcttttaattggagcatttagtccatttacatttaaagttaatattgttatatgtgaatttgatcctgtcattatgatgttagctggttattttgctcattagttgatgcagtttcttcctagtctygatggtctttacattttggcatgattttgcagcggctggtaccattgttcctttccatgtttagcacttccttcaggagctcttttagggcaggcctggtggtgacaaaatctctcagcatttgcttgtctgtaaagtattttatttctccttcacttaygaagcttagtttggctggatatgaaattctgggttgaaaattcttttctttaagaatgttgaatattggtccccactctcttctggcttgtagggtttctgctgagagatctgctgttagtctgatggacttccctttgagggtaacccgacctttctctctggctgcccttaacattttttccatcatttcaactttggtgaatctgacaattatgtgtcttggagttgctcttctcaaggagtatctgtgtggcgttctctgtatttcctgaatctgaacgttggcctgccttgctagattggggaagttctcctggatcatatcctgcagtgttttccaacttggttccattctccccatcactttcaggtacaccaatcagrcgtagatttggtcttttcacatagtcccatatttcttggaggctttgctcatttctttttattcttttttctctaaacttcccttctcgcttcatttcatcttccattgctgataccctttcttccagttgatygcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagcttgtcaaagtcattctccatccagctttgttccgttgctggtgaggaactgcgttcctttggaggaggagagacgctctgcgttttagagtttccagtttttctgttctgttttttccccatctttgtggttttatctacttttggtctttgatgatggtgatgtacagatgggtttttggtgtggatgtcctgtttgttagttttccttctaacagacaggaccctcagctgcaggtctgttggaataccctgctgtgtgaggtgtcagtgtgcccctgctggggggtgcctcccagttaggctgctcgggggtcaggggtcagggaaccacttgaggaggcagtctgcccgttctcagatctccagctgygtgctgggaaaaccactgctctcttcaaagctgtcagacagggacatttaagtctgcagaggttactgctgtctttttgtttgtctgtgcccttcccccagaggtggagcctacagaggcaggcaggcctccttgagctrtggtgggctccacccagttcgagcttcctggctgctttgtttacctaagcaagcctgggcaatggcgggcgcccctcccccagcctcgctgccrccttgctgtttgatctcagactgctgtgctagcaatcagcgagacaccgtgggtgtaggaccctctgagccaggtgcgggatataatatcgtggtgcgccgttttttaagccggtccgaaaagcgcaatattcgggtgggagtgacccaattttccaggtgcatccgtcacctctttctttgactcggaaagggaactccctgaccccttgcgcttcccaagtgaggcaatgcctcaccctgcttcagctcgtgcacggtgcccgcacccactgacctgcgcccactgtctggcactccctagtgagatsaacccggtacctcagatggaaatgcagaaatcacccatcttctgtgttgctcacgctgggagctgtataccggggctgttcctgttcggccatcttctttttttccagtttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagayggggtttcaccgttttagccgggatggtctcgatctcctgacctcgtgatccgcctgcctcggcctcccaaagtgctgggattacaggtgtgagccaccgcgcccggcctttttccagttttatgtagtgaattacatttattttcaaatgttaaaccagccttgcattcctgggataaacccacttggtcatgttatactattcttttttggatattattatattccatttactaatattttgttttatgtttacatctgtattcataagagattttggctacaattttttttttgtaatcttgtcggattttgatatcaaggttacattggcctttttaaaaaaaaaaaaaacagctgttgttacttgtcttgttctcctcttccttgcagctttttgttcctgttttatagaggtggtgttttttttttctctgttctatttaaggatgtcagtttcctgaagcatatttcttaatctttttcagaaatatattcgtcttccaagagatgatgatgcttttctctcatttgcaatgttttttgacagatcttttatttttcacttgctttcttgagtaaggagagctctrtctagatttgctgttttgccacaggtggttgaatgggttaccatgggcactgttctttgtgcttgcgagtgatggtcagatccccttctcagatctgtggctgaagaactggtttatgttcattgttcctagttraattcctagtaactagcaggcatttgcaccacgaaggtagaactttattgccttacagaataagctgaaatttctagagtgcattctgttagaattattcctgtctctgctttcactgaactttttgtgtgtaattattataaccaatgtaactaattttaattcaagagattaggtagctctgcctgtttattagtctctctctgtctctacgtgtgtgtgtatgtgtgtgtgtgtgtgtgtgtgtgtgtgtgtgtatgtgtgtgtgtgacccatgagtataaccaggactgaagggtaaaatgactgaaggtggaagacaaatgaacctgttattatagaagagaggtcatgagggccgatatttggatattttcttttgctttacatgacatcgcctttatttttatttatttatttatttttgagacggagtcttgctctgtctcccaggctagagtgcagtggcgcgatctgggctcactgcaagctctgtctcccgggttcacaccattctcctgcctcagcctctcgagtagctgggactacaggcgcccaccaccgtgcccagctaattttttttgtatttttagcagagatgaagtttcactgtgttagccaggatggtctcgatcttctgacctcgtgatccacccgcctcagcctccyacagtgctgggattacaggcagacatcacctttattttaagagtccaggtgtcagtgagaattatcaagatgtagcatcagaagattagaaggtcttcacaaccacatgatgaggactctagagtttgtagcctgggtgattgagagaaagacgtggcagaactaggattaaaaatagggaaattgagatttttctagggaaataaatgattgctttgatatgggttatattaagtgtgaggagctttccaggggcaggtgacatttagacctgaatgaagttcatgacagtggaaactaaagttatagtttgggaatcgcagagtgtggtgatagtgggaatgaaagaaacttcatgaatttttaataggagggtagagggcaggagagagggaatagtctgtaagatgttggggacatctcacatcctaaatgcaaatatctagccttgttgcttcatgcactcatctctccgctgatgttcccttggtccagggcaccatcttctcctaccttaatggctgtaattcctcctgactgggctctttctaccactttgactcttccagtccagtctctgtacagtatccagggtgagccttccagaagaccaatctgaacatgtcagttgactgcttaaaatccttcagctgctctccatgcttccagattaaaatccatacacctaatatggctttaaggccctttgagacctcaactctgtctgttagtataaaaataacacaaattgaataaccaaaatttattgaactcttttgaactttagaacttattccaaatagtttatatttgttgtcttgttaaattttcatgtttattctttgagtttatccttattaacaatcctatggagaaggtactgttagatccccattttacagatgagaaagtcacagagaggtttccagttgcacaaggtcacagagctatcaagtgtggaatgaataaatttacatcattatgttatttaatcctctccataatcctatgaagtaagtattkttatcactgccctttacaaatgaagtgactgaagtcagagatgttaggccgtttgtgtggtggagctgcaactggagcccagatcgatgtgattstaagtgtattttgtcttccatgctagtctgaccgcagcctcattsatagcacccctcacctctcaccttaatcacacgtgtagattcccttgtttaacttctgctcattctttaggtttcagctcaattagagctctggctgagaacccttaagcgagcatcccctttaccctcctgccgcacttgaaggcactttgttatcatcactggctgttagtgttctttgattgtctttctcatagtgtgtgggcttcatgaagtcaggtactgtgagcctcttgctcactgttaaaccttgagtgacttgcactgtatgtggcacataacggtactcagttgctgtatattgcataattacataaatgtttaactcagtgatgcagtttggtgttgactgggtttcgttcttaaaagaatataatcagtagtctatttatatgtttaactcccaggatttatatttgtgatggttccagataactgataatccccaaatcatgtggctttagcaatccgctttaggagtataaatatttatatttctgttatttttcttaggctaatgttgtgctttatctatggtgtaaatactgataatcagaagagaatggcaatccagaacgtgctggtttaactggtgaatgtagcctaggctgtctcacttgtgactagaatacaaagtcagttattcttacagtgatcattgaaagttattcctattccacctataagctggttattctctttgctaccacaggataagtagttatagcctggaattgaggagaaagaaatttatagtgtcccaatggcctactttttaatattttctcaggcaaattggtctgacctttcctaccttggtctgacttcctcataggaaaagtttcacattgcacaggaaagaacaatttagcaggaatataagttgcaaattattagttcagtggtactcaagcatgttcaggtgatgaagtacctaaaagtcatggtattctgtggaatactatgaaatatttatatattaaactttacattttttccctaaatcagatattattttatattacattccagaatagacagggagtagcaggtgataaaggtttaagaaaaatttgtggtaagaaaacttaaaattatattaccttattttttcatgcaaattgggaaaaggccatttttggcacctttgtctagcttccaaacctccagcatttaaggtagtgtagttagagaaccattaaattaattgaatatgggggagagaggagaagctgaaatgaaaggtgatgatatcaaggtttccaayttgggcctcataatacccttcatagacactggcgagtcaggagggagaactggcattgaggtcgagaaggatgaatttggttgattgtaaactaatgataggctgaggagagagatgcagtagacagaagagaagcacagtgcctgtcacctagcatggttctcaataattattggctgccatttgtcaccaggaagatagtgtagagatttggaaattatgggcatgaatgaataagaactgttttcaggctgaatatagtgaagtgagtttcaagatttgagcctcggggaatagaagagacaaagttaagccttgtagaatgctgttgggaagtcagtggaagtggaaattcagaaagggtgatttggtttaatggtgggttgtggatgttctgtgaggagatatagtctcagtaatgtgttgcctttattcattcatctaaagcagaaatctaggaattacctttgataccttccatgttattttatccccctaatctaatgataaggtgctgtcaagtttaccttcttaagtaggacacaaagagcacactgtaaaagagtaaactgaactttatcaaaattaaagtcttttgctcttcaaaacctgtcattaagaaaatgaaaagacaaaccacagacttctaaaaaacacatgcatttggccagttctttctatttccatttccaccttcatgtaaaacatatatcagctgggcatgttggctcacgcctgtaattttgggaggctgaggcaggaagattgcatgagcctaggagtttgagactagcctgggctaatagggagaccctgtctttacaaaagaaaaaaaaaatagctggatgtggtggtgcatggctgtagtcctggctacttgggaggctgaaggggaagaattgcttgagccaggaggttgaggctgcagtaagctgtgttcatgtcattgcactccagtctgggctrcagagtgagaccctgtctcaaaaaataaaataaaaaataaaatgtatcatattatatgtacatatgagaccctcataactcaataagacaatccaataaaaatggacaaaagatttgaaaagagtattaaagaagatatacaaatggaaaataagtgcaagaaaaaatgctcagcatcattttagtcattaggaaaatgcaaattaaaactacagtgagaaagctcctacacccccaatagaatggctaaaattacaaagtctgggctgggcacagggcttacacttaggtgggaggattgctcaaggatacaggactttgagaccctacctttaaattaaaaaaaaattttttttagttgttgactaggatgtatgtatgtagaagaagaggacctgtggacctttttttttttttttttccgcttgagacagggtcctactctgttgcccggagtggagtggcaraaccatggctcactgcagccttgaactcctgggctcaagcagtcctcttaagtagctgtgcacactgccacatctgcctaatttttaaatttttggtggagactgggtcttgctatgctccccaggctggtcttgaactcctggcctcaagcgatcctctctcttggcctctcaaagtgttgagtttacaggtgtgagccactgcactgggccagacctttatgcattgctggtaggctccgaggtgagccctggagttcaaaatcagctttctgaagtcattttcttgaactgccctctcttgccatctcctcagtgccctgcggctccctttatttaaccctgctctgctgtgtacttcccatgattgtgtatgtagtctgggcttcgcagtgagaggacagagtagaaaagaaagtaataggggtttgccctatcctcttaaggccacacttcctctggttgtagggaaaggttccttccctcactcaatgctttaggtacctgtaggctgctgcctcttttctacttcttgagcctgaactagccagcttctcttggaagttattcatgctgatgtccacgtccagtatttgggctgccttgagtctatgctgagtgataatggaggaacaaactcaaacacaccactggtttggtggtacttttaattagaatcttctatcccatttcatctgctactctactttctaggttcctcaaatagcgctccatgaattctcccctggttttatagaggtattttctcgttgtggagagacagggtggagtgtgcctgttactgggagccagaacttctagatttctttttatttattttgctttgcgttcattggtccttttaaatgtgtgaatgtgtatctgttgttagttctgggaagttctctgtattttcagaccaagaatgaagttaagstagaaatcttaagagatagctagagtattaaaaacagctgttggctatgtctcatcctcttctcttccagagtattgatttgtcttaatgttttacttctgcgtttatcttgtgtagcttttgttttctattttctgtttttctttttgaactctattttgtatcatttctttaagttcatgaattctctccctggttgtatctttcctgctcttaagtcatccgttcagttattcattcttattttgagaactattttgttctttttcagttttccttggtcatgtcatagtttcttactgtttactcatttttaatcttttaaaaatttatttaagcttattaaatattccatattctgtctcccataattctaatacctgaagtctgaaggtctgactctgccatcttttatttctgaggttcttatttatgggccttgtttccccagggttttctgatttttgccagtgagctcatatttcttggagctttctgtgagaaaaattttgaagccgagtttgaagtggatttttccagagaaggtttacatattttgttagtgtcctgaagccactcttagtttgggaccacttcggtttaaattctggggttgagggttttttttktttgtttgtttgtttgtttgttttcagagagtctcactctgttgcctagggtggagtgcagtggcagtatcctggctgactgcagccttgaactcctgggctcaagctaacatcctgcctcagcctcccgagtagccaagactacaggcgtgtaccaccatgccctgctgattttttaatttttttttattttttcctgatggagctggggtcttgctctgctaaccaggctggtctcatattcctgggctcagcttacccaagtgctagaattacagatgtgagccaccatgcctggcctgttgagatttttttgaccactcagtagcagtcccttgtgagggcctgcttgtgtttgaactggtggaaaaatttccctttctcagtgctgagttttgaggctagtggtttttatgacagttcctgagatgtgtatgtgtgtggatgggtttctttcttcatcaccttggtcatcccactttaaatggtgggagagggatgtctgttacacttttctccttaggctgaatgttcgttttgtcttgaattccttgagccccttagattgggagaatggagcatgcattggactacataaatatcttcaaggagaaagtgagtttttgtgttttggtaaccctgttaggtttctatcttcacttagttctttgtctgaatctttgttcttttctttttttctttttttttttttgagtcagagtctcactctatcgcccaggctggtgtgcagtggcataatctcggctcagtgccacctccacctcctgggttcaagtgattctcctacctcagcctcccaagtagctgggattacaggcacatgctactatgcctggctaattttttatatttttagtagagatggggcttcactatgttggccaggctggtcttgaactcctgatctcaagtgatccacccgccttggcctctcatagtgctgggattacaggtgtgaaccaccatacccgaccgaatctttgttattttcttgcaagctcatcaatgtatttatctgagaagatggaaaaaaaccattatttatagttttcagtggaggatctgaagggtacttagtaggaatttgcaagtggcatgcagctatggtcccagcacctagggaggctgaagtgggaggattgcttgaggctggcagttcaagggtgcagtgtgctatgatcatgcctgtgaatagtcactgcaccccagcccaggcaatatggcagcaccctgtctcttaaaaaaaaaaaaaaggaacttgcagctgcagtgtttctgagtttcaatcagggtgattctgctagcattctccagcctctgcatgagcattcatacctctgtactttgctcagcatgtgtctcttgtttaaaatccccccactcctctccacctagccaaacccagttcattctgcaatgtgaacaatcaagtttcacctcttcatggtgcttctcttgaatgctgtagctcactggttcccaaatgtttggaatattttaaagtacagacttaaaaacaaattttgtggagttacatcaaaatgatcatctcctgtcaccattatttttgaaaagaaattacattttcatatctraaaggcaggaggaatatgatgtccaattaaggatagtttttataattgaattaaatatctttatatggaaagtacactgtattgtccccgtttttctcattttgctactgattagaaaaagcctcattgcatcctatccgctgataatcaggaccacaaccttagctcagaatgatgtcttcaatttgcaaacccacagcattttgttttatcaattcgtggcagccagtcatttatttctattgatttcaaacagcccatgtttggctgtttacattttatgttttgtctccttgacttggttgtaagctccttaggagccattatctgtgtgtatttagattactcataaatatgtgttgaatgagttaaatttagatacctcggatgatggttgaaacctagcaatatttatagagcacacatttgagtatatcacagttctgaacgttgtttacttctggaggaaaaagaagttttaatgtgaatcatgagtcacttactcatctctctcctcctcagggaatttcattcacttaacaaattcaccaagcgcttgtttaaaaaccaggtcttttgttagggatctgggaatacagaggtgaagtgaaacaaagttcccagtgtagtaggtaatatgtatatataagtacaaagcatagaataccacctgggaagccttataacagggctttgaaaccagttttgtgacggtgtggagagagcaactgagctttgtaagggggtgagagaagcctccagagaggaggaggcatttgttcattcactttccattcattcagcaaatatctcttaagtgcctactacttgccaagcactgttctagatgcatcttgaataaataggacattgttaggagatggaacacattttaggtggggaaattatgataaagagcatgccctttgaagtaagaacagacctgggcttgagttcatacactgccacttactagatatttgtctttgggcaagcaattcaatttctagaagattcttacttttgtaaagtgctgtagatcctccctccctcacagtatgtcatgtgggtaaagtgaggtgctgtatataaaattaagcttagcacagtgcccagcccctctgaaatagtgcaataagtgacaaatgtatatacaaggcatgtaagtgattgaggcctgatggtaagattaacatgactaaaatgtgggggcatgtgggttggtagggggtggtgggcagatgaagctgataagtctggtctcacygaggctaaattgcaaatagtcttgcatcrcatgtcctgctaatgacggtcttttaactcctgaatgcatttgggagcctttgaggtttacattgtgtttttgtcttttcttttttaaactatgcagtggcatgctgagctgtagcatagtgattagggacatggactctggagccaaatctgcctgggttctagtcccagctgtctcacttactaaatgtttgactttaactgatctgttcgttagtttcttcattggtaaactggatgataatcatatctatcttaaatgtttatcttgttttgtttgtacaatgctctttgaatcactttttttttttwaaaaacatataatcctgtacgtatagtgggccagtgggccatgagccaccatgcccagaccattctttattcttattctttattcttttttattcttattctttattattattattcttattatttttgagacggcatctcactctgtcacccaggctggagtgcagtggcgcgatctcggctccccgcaacccctgcctctcaggttcaagcaattctcctgcctcagccacttgagtagctgggattacaggtgcccacgaccacacccggctaatttttgtatttttagtagagacagggtttcaccatgttggccaggctggtcttcaactcctgacctcaagtgatccatctgccttggcatctcaaagtgctgggatattattttattttaccttctgggatacatgtgtaggatgtgcaggtttgttacataggtaaatgtgtgccatggtggtttgctgcacctgtcaatccatcacctaggtattaagccccacatgtattagctatttaccctgatgctctccctctgtttttgtattcttataaatattcttgggtttcctcaggggagtaatctgaggcagtcataggctcacttctttcttttccatctttcaaggcattgctgcactttgttgcctaatgtcttgaaaaccattgtttcatatgttttgtctatgttactttgaaataatgtgctccttccgagtcttgctttttaaggtttgttaagtgggattggagttgtgctcagtctagggctagactaggcaacctagaattttattctccatttctaaggtaatactctattgtgtactctatccaatgcaccatgaacatgagttttccacttcggctggggggaataggcattatttctaaccctgtgtgagtaccagctactgcacctgtaatcttttttgctggttctttgtgcaggcttaagttatttcctcacatacacatgctaatcagtacttagctatatacttgagggggctcttgcagatctctggagttctttctctgtgcagctctcttcactccagcactctgtgctgcaaactcaactgccttggtttccctggacgcttagctctgtctctcagctccaggtgtttgctgggctttgcttaggtcccccctccttgcaccataatctggaaactctcaaagtggtgagctggggcatcagagggctcagctcacttgtttacttctctcagggatcactgtgctttgttgtctgttctccagtctcttgaaaaacattgttcgagagaaggatggatggatcgatggaattttggttgtttcagatggaagggtaaatgtggtccatgttactccatctctgctggatttgagattccagtaaatttgttatatacttatttaaatttttgatagcctgctactgccggtataagatggtatctgatttagtacgattttatttattattattaaagtgtatatttcaaggtcttctaaagagtctcacgatttctaggttgtgtgccatcttggcacattgagaagaactactgttcttttatagtagttccaaaatccaactgatcagaatcacttaggaaaataggttcatagatcaatagattatcaaaatcacttttcagaaaatagatacctgggctttatttcccacctaatgaatcagtcttcagtggtagaacctgggaatctgatttaaaaaacttctaggtgatttgagactgagtcagtatagtgtacgttacgttgttaagagcacgagttccatggtgactgtgatctatgatgacaactcactaaggtccaaatggagcagtggcagagggagaggcaagttcttctcagaaaagggaacttgggaccatgaaggagagaggagctcagtgcttctgggagacatggggaaggcaccactctgtaattctggatctccctgaagtcaggttgtgagctctctggatggctcaaaggactactcaaggagtgctgagaacctgagctcactgttctgaaggccttttcagttgcccttaggtgctaacacaacagccagacactatggtttttgaagggtgtgtggaggagaaaaacaattgggcctataataaggttcattaaaaaaaaattagtggaataggggttacatgggtatatgcagttgcccaagttccttgaactagacacttacaatgagtgcattttagtgtatgtatattagcatacatgtaattgtgaggatacaattatatgttggaggtataaagttgattttaaaaattcaagaatatagactctagagccacactctctgggttcaaattccagctctatctcttacaaactgtgtgaacttggacaagcttctgaacttgtatttcagtttcctcatctgtaaaatgagaatgatggtaatagtagttctttcatagagttgttgggaaggttaagtgaaataatagatgaaaagtgcttagaaaaatatctgacacatatttaagtgtttagtacatattaacaagatttagaagtgacttggtcttctgcagaatatctgctcttcttagatggggtaatggaaataaccttcccctcacaggcttggcgggagggttaaataagaaagaacataaaagcaagtcatcaatgaaacaaggggttcttgttgcatattcctccataaatagcttcatgaacgccttgacatttttatgtaaaaaatattccatttaagcacatttttctggggagatggtgaagcttttcatggcctcctcagagaagtctgtggcccaccattcccccagccactctaaacaggtgtgagtaatttttggacaggcaacgtggtgtggtggaaaaggcatgggttttggaatcttaaaaccagggttcagttggagttctaccacttcctggcctcagtttcccttactgtaaaacaaggaaaataccaccatcttattacctgacacggttttgacaatcagcttcagaaacatatgtgagttctaaggtaaccataaagtattttacagatgttcactttattactgactgaggggcataagttgcacatccatggactcttttgaattttttttttttcccgaagatggagtttcactcttgttgcccaggctggagtgcaatggtgccgtcttggctgactgcagcctctgccttccaggttcaagcgattctcctgattcagcctcccaagtagctggggttacagctgtgtgccaccaggcctggctaatttttgtatttttagtagagacggggtttcaccatgttggccaggctggtcttgaactcctgacctcaggtgatctacctgcctcggcctcccaaagtgctggaattacaggtatgagccaccacgcccggcctcttttgatttttatacattgcatttattcagtattttttttcctctgtagaggagagactttttcttcagttttggtaaaatgagaatttctttctgactgcacaatccatcccttgttcttaaaatccctttatttattgcctagactaatgtttctattcggatagttccctattttctggattgcttttagtgacggtatttgaaagcctaatggttttgagtctttgaaatacacagtaatatgtggattacttataaagcctattattggtaaggtgaagccattttatttttatatgatacgtgataataccctttacattagtttaacatcttttagtttacaaagcactttctcatttttctctcatttgatccctgaaacaacttttgagatgagcagggcaggtatatatcttgacagaggaggaagccgaaaggttaaatggcttgtcctaatcccataacaagtaagggatctacctgggatttgaacccaagcctcctgatgtttagtttggggttctttccatagaaccacatgtcattcctgtgagaaagtcttggtaaaaggaaggtcagagaaattggtatttaatgaatgattttaaaaaaatatttttccaggaactagaatcttatagaaaagttggcagtacagtgtaaagaacttaaaatacacacacacacacacacacacacacacacacacacacacacacacacagtttaaagcacggtattgacctgatgcatcatcacccttgaatgtttcagtgtgcttctcctacaaacaaggttattctcccctctaacgcaatgcaaacatcaaaatcagcaagttaatggcaatttgttactacgtctaatcctaagactgcattcaggtttcactagtggtcccaataacatcctttacagcaaaagaatcacacattgcatttagttgtcatttctctttagtttcctttagtctggaagagattttcagcctttccttgattttcatgacgttgacacttttgaagattaaggccagatattttctagaaggtccttccacttggttttgtctgatgtttcttcaggtgtagcatctccgacaggaatatcgcagcagtgatggtgtgccctgctctttgcggtccagcagtttcttccattactgatggtgatcactttgacttgactaggtttttgccaaacttctgcattgaaagttactctcttctcccttgtattcagtattttgtgggggaggtactttgaaactgtgtaaatataccatttctcattaaacttttcaatttattcccttatttagatgcgtatgaactcatggcttcttgttttatttgatggatccaaatctgttaatatccttactgatttggatgctcagactgccccagatttggccagtggaagccctttcaggcttgctcccrtgtcccttcaatgtatccccatcattctttgagcacttctttgcttcctggcacaaaaaatgttccaagttcatctagcacgttccctgtcttagtgctagaatcagctatttctcctaggagccctggttccttttagaggagaattgtatttagaagccaaggcctgggaattaggtgtgctcattgctgttggggtgttgctgctcccaggccctcccagtagccagagctgggaaatatgtgtgcatgtgaaaagtcaggttacatttatgctttatttttctatcaagttatatatatacatataaaccttgagcacattctaatatctkcatttcaaatccaactttgtataagtcatgttggttttctgttaacttcaactgtaagaaaccagccttccccatgtcttccaagtagccttgggttcagattaggcacacggccccttcacctccaccctgtgtgcatgctcgcctccttcttcaccttgctttcttggcatcacaaggacttgatggtggttctccacacctcctgccccactgccctgcttggactctgactcccactcactctgggaagcctcctcctacccaacatggacgatctcctcatgcctgcttgggcactggcctccattctcgggggccctaatgcttagacatgctcctcaccctctgcagctctgacaccctgtgttgggatgccctcacatgggtaccccctcattctgcctgtgcttcaacaccccaggcccagctgtgctgtgcgtgaatacccttccaccccactcaggttctgacttcccacaccaggttgttccctgagtagatgtcttcctcatcagttggattgtgcatcttatgccaggacatccctcagcatggatgttgccccttcatagggacaccttccttgccccgcccaggctctgacatctcacactgggctgtcaccagcatgaacgtctacctcactctgcctacctaacaggtttaggactaaactgttcagaaagggaaggggaggtttttacatttttgtaaggtcaaaaatgtttattgataatgagataaatatcacctttgcaaatgcccttaatgggtaaagcctagattttacactgcagctcagcatatgagacaacttattaacactgtgtgttgtactgcacattgctgaggggtgttcaggctttgtctctctgcttggaatgcagctaaccctcctccagttaccttgcttgcacttagaggcttaagaatcttcccgtagggatatatggaaggtaaacctttgtgactcttttcgtagcaatatctgcgtatcttcattaatctgatcctgagaacattattagaaatgaagttaagtgtagtcttgaaacgacttgtttgtgtaattacacaactaagttaattttctaacaagtctcaacaatgactgcattctcctatggaggtgttaacttgttatgggctagaaagcactctttgatacaatgttttcagcctggaaaaaaaggctttaatttcagagtccagtgaaacaaatggagacttgttggaaattttaacactacctttttgcttgtttttctagcttaaaggactcaatgtttattaggtggtgtttgctagtgcgttctgaagtgtatacagtttcttttgaccatgttgtcaagtttaagagagttcaattggtatgaatttttaaacggtacacctcagccccttcagcatgtaagtttgtaactaaggaaacactgcgctgaagctggtttgaagttttgaagaccgtgaaawgagtaaggggtcctaataactatttcgtttcaggtctgtagctctaaattacccttaaaaggactagggcctaccattgtggcatggttaccatatgcaacacagattcattttatgaggagttaatgttacatttttctcctaatctcatatattctaattgaggaaaaktagatcctaattaaaagctgatgatccagcagagtgatcaatagcatgatgccttgaaaaaaaaaacaaaacaaaaaacgccattaagctttgctgctgcctaaatactgtcaaagcctttgtctatttcatggcttcaagctgagtgtacttaatctttttgagaacatggtcctggctgggtgtggtggctcacgcctgtaatcccagaactttgggaggctgagaygggcagataagttgaggtcaagagttcaggaccagcctgggcaacatggtgaaaccccatctctcctaaaattacaaaaatcccggacatggtggcaggtgcctgtaatcccagctacttgggaggatgaggcaggataatcacttgaacccgggaggcggaggttgcagtgagctgagatcatgccactgcactccagcctgggcaacagagtgagactatctcgaaaagaaaaaaaaagaacatggtcctgagcactgagcatgacccttccggtgcactgagaactgtgttcagcagagagatcttgaatagaaatgctctattggcttaccctcagccttcattctcccagaagcaaaaactgagcagacctcccttctttcaaaaacgttttagctgtttgtatttgccatttttcagtgtttaagagctgaggctgttgtcagcaggtgtgacttattgagaacttttactccaaaggaaaacatctttacagagtaataggtgtaagcagtgtgtattctgtaaattacctcttgtcagagaaagagaagtgattagtgggagctggaaacgtgtcagatgttggaggaaaactcattcatgaaacatttattgagccaggtgtcagactagggttatgagaagacacagttggtaccctcaaggagctgccagtctagtggggaagaatgtattatattttatctgagacacaccagtggttctcaaccttgactgtactttggaataagtttaggaattaaaaagtatcagtgcctggagattctgatttaattggtctgcgatatagactgggcatcaggatttttaaaagccccccaggtaattgtaattgtaccagggttggatatggtgagagcctggagagtgggaagtacagggtgcttgggagcataaaggtggggcacttaacccagtctaggctgtgtgcgtgcgtctgtgtgtgtgtgtgtgagagagagagtgagtgtgtgtgtgtgtgtgtgtgtgtgtgtgtgtgcgcgcgcgctcgcaggtcaggtgggagatgggagggttgttgaacaataatacttcctagagaagaggaagtgcctgagtttgtcaagtgaaaaagcctggaaagactgttcttggcaaaaaagcaattgaataatgtagaatagtgaagtggttattgtctttggagttagttccatgctgattctgctgcttggtcattttgtctttggccaatttattctctgtgagcttcagtgtcctcatctctaaaccgggagtagtattacctgtggggttgttgaggactaattgaggtaatgcatgtgaagtgcttaggatcatggctggcacataggaagcagtaagtggtgttagctgtatggaaatggtataattgtcctagaattagggcatgcatgcatggtttgcttagagagctacaagtagatctatatggctggattgtagggtacaagactgaagaagatggggggtgggaggcaaaaaaaatgcttggcaggtgggcagggttaggagtctataggagaatgaaacaattaataatgggatatcatggcagagccaggacatttccatggtaatatcttaagatgtatcatgaagtgttctgggaaaacttgggtccatattggaaaattggctctgaatgtggcattctcagcatcattacatgtaccaaattagcagtgagtgttaataggacagaaataggattttcagttcctttagccaaaaagttaaaaatattaaacatcytgaagagtaatggagggataagcaatctcaaggtggtcgcagagagcctctggaaattgttatagtcttaattgtttacaggcttaatgaaaataccaactaagggggttgcttggctatttgcatttagaggaggcacttttttatttttgatttgcagagaaatagagaatgcttctatctgcgttggcttccctggcccttaaaataactgatgtatatttgttggtatgttacataacttgtcacaacattactcaccacttcttccataaggcaacatggaaatgatcatggataagcatgaccataacttataattatagaccaatttgttcttagcattttagctcttttttttttttttttttgagactgtcataatccttggctccatgtaatggaatagaactctaccagctgtttgaactgagtaagaatcttaggtggctttattatgactcattagagtgaggcagtaactacagatagtggtagaagaagaggaataaccttccttgtttccacaaatgccttttttctttgaaatttatcttttattgcaaacgcactattgaaataatggattactgtggtatcccctatgtttatgatgtatattctaaattatctggaagaattctacttaactggtagttcttaaagtatggtcacgggtccagcagcatcaggatgacttggagacttgttagaaatacaattcttgggtcctacctgagacactctggggatgggaactgaaatcttttagttaagccctccaggtgactatagtacttgctaaagtttgagaatcgtggaactggatgatcacacccatcatttattgaaatcttttagacctcaggaaggcaactctattctttatgccttctacccagtatttaggtggcactggctgtgtgccagtcacttcccaggcaccagggaaacactccttgacatgatagacaagatccctgctctccagcagcttacatttagagaaaggagactgactgtaaaccaagattatggcaggtataatgtggagaattacagttaggtgatagagtgtgtgttggggaaggtctttctgaggaggccaaatataagctgagttttcaatgccaagaaggaccacctgtgtgaagatcaatataaaggactgtaagatgggacttctctttggtgtgtttgaggagcagaaagaaggtcattgtggctggagttcagtgggcaaggggagagaggtataaaatgaagttggacaggtaggcagaggccagatcatgtaggactttgtaggcattgctaaggactgccaccttctttttctgttttgtttgtttaaattgtggtaaatttcacataagacttcccatcttaaccacgttcaagtgtacagttcaaaggtattatgtgtattcatattgtggggcaacaattgtcaatgtgcagctccaggactacaactttgacttgactttgagtggtgtggggagcttttaggagatttgagcaaagaagtgacataacctgaacttcagaataaaaggattactgtctgttaatgttgtgatctgactctatagaggggcaaggaagaaagcagggrgacccatcaggagggtgctgcagtaatcgaggtgatatgatagtgatctatcaaggatggttgtatttgggggtgctgagaaacgttgagattctggatgtattttgatggtagaatcagtagaattttctgattggttgactgtggcatatgaaacgggagtcgaggatgacattaagttttgttagtctcagcaactagtagagttcaggagatgcaggtttgagggagaaaaatatgatatgttaaattagaaatgcttcttagatgcccaaatgggattttttttttttttttttgaaacaaggttttgctatgttgctcaggctggtctcaaactcctggcctcaaacaatcctcctgcgttggcctctccagtagctgggcatcccccaccatgcctggcccagtggggatgttgagtaggcagctgggtaagggagtctggagtcagggaagaagtagtcaggttggagatgtgactggggcttgtatgcatggtaatgaaagcccagagactgaatgagatcatctaagcaatgagtggagacagggacagtaggagagctaacctgagaaggaattcgcaaaggagtagccagtgaggtaggaagaggatcaacagagagcaacgtcctggaagccaagaaaagaaagacattcaaggaggagggcagatggatgaactatcaaatgctattgacaggccgagtaagatgagcactgagaattgagcatttaaatacattttagcaatgcagaggtctgtggttaccttgaccaagttgtttcagtggtgtcgtgggttcagaagcctggttggagtatgttagagaaaggaagaagcagcagaaacaatgagtatatacattaggccatttttcacttagatagcagggctgtacaaaacaccctgtggtacaggataatgtgttggtgtccccgtgttttaaagtttggatataacacctttkcatgctcattttatttcaatttttaaaatgcataaaaataaattaaaaatggaaacttgagtaaaaatgtgggaagctctaaagaacctccatgaagtcctagggtcctgaagaacacactttgaaggctgttatattaatccaaaggaatgaaattctgagatgaaattcagccatttgcaaactaggcttaagaaagacattttgaggtttcagagagaatcttcctgatgctcttcagattatactacctattactcatgaaagaacctttgaacttccctttctttcatcaaatgttctaccttaagatcttttgaatgaaaggggtgtttgcatatggtattttccacaaatatttggtcccatatgccaaagatgccaagatcattttgtaccctcttgcagggaaaaaagagcacaacaattttttaaggtcctcttgaaacttcagtttacttaatttttttaagtaagatactgtgacttaatgtctgattttaaaaataactcagtttgacaaggtatatttaaataccttgaattttagagcagccaggtctttgctacagacgcttgaaagcaaaagcccatgtttctctctgggggagaaatgacgattttacacccccgaaataagtagattcctgattcacaaaacacttatttttctttcccctcctaaggaagtagagggagtattaccattttttagtgagtgtaaaatgccattatttataatataagcctttatttaaggtattactaggaaaaaatgccggctcttagaattgtaaaatgctgtcggttgtaagagatatgaaaacgtggggggaaacagttcattctagaatcgagtgaaataggatttgataaacaggaggcatgagttctggtcctggccatgtttctagacaagtcactttagaatccctttgcatgaggttgctcatttgtatggttgtagtaatcctgacacacctatctctcaggattatgatgacgatgaaatgagataactgagattgctattttgaaaagtagatgccgctgggcatattaaaagtatttatttgatgtaaataaatccttagagatgattaggcaactcagaaggtttcttacctcatgtttgttgtcagatttaaaatagaattaagttacagatatttgaaagtacaacattttcttctgctacatgatttttatttcatctggaaacatctttttatggtagttttgaaattaaagagaaaatgtaaaaataatataaccacagtattcttattatctagaattaaccataaacattctgttctgtgatcttttaaaaatttatgaactattggctgggtgcagtggctcccagcactttgggaggccaaggcgggtggattacttgaggtcaggaattcgagaccagcctggccaacatggtgaaaccccatctctactaaaatacaaaagattagctgggcgtggtggtgtgttcctgtaatccaagctacttgggaggctgaggcaggagaatcgcttgaacctgggaagcagaggttgcagtgagctgagattgtgccactgcacttcagcctggatgacagagtgagactctgtctcaaaataaatacgtaaataaacaaatttatgaactgttatgaaataaacaagtaagagtataataataaaaattcatacagttaccattgccaatacaggtgaaggcccattgaatcctgaagatcgtgaacttatcaaggttatatagctatgtgggaacagtgtcttacgtttagattggcatcttgtcttcacagtagtctagtgagatacactgttcctcttgtttaagtcttgaaaacctgtacataagcaagttaatcttgtcacattcgtgttttattctggaatatactgaggagagggctaatttgtgctggtgttgccttggtctgagtttcctcaaatttctacctctgggtttggtgatccagctgtggaaattggaaatgtgacatctgtaaaaccatagtaatggctagcctattatgtgccagacatcatgcctagacaatttgtgtgtgtgtgtgtgtgtgtataattttattattcatttttgagacagcatctcactctgttacccaggctggagtgcagtagcgtgatcttagctcactgcaacctctgcctcctgggctcaagtgatcctcccaccttagcctcccaagtagcttgcattataggtgtgcaccaccatgtctggctgatttttgcatttttagtagagacagggttttgctatattgcccaggctggttttgaactcctggcctcaagtgatcctcccaccttggcctcccaaagtgctgggattacaggtgtgagccaccacacctgacctgtatatatatatatttcaagttttacagtaattctttggctaagtgttttcattttgtagtttaggaaggcatggtctcagagaaatagtgtagcttgtccaaagttccacggccattaagttgtgagctaatgatttcaaggaagatctgtttaataccatagcccacatgttctataccatgctgcctcaatctttgtcagtaatcatgatctgtttcttttgtaggcagaatccagagaccacatttgaagtatatgttgaagtggcctatcccaggacaggtggcactctttcaggtactttgcatgtttgattatgatatggtgtgttacttattgtttgagatagctatgcacgtgagataatatgtgaatatgagtaaattgttatttgtctttaagtatgtttaagtgcctttttccttttattcatgcycacattatcctaggaagaatggagaatgaaaacacagtgaatagtctgaattaagagttcaagcataataggcttgaagtatggctttattcattgtaatcattgggtcttggtttgcatctttcacagatgcctggaagtcaactatttagtgtgaaatattgtcaccttgctaatgagcagggcttcacctctagtctaccaatctaatggtagaattagattataggatacaaaataatataaaggaaattctctgccactaatctagaaggagatgcttggacttaatttagtaaattttatgtctgctggcaaaagaaggttgaaaattagttgaaggaaacacctcctctggctttagcttttgggctaatttgaatatgtgttcctggacaagagggtcctaggaaggaccagggtatcttgtgcaggcagcatatatttcttcttaaaatctttcttggttaatgagaaaaataaccttatgatctagtgttctttttcttggtgcctaagaggtgatacattttgccaaaggtatgtttaggactcttggtccacccacaaaaacacctgcatataataatattatttttttttttttgagatggagttttgctcttgttgcccaggctggagtgcaatggcgtgatcttggctcaccgcaacctctgcctcccgggttcaagtgattctcctgtctcagcctcccgagtagctgggattataggcatgtgccaccacgcccagctaattttgtatttttaatagagacagggcttctccgtgttggtcaggcacggagaaggcatttgttaatatgaacaaaatctgaaaggtacagatgaaatggaagaatgaacaaagtgaatagcatttatactacttcctatttcagccatctaattcctctccccatagacaacacctttgtttaactctacagtttattttttaaacttttattttatgtatttattttcatgagatggaattgctctcttgtcacccaggctggagtgcaatggcacaatctcggctcactgcagcttccgcctcctgggtcaagtagttctcctgcctcagcctcccaagtagctgggattacaggcgcccgccaccactcccagctaacttttatatttttagtaaagacaggtttcaccatgttggccaggctggtcttgagctcctgacctcaggtgatctacccacctcggcctcccaaagtgctgggattacaggtatgagccaccatgcccggcctgtttttttaactttttgttttgcaagtattttattttattattattatttttgagacggcatcttgcactgtcrcccaggctggagtgcaatggcatgatctcggctcactgcaacctccgcctcctggrttcaagcaattcttctgcctcagccttccaagtagctgggattacaggtgcccaccaccacgtcyggctaattttttgtatttttagtagagacggggtttcactatgttggccaggctgtctcgaactcttgacctcgttatccgcctgcctcagcctcccaaagtgttgggattacttacaggcgtgagccaccgcgcctggcccttattttttaattagtataagtttaggggttacaagagcagttgtgttacatgcatatattgcatagtggtgaagtctgggcttttagtgtacccatcacctgaatagtgtacattgtacccattaagtaatttcttatccctcagcccctcccacccttctgagtctccagtgcctattattccacactctatgaccacgtgtacacatcatttagttcccacttataggtgagaacatgctgtatttgactttctatttcacttaaaagaatggcctccagttccatccatggaactgcaaaagacattatttcattcttttttatggctgagtagtattccacattttctttatccaattgcccattggtggacacttatattgattctgtatctttgctattgtaaatagtgcttctataaaaatatgaatgcagttatctttttaatatgatttattttcctttgggtatatactcggtaatgggattgctggatcgaatgaattgttttgagactattttaagagttacaaggacagtccagtgcgtatgctctttccttagatttgtcaattgttattattttgctgcatttgctttatcacccccccaatacatacacagcacatatgtgtgcatgtgagtatacacacacagaattattgctggatcatttaagagtgagttgcagacattatgacccttcacccctgcatatccaggagatattctggatatatctcctaagaataaagacatattcttatatacccctagtataatggttgaaatcagaaaatttaatattgatataatgtcagttgtccatatttaaatttaatcaattgttatatcatgtcctttacagcattttccctatgacccagaatccaatccggaatcatgcagtccatttagttttcatgtcagtttacttcctttcagcctagaataatttttacagcctttctttgtcttttttgacatgtttttgaagaatttgggtctgttgttttgtagaaagttcctggatttgtatctgtctgattggatcttcatgattagatgcaggttattggtttttggtaaaagtatctcaaaagtgttatgtatttttcagtgcatccagtaagcagaccatgatatctgtcctgttatttgtgaaaaagtacataaaacatatgtatagtttaacaaataagtataaattgagtaaccatgttattatgatccaggttaagaaatataatgttatccagttcttcagaaatactggtcctggcaagagggacccctgccttggcctgatgctttagaaggatctgctttgtccctcctctaccartgccctttccacagggcaaggagtctctggggcctacggaacatggtcacttggagactaaacccttccatcctagaccatgctttgagcacccagcatctcagaacttcttgcccaaatggccttgagcttgtttctggagcctgtgtgagtctctcccctggggtctgtcctcctgggagtggactatgctactggtgtatacatccctaggtctaagggtggcctaaggatagctgtcagtggggaatagggtatgggatagagcttgcagtacaggatggagagggggctgtgggcagtgagccaatggccaatttgccctgcaccactgcttttctccatggaatgcaaaatacaaaaacacaatatgaacctggccttctagtcagttgtaaaggtatatttattatggcaggaggatagaaaatatttaatagtttgtatgcttgttttaaaacttttaaatatttaaatattcagatgtatggtctgtaggtctctatttgaacccttgcctaagccctgtaaatgttacaggtgggtttgcccagcaccccagaggcccctccctccctgccttcagaggtaactactatcctgacttttatgataatcatctctttgtttttcttcatagttttgctacataagtatacctcattgaaaaaatataattgaattgtgccgccttctgaattttatagaaatggaattattctgtatgtagctctgctgcttttttgctcaattatgtttgaaagggtcttccrtgttgtgtgtaactgcagtcatagattttcattgctgtgtagtgtactatagaattatttcagaatttagttatccattctactgttgacctttgaagttgttcgcagtttttggctactataagccatgctactgtgacctttcctacgtatgaatcctggcacatgtaaacatmcatttccatatagaacatacttgattactgaatcatgccatacttttacaaaatggattgtgccagtctgtactcccacctgcagtgtttggtagtctacacttactgctctacaacttcatcagcccttggtacagttagatttgacttttgccaacctgatggttatatagtagtatctccttgttgttttttatttgctttttgttgaagactaatgagattgaaccccttcttatatgcttactggcttcttacttatttgtttgtttattagttagagacaaagtcttgctcctttgcccagctgaagtgcagtggcgtgatcatagttcattgcagcctcgaactcctgggctcaagtgttcctcccaccttagcctccttagtagatggtactagcctccttagtagctggtataggcttattggcctcgtgaatatcttttataaagtactcattcaggctacttgctcatttttaaaattgagttttctaccttttcctcattggtttataagaaattgtttatatactatagatattaattatctggttatatgtgttatagatatcttctatggtttgtctttgtatctttgaccaaaacttcttggttttaatatggtataatttatcaatattttcctactctacaaagatattttccaatatttcctttttttcgttttttttttttttttactttttaaattttatgtagagatgggctcttactttgttgcccaggctgatatcaaactcctggatcaagcgatcctcccacttcagactccaaagtgttgggattatggatgtgagccacctctccaggcccaatattttcttttaagggatagatagggccgggtgcagtggcttacgcctgtaatcccagcactttgagaggtcaaggtgggcggatcacaaggtcaagagttcgagaccagcctagtcaacatggtaaaaccccgtctctattaaaaatacaaaaactagccaggcatggtggtgcatgcctgtagtcccagctgctcgggtggctgaggcaggaggatcgcttgaacctgggaggcggagcttgcagtgagctgagattgtgccactgcactccagcctgggtgacagagtgagactccgtctcaaaaaaaaaaaaagagagatagataattttgccttttacatctaagtctttactaaggatattagttttctattggatgattaatattcagaaaagttaacctctaaatttgattcctcatcggtgatttttaaaaattgggaaactaaataaaacttatttactacaatatgctatgtctgtacttaaaacattttataaagtgatcaggtacttcaaaccatacctaaaacattacctaatgataaaaagatgtgaggtgataaagggtaaactttgaggacagttcttttttccattgattgcttttaatgtctacactagtgaagtcatgtattgtaaactgtccctcatgtgttctgtgctctgaagagcatctcatgacatctgtggaagggcatgtgatctgtcagttctacttagaaattgcattaagacccctaacactgaattggaacactttccaaagattgtacaaataaaatttgagtacacaagctgaactccatattttaggaattcataagattttctagttactagttaccagtgaataaactgtcacttaatatttgatttcaggtacctttgtcggtttctacagctttatttgtttttaatacaacttatgtttgcctttttctaatatttaatgcattatttttgccattttagatgattacaaagaatctgctttaagattagtctttgttcctaggatctgcatctctgatctgtgccaaagtatctgaaaaacttagatataaaccttacgctgtacagtactagtgtctgggcataatcttccctttgaagtttgtttgcatccccctagagggattaattccctgctgtgagaaggtgggttagaaagcactgaaactactttatgggtctttaattggaggatttagtatacattttgttctataaacttctgtgggagtttcattcttacaatttttcttatactgtggtatgttatattttcattgtaaattaaagtacatatactcaaatttttcttgttatttagtgcatactgacagattatcctggtgtgtgtgtttttttccatttgtctttaaatttttaatagcttgttttctgattagttcttgagtatgtaaaattttaaacttcttggaaaatgatgaacaagagaaaaattatcactcaataactactgttaatgtttcagtatatttacttccttattgtcttcttttgtgtgtgtgaatgtgtgtgtaaataaaatataaaaactttttttctgaactctcagctrtatgtgttttcctcactctctccaattattcattaagctttccctaaaattattaatgttgatttgcagaaatcattttagttgctatgaattattacatcatgtttatgttctacatttacttataacggaatcttcaggttgtttccaaagttctcttgttataaatgatgtagtgaacatctttgtgtataatgcttgtcagtttatgtatgtaatttaaatgcttaaaaaaagtcatatcattttgaggagatctttgatctactttgttcttaatttttgtatgcttatttttttttgccacacttcattttgtgactccaattggtgtattkgtttaagaacctacctttacatagggatcccagaaaatcaagacagttagctcaaattgcaaaaactctgaagtctgaattcagtctgtgcgaccaaaggtctcggaagagggtgctcttgtaagagagatcagcctgcaaggtcccatgatcagatgrcactggccacacaaaaactctggaatgcatttcaaacacaagtgtctcattacagctggcatcttagcctgcagcgggcactcttcttgggcagatgcttagcactgggagactggcagcatcaggttcttcagaaatgcttggcagaccagcttcctcctgtgtctaccccacatccccctaccccaacccccagcattttcagtgcattagcccaatggccactttttaaaaagaatggggtggttaggttgagaaactgtcggggaactctgaaaggcatgcctaagacatggtgctttggttgctgagtttctcagatacgtgggtgttaagcagcaacataaaaaaaaatctttgcttagaatctcttaactaactatacacatttctatattagcagtatcatgaagaaaactgagtttttgctgacttaaaatattgagagccagatttgttattctgaagtttaactttcattttacaggactgtaaattgtggtctaggagcttcacctgaatatctgtgatcacaatggatactcaaaattattagacatttttaaaaagctgatttaaaaaacatgatgctggctgggtgtagtgtctcacgcctgtaatcctagcactttgggaggctgaggcaggtggattgctggagctcaggagtttaagaccagcctgggcaacatgatgaaaccctgtctttactaaacatacaaaaacatagctgggtatggtggtgcatgcctgtggtcctagctactcagaaggctgaggtgtgagatcacttgagtccaggaggtagatgttgcagtgaaccaagattgtgccactgcactatagcccaggcaacagacctagaccctgtctcaataataataataagattaaaaacaacttgttgtctcctgagaagtggtatggcggggggagctcttttgagagtcaaattttattccagattaaaatgttctagagagatattaattaaattcatcttattttttttcagtaataatgacagtgaatgacagcaagcttgaagaatggcaatagaatagctaactttccttgagtccttattatgccccaggcacttttcttaatattactttcttaaagctcgaacaattctctaaagatggctcttatrtttgaggaaactgagactcaaagaggtttacttgcccaggttggacaaccacaaagtcgtagaaccatgaaaaaatagctggtgaggccagccacggtggttcacacctataatcccagcactttgggaggctraggtgggcggatcacgaggtcaggagatcgagaccatcctggtcaacatggtgaaaccccgtctctactaaaaatacaaaaatcagctgggtgtggtggcatgcacctgtaattcaagctactcaggaggctgaggcaggagaatcgcttgaacctgggaggcagagattgcagtgaaccyagatcacrccactgcactccagcctggcaacaaagcaagactccgtctcaaaaaaaaaaaaaaaaaaattagccgggcatggtggcgggcacttgtaatctcagctacttaggaggctgaggcaggaaaatggcttgaacctgggaggtggaggttgcagtgagccgcgatcacatcactgtattccagccggggcggcagagtgagactccatctcagaaaaaaaaaaaaaaagctgattaatattacctgtatgtgcagtggttagaacagtcagataaggttaatgtgggggcagataaatcaggattgtacagaaaatcaggggatatgtggttttattcatgaactatacaagggattcttatatttgtctgttaagtcagcacgattacttcagctattctatattttttttatcttgcattttccagtgaaagtgaatccatcttatggagtgttagggctgggccctgattctttttttttttttttttttttgagacagggtcttgctctcatcacccaggcactcttacataacagtttcaatggcgtgatcatggttcactgcagctttgaccttccagacttaggtgatcctcccacctcagcctccccagtagctgggactacaggtgcacaccaccacactcagctaatttttgtagagatagggtcttgccatgttgcccaggctggtcacgaactcctgggctcaagagatcctcccacctcagcctcccaaagtgttgggattayaggcatgagccaccgcacctggcctggaccctgattcttgatactatagttgggrcaaattgccactcactcaaaagacatggattgttaaaaacatttttgtaaattttcctggctctgagtacttgacatgctagttagaaaaagtcttgtttgggatagagatgtggaaattcatctaactgtgcttttttcaactgattttaaagtcagggatagctgacttgtttagaaaaagaaagctttactcaagatatcactatgagcttgtaatatgctttgtctctttttctcaagattgctgtaataatgattatttctttaaactggaggtgagcctaatgagagctcattataataaaattcttgcccaccacctaatgaagtaagaaatattattctaattatataggtaagaaaaagagggctccatgagcgcagagattatgtcttgcttgcacttgtatgctttggtagctagaagagtgcctggcatacrttaggccctcaagtatttaatgattaaatcttagagctaggaagcaacttgtccaaagaacagagtgacagagttgggatttgaattctagtgtgactgtattctttaaagaaatttatgaaagctatcacacaaattatataatgcatatgtatgtatacagtttaaagaataaatgaaaatgcacatatccaccactcaacttagaaaacagaacattttgtatctttgagtactccatttatgcctctctcaatttgcctttctctactgagatcacattttgaattttacgttaattgtatatccctgcttgaagcttgtgctttttatatactatggtgatgctctaaattggttatatagaatgagtttgaattgctgttcttaggaagtaacaaagtgagccatatattttcttttcttaatgcttagttatttgaagcagatcccagatttcttctttttcctaaagtgcgcaatttaggggccatctgggtataaattatgatataggggagccttagaatttttgctttattcatgacactgtggttcttcttgctgtgttagtggttcacagtattaggcctcaggccttctatggtggaccgggaattcattgatttactaaactttgaaatccttttgagcagtgagtttgttgaatttttaaaattccctccacatgccaatctcagagcctcattttctcaactctaaaatggggcactaatagtacctrttttagttgaaagattaaatgggagtgcaccatgcatgggacatggaaagttctttataaatgggagctgttattttaacttacttttgtttaaagcaagagtttatatctgtgtggaactctgctactcagcaactgttatcaaattgacataactgaaaaacagaaagtaaargtaactagacaaagtagatttctcagagtctatccattaaaacttaagttctttaatcacagaaaagccctcagcttatgccctgagtgcttcagtatgccgggaagatttctctgtgcaayattgctcagcagttactgatcgtgtcaatgacatcaatcattgcatcagtcaggatccttttcactggaagtgacagaaacccagtgaaatccgacttgaacaacaaagggaatttactggctcttaacactgagaagtccagtggtaaaactggctttaggttttgctgaatctaggttttctactcatattttcagaaattttccctatctcttgattctctgtcttctgtgttgggttcatttctgggcaggtgctccctataaagtggcaaagatggttatgaataaatccaagcttatgttccatcagtttaacacccaaatagaaaaagagtgtcttacagtatcttgagccatagtcccaaggctgactctagtaggccctgtttggatcacgtacccattcatgaaccaataaccatgacttttgagttgttgattggaggataagggagtgtgttgggggagcagggggagaactgggggagctgttcaggaccacctggatcctatagcctgagaatggggcagggtggttcctcagaggaaaatctggtgctattactggaggaagggagaacggatgctgggccgccaaaacagatgtctactgcagccatcaagaaaatgtttgattcaaaatattctttccaaaaaagcagtgagataataatgaagcttggaaacatttataactaaaatgatttaaatcaagttttaatgcttaaaaatascgatcttcaggtttcttgaaaactgccatgtaagactgatttccccaggagtctacatgcccgaggtcttattatcacacttctaaatcattaatcacctattctttgagtgttcactttagactgtgctagactctgtagagagtggaacgttcaccctataaaacaggaactagacctcatgttttaaatgcttagaagactttttttaaaaaaacctttaggaagttacattctagcttttgaacttctkttggtattatttcacaacacattttgcatttccttctttatgttacattgaaaacatgcagtccgctcaaaggctttctttagaaaaagaaagctttactgaagatatcactgtgagcttgctttgcccagcagaagactttaataagttgctcaatttaaagacagttttcttacctttaatatrttcttagacattagaattttctgctatcacgaagccttatttgaggagaagatagatgcagataaattgctgtctagattataacaatgtccttaattatctttgaataatttgtaataaaaacagtataatggccagtctgtagactttgaaatcaaacagacttaggttcagatttcttttgccactcattaattgtttgactttgggaaagctatttaaactaaattctggtttgcccattgtttaagtgggacttctatctacttggcaggttgttttgtaaattagagataatatgtactaaaatgctcagcacaggaagtggtacaaaccagcattcttgtggtgatgtaatttaacgtcacccttaaattaaaaacataaaaaccctaaactccaaaccaaaatcaaacaacacaacttccggaaattgtgctatcattaagaaatgaaatttttgtgatagaatttatgtaaattcctttttgaagggattcaaatattagaatgatagtcattattactatatgaaagatatgacaacttgataaaaagaacactgcctgaactgactaattttctttttcagaaaatgtagaattaattctgagttgttcccagamaaacayactttgggcacatgaataattcaacctatatatttttttcttccacttatgtgtcacagtttaacaagaacccagtgatcaatcctcagctaccagagtttttatttaaactgtctacttgtgagaaagagccagatgctgagaaaataagctaggattagaaatgtattaaaacaacccatttctggaatatggtctaaagtttgtgtgtatttagcccagttttctgtcctcgcagtaatgatcctgatactcagaatgatagaattgacttcttgaacataaagcacattttccattggtttgttaggttgtgcttaccatgaaaggaaaagtgacaaaagtatttgggaaagattttatacacagaccaaaatgaaaaatattttcatcatggcygtccaggaagtagaaaatcagctaagtgctaagtggaacattcatttcctctttctagtattttggttaacggaaatacatccccccaaaatgcccccaaaatatagttagagaaatttggtttagaggatggtttctagagtcaggtcatgtgggtcaaaattctggctcccctacttaggacatatccctgtgtaattttgggcaaattacttaatttccttccttgttttagttccctatgctgtaaaatggggataaatggggatgatgataatatctcatattatcatcacatttgaggattcagaaacacagtwtttaaagaattaagcacagggcatggcacagagtttctctcagtttgaactatcatgaagaaaaacatgaaatttgttttgatccttcaaactggaaattgaggatcatcargagtctgccctggggggacatcccctgatcctgtcctcctcattctgagccttctcattctgcacacatggtggaggggccctgggaccagtcctaaggcagttccaggcccagggccttgggaatgctgctttaggtttctttcttacctctaacagccccagcaagtccagtttaggctttaaaaaagttcttaatccctggggtggaccctggaacaagctgacctaatttctcttgtttttgctgaatggaaattgagttgacttgggttttatttaggcttcgtggggcctgctgcaggatcaaagctcaggtctagacccaattgaagttgagatttagatttagagctgaccactgctacatttttcacttcttgttttgaaagcttttttttaattacacagtttattcagcaatatttattataaatgcgaaaggtgctggggatgggtgaggacattccagcagaaggaagagcatctgcaaagctatggagggatatttaattttctttttattaatcaaaaatatgactcaggttctgattagtatgtagggaccctgtacagtcatgctcagtctaagaatatcagctccaagagggcaaggatcatttacttggttcactgatgtgtccccagcacctagaacagtgactggaatgtagtaggcactcagtgtgtatttgttggaccaataaatgagttgacacaattccaactgattgcagagaacctagatattttgattcatctccacagttttattgttgataaatatctcatttccagtaggttgaatggctactccatttgctgtattgtttttttaatggaaattcatgggtaggtctagggggagggcatttatattagcggcaggagttctgctgcagttttctctcccgcgatttttctggaagatgttattctgccttttctatgagcagacgtgcttaggacgaaaagtttaaaggaaggcgctctcacattcgtctccctgggcgaggaatgccttttcctccccatttaccaagtgtccatcagacttcccacagtacaatgaggcatttaccccgggcctcggcgtcagcctgtactttttacattttaggctttttctgccacccctgggaaactgccctgtggtctggaatcatgggaatttgtgtcactaaaagctgtttccccaccctctcctctagcagaagcagtgtgtgtatacagcaggaagagctttggacttgggttttaattatggctctgcaactaatagtgatctgaccttggggaaattattcatctttttttggttgaattttctcatttgcaaataaaacttggataatgcttatcttttagaattgccatgaggattaaataaaatactaatcataaaataattaacagtgcctggttagttttctttcttctgtcacatcaaatcattgttttccactcttttagcttcttggcacaaaaggacagctatattatttttcatagtgtagaggactatagagtctttgaaactctcgataatgattttctgtgtgttttttttttttgagtgaagcaatatggagttttgttaatatattttcaatgacatggaaacagtcctttaaaaaaaaaatctcatatatttaatttaaaacttttccagactatgaacctaaagtcaggatcttcggatatagttcttgtgcccatactcagcttcctatagaggacatagcatgtttaagctttggggagagagagaaaaatatatgtgtggtgaaagagatattttagcctgcttttgtaactttagctttgctatgcaatgtgccaaaagttatttctccctagggagtgcctctttcaacagtttgcgaaggcagcataaattctcacttggtgttcaaggaagatggtaatacaatttagtacaaccaaagttgttttttttttttttaacttgttagaaaccaaaatgtgattgcagtggcaaatttgtcagcacactcgagtttaacaagtgttcgaaggattagtaaaggaaatgtagtttactctgcagcttttatgacaaagaatttaaaaggttttgctctaagccccaccatgtgtttcttccttttctccaaaacatacctttaagttgaaaagagagatgaatctcttagggagaaactattaactctgagggagtttatcattgtttgagaggaagcagagcatttacatttgaatcaactctgagtgtagcttgtgccctaatctcattccttctagaagttggtgaggagtttaagtacttcctactttgtgttctggtcctcrtagtgccatcctaattttcctggggatcatacatttcgtaattcaaagtaagcaaactggacacggtgccttggttatgcatggaaatattttctgtagttgtcaaagttctctaagtagggccattggccagaattgtctcattgtcatcgcacttattaccatgctaaaaatgctataaaaaagaccaaatactacagaaagtttgaaaaagagataaaatataagcacctccatcacaatcctattttcaagttttgaagattcccatttgatgtatttgcagttgaggtacagtttaaatgagagaaagcaagatcttaatgttgaccacaaacattttcatcagtttttcatggctgcatcagagttttatagtttgatcaactagctcctgattgttatacatataaatcagctcctttaaaataagaccagttaatactactctcttatttgtggacttctgtggccaaatctttggtactgccttttttcgggggtgaggggtggtggaygggaaggaaggtagaggaacagagagaggctgactgtgccaaagataaactatgttacagatggaaatgtttttttctaagtccaaaatctataagaaaccttaaagtgagccattttctgagatcaaaaatgtgtaaacttgtgttagtgttttgctctgtggtgaatgaaagcaccactactttttaaaaagccacatttatggatctttaggttcttttaatacttgcttctatgttttactttttaattttacttgaagaacattcttctgatggaggatttaggtcatgttagctcaaagaaaatagaaaccatctacctaaagacttggtgggagaaattctttgtatttgctctcatatcttgttagacagctgtgttccggactcaggactggattttgcttttgtagcagctgtgagatcctcaccttacaaacataaaatgttcctgctaaaagtttatttatgtgactagggaccatcattgaaacccatcccaaagaaatggaatgtatataatatactttatgggtgtcagatgaagaactcttgttggagctagtgtttaattaaacccaatggcctttaagaattaaaaaaaaawttttttttattaggaattagtacgttagagcttggaagtagcttatgttcattccttagcggttgggacaagaattttgcttttgctgaaagagcctgtgtagtatggtactagcttaaaatgatttgcctggcatttgcactgggcatatttggaaaggaaagcctctttgtgttgtgcatttaaaaaaagtgtctgtaagtgtgcttagaaaatggcagcatttgctggtcttggctgtcaatgtcttgctgctcctaactgtgtttaaccagaaagggaaactcagagtagaaaaagtctcactcccaagactttacaagaaaacccctctttgttgatttatatatatattttttaaaggagcttgacatcttcatcaagttcacagtgggcttgctttgtttgctttctcttgaatgcttgataagatttttcttctattgttttgtgcagcaagaacagatctttccatggctggggtgggttttttgtaaatccacaatatggtcattgtctggtggtgaataattgtggctgctttttgtacaaccagaactaaggctttggctgtgaacagattccttcttagcgtgaaaagggactaatccatgtaaatacagccccaaaataaagctttacagaaaaaggggaaggccgctaagcaggagggcacaggtcagcaatttaacctttaacctaacaaataagaagcatgaaagttccagaattggtttacaaaagaaagctcctgtgatctgtcagtttttcttttcaggagggaactgggtgagagatctgactgacagctagtgccttttaactgcagactgaaattaactgccaaattgaaacttgaatatttgaaggagaatttttcttaaataaattgagatggcagaataggccttataagcactggtcagggtcttacatgggatttttatcctggaagggggttgggggaggaataggcattggactggactaccttaagatcccttccaagtttgataaagagaatgtggtctgactcttactagtcaaattagacatgaactttgcagtttaaggccagatgaaactccccttccgtagtattatcactgattaccctttgtagacttttcatggcttcataaattaattgcagcctttactaaagatttaagagctttttgtaaatgttattgatgttttccacaaaacattaattacgaaaagatagccatcttgagatttcacaatatgcacaacttttatggcccagtgcattatgagaaactctattgtgtggtgccgagcactgtaaagcggaggacataggctttctttcatgtactgctgttttgttccrcatgcttaggcattattagcagatacaactgagtaagctaaagcagcagagatgaagtataggtgtttattaggcaatgcactggggaaatgggaagctgtgaaaaatgagggactgccttgtctgttccatgggcttgaagagttaagaaaataaggtttgtgtagagtggtaagtcttacttttgtgctgttgtactcatttacaaactttgcaaacagtttgtatttatttaatcacaataggtaatcttgttaatgagtgttagtttttgcttaaagcataagagatctgatgtcagctgttctatctcactatggagaattctgtaactgatagaaactttaattactgggaatcattcagattaaaaacaaacaatgaacgaatgactagagtaggctccctgtagaataatagaataatataagaatagtcattatactatgtaacaaaacaaaatgtcaggggtgattctgttttagtttttcagttgtccatggtatatttgtctaggttgtctaaaatttgttctaagggcttattgacctacctcagtttccctaaagtatttagagrccagagacaacrtaacgttgcagattaaaatgagcataaagttaagtggccaccctcacttagctcaggcgtgcaccttctctttcctagctgattaccatggcctcctarctggcctttatgctttccttcacatccatatttaatgctgtcatctcagcaatcttttaaaaacacagctgagaccacaatattccctttgtaacacctttctgtggtcctctgtcaccccaagctaaagtcaagctcattagcagggcaaatgaggtcttccatgctccatcctttcyctatccagcttcatcttagtccactcctctcctctccttttaaataygcatttcccaatatgtctcaaccaaatttcatacattttttaaaatttccatattatatttggcttcccccaaatgtaagaaggtctaatatctttaaaatggggaatctaatgatgatggctttgcaaatggctagcatttgtataggcttcacactttgtaagcattcccatgttcttttatttaatcttcacagcaacgatgcagaatgggcaatgttttctgggagatgcttgatgaatatttggatggatggatgaataaatgaatgagtggtgcatggagtcagaaaactggagttacagtccaaattcttattaaccatgtaattttaaataggtaatttaacctctctgaacctatttgctaatctgtaaaattaggtctatacctgcattgtctgtcacactagatggcaaaataatgaaataatgtgtagtaaatagaaataccattcaaaatgtaaaccccatgcaaatgttagttcctgttattaatattcttaatttattccaggtcctgtaaatgaagagaaagtgttcatggatatagatagatttgtgttttaatgactaaaaggacatcagaactgtttttatttatgtagaaaagtgtaagcctattttgttagcatacagaaaactgtatactattgtttccttttataaagaaaatgtcaggtttatactgttagtaagtgctaacaaaggtgcacatactgtatggtaggtggatgttcagatacagtatctagaggttcctttttgctatgcattcttcctggattggttctcaagaaccttagggctatgtttgccttctagctctgtgaactacacatgactattttagtatgttattatttttgtatggatttttttggtatgcatttttgtatgctattataatccctggcataatctttcctccttttattttccctttgtccttacaccctcggtttacatgtgtatttttaatcttttaactataagtatttttgtaagtcatttcaaattgtttatggaatgtggtggatgataaattctccaagtaagatctcagtcacacttggtttctcctattgcctacagactgatcatttctcagcttgtgtctttggccctgacttccragtgccagacctgggtcctcagctctctgtccgtagctgtttctccatcctacatgggcatctcaaattgaatttaacctcctcccctcgaccaaccttttacccccactgccagtcacctagcaaaacaaaatggaaacgccgatcctaatcctaaactgttccttctatccacggtcttgttgaagggcatttgtacccactcacttactaatgctagaagcctgaaagtcaccctagactctcaccctacatccaattaaatctgagtattttttaaagatttaaaaaaagctttagaaagattttaaacaatatcaaagttacagaaaagttgtaattgcactgcaaataattttttcttctgcacaatttgggaataagttactgatctcaacctcgactacgtcagtcgactaygtcgactactgcaaacaaggtgattctcctgcacaaccacaatgtggtatcaaagtgaggaaattaacattgataccgtactaccatctaattctcagttttggcacttgtcccagtaatgttctttaaagcaaaaggattctgttcagaatcacaaattgcgtttagtttatttaatgtttctttctttcttttcttttttttttttttttttgagayggagtctcgctctgtcgcccaggctggagtgcagtggcaagatctctgctcactgcaagctccgcctcccgggttcacgccattctcctgcctcagcytcctgagtagctgggactacaggcgtccgccaccacgcccagctaattttttgtatttttagtagagatggggtttcactgtgttagccaggatggtctcgatctcctgacctcgtgatccacccgcctcggcctcccraagtgctgggattacaggtgtgagccactgcccctggccagtttaatgtttctttagtctcccttaggaaaggttctcagtctttccttgactttgatgaccttgacatttgaaggttacaagcctcaatttgggtttgtctggtgtttccttatgattaggtttaggttgagcatcttgagtggaaatattatagaagtgatgctgtgcttttcttgttatatcacataatacacaattttgatttggccctttactggtgatgatcttttgatcacttgattaaagtagtctttgccaggcttgtctactgaaaagttcctccttacttactcctttttaattaacaattgttttgggggaaagtactttgaaattatgtaaatattccatttctcattaaactttcagtttatttgtttatttgactttggacttactcctttcttattcaaggttgttactgaattgttcaaattatttgagtgaattgaattattcaatttgttccagctttgatcattaggagccaacttgaagggctcttgtgttcttttgactggtcctcatcattctctgggttctcctttgctttctggtgcaagatgttctgtgctcatcwtttagtttcttttccttagccatgaaatctgccattttcccaaggttccttttggtggagaatgctatttaaaagccaaaattttgattctatgtgtgttcattgctatggtggtgttgctgcttctaggccttcttggtggtcagggtcagagagtacatctatatgtatttctgcatctatctgtgtatattgaaaagtgtgagtccacaccagtacttccgatttcaaccaataccaycgattcattcaagttttctccctttccatatttgtaacttctctcttcaactgtgagaagcctggttcccattatccttaatatatttacttattaatcccttgtacatgactactctgtcatcatggctgccaccaatgcctacccagtgtggatgtcttccttaactcaattggggctctgataccctgtgtcgctctgcctcttctgcctgaatgcccacctcatccaccttggtctttgacaagccctgccaggctggtccttctgtgtgggtgctctcttcactttgaattttgacaccccgtgcatggctgccatgtccttccatgttgttccctgcataatcctcctcaggatctgacaccctatcaggtggcccctgcatggaaagttccttaccctgctcaggtgctctgacacctcacaccagatcatcttttaacatggacacgcttctcaaactgcgttgacactgacaccccctgccatgcagctgttccctgtggatgactgtgtatccctgcttgggctttttctccccacactagttcactctcctctgtgggcacccttgtcacaattgggttctgacaccctatgttagattactctagacagtgtgggcgctcttctcgcactggttgcactytgagtccccatattgtgcaagccctcctatgtggatgccatccttacctactctggactactgtggctacttctcaccaagtatggacgtgtacctcgacttaaggattaaattgtcaattaggaagagaaagtaaagtctaatttcttgatcttttcctatgtttttttctcccttgttatccaattcattgccattgacttagttctggccttccttattctttcttggattactgccacttaattggttttctttatttttgagacrgagttttgctcttgttgcccaggctggagtgcaatggcgcgatctcggctcaatgcaacctccgcctcccgggttcaagcgattttcctgcctcagcctcccgagtagctgggattacaggcatgtgccaccatgcctgactaattttctatttttagcagaggtggggtttctccatgttggtcaggctggtcttgaactcccgacctcaggtgatccgcctgcctcagcctcacaaagtgctgggattacaggtgtgagccgccgcacctggacacttaattggtttccttagctggagtcttatcccttccaaccccttttcttctgtcctgctgtcataatgtgtgttttaaacaaatataatcatgccagtcttctgcttaaaccttataatgcctcttcattacctacagggtaatactcaaatcttagcgtggcacagaaggctcctcatcacttggctgacctctcctcctttgtcgctcactactgcctgtcattgaccttctgcactagctgagccactttagtctattttctttcataccttaggatctggtctttctcttttctgtacaatactctttctccctattttcctggtttatttccattgtcctttataacttagacaaggtgccacctcttttaggaggccttctctaatcctccatttttttctgtctacccttgcttccccctctctgccatccttcacagacttggttagataccctccctcttggcaccctgcatatcgtattataattgtcttttctgtttttcttgagggcaggaaccttcttgcttgaattctcccttgaagaataatcstattcagtaggtagctagctaaatgaagagatatttaaaaatatctcattcagtggaatttgttatgtccaaataagcaaggcaatgttagtatcagttgtttgtgaggcttttgaaatagctccatttacatagaactggacattataattgtgttttttagagtggagttttacctatggttacatttacttctagagtatctccagggacttatcttgtttttcttagcaaggtagaaaagagatttagagtatatgaaggatcggttcattatcttctatttcccttccactgcatttattaccactttgcatgcagtaggttgtggcaatgtctggtactatctcggtagctgataagatgaagatatattcgaccaagagacagaagaggagagagaaacttcatgtgaactggtaaccatttgcttaaattgattaaatcagttgcttcattttttatttcattttacttatttttatttttatttttttttttgagacagagtatcactctgtcacccaggctggagtgcaatggcatgatctcagctcactgcaccctctgcgtcctgggttcaagtgattctcctgcctcagcctcctgagtagctgggactacaggtgcatgccaccatacccggctaatttttgtatttttagtagagctaggttttactatgttggccaggctggtctcaaactcctgacctcaggtgatccacccacctcggcctcccaaagtgctgggattacaggtgtgaaccaccgtgcccagcttcattttttatttttttgttttactttgctttctgggtcattttgaattttatttttaaatctgagacaaaatattaaacatctgggtcctattacatgtagacgttctttacaaatgttgtgattgggatcaaggaacagtctgaagttcccgggcaggagaatcagctgagggctaggatgaatgttgccatttgtgttgagagaccagcaaggttgatttttgccagcagaaatgtagaaagaatgatcttgctcaaaatgagttaatgcagtgggttaaaaatgaatttgtaaatactttcatctgcctcagttattgctgcctaatatttgtttcacccacggtttctcttttcctgcaaattatgtgtacagtgtgattgactttctaaaggtgttgatatatactaatatatcctaatattctaaaggtgatgatacatatattttttttcccatgaaaatatcttagaagtaggtgtattgtaatagttacctaaaggaaatgcttcttaatctgagacattttccggcccattgagaggaacagtagcttttttgagaggctggcatctcaagatagaaagatgtctctaagtattgccctggagtgctactgaatgatttctttactctgtcattgagcccttattgtgtcaaaaaacaaatctcttggagaccctcacagaaagatttgtttcctaaaacctgagtgctagctagagctcataatttttgtgtttttttgagacagagtctcactctgtcacccaggytggagtacagtggtgtgatctcggctcactgcaacctctgtctcccaggttcaagtgattctcatgcctcagcctcccatgtagctgggattacaggcgcctgccaccatgcctggctaatttctgtatttttagtagagatggggttttaccaggttggccaggctggtctcgaactcctgaactcaagtcatccgcctacctcaccctcccaaagtgctgggattacaggtgtgagccaccacgcccggcctagagctcataatttcagtctcctcaatttaaggggtttttacaaaagtgttccaaatgaaatattttctcccccgcttctattcttttgtacaacagttgaggagtcaacctatacttgccttattgataactgatcactggttatttataataaaatttaaaggctgggcgtggtggctcatgcctgtaatcccagcaytttgggaggctgagaccggcggatcatgaggtcagaagttcgagaccagcctggccaacatggtgaaacctcgtgtctactaaaaataataaaattagctggatgtggtggtgttcacctgtaatcccagttacttggggaggctgaggcaggagaatggctttaacccaggcggtggaggttgcagtgagccaagattatgccactgcattctagcctgggtgacagagcaggattccatctcaaaaccaaaaaagaaaaaaagaaaaaaaaaagaaagaaaaacaatttaaaatgaaacatctttggaaggttttttctttctttttaaaaactagttgcactcttatcagccaatgtttttgagctgtgtcaggctattaaaatgcaggtttatagggtggtgttttcaggatgttcctgagaatcagtcctgagtttcagtattccctctgctgctgtggtggataaggtgaacattcttatttttaattgcttagctttcctaaatgtttaactgaggcccgtcgcataagtgcactgggagtgtgctgttatattcattagtgtggctttggatggcctgagtccatgacagactggctttcttcatatacttattcataaattcaaacaagtctttgaaggacttaatgctatggatataaataaaacactttctttttgaggagtttacatctgatgagggaaataaatagtcaaccagtagccatacattatttgggataaatagagacaggcacaaagtgctgtggcagctcagcagaggcagcagggagcaaacagttttatacccagttgctatggaaatctgtgtatcctcagcctccccaaggtccccaaaagtgccatccttacatcagcagctcagacccctcaatctccggaactaaatcaggcttaggtgaggatgagaaacttagatatgacttcttaagtatagcttctcaagtacaggccctctcaatttgtaaactaaagagagaagttaactgttccccgtccctaccaccaccactcttccccagagtgtaatggcgggacaggcagaagataactgccgaagacactgattgtttaaaagggggccagcaggaggcacgttggagcacatagcactcaatagcggtccccaaatacgctgggcaaatgttggaagtttcctgatggagactcagtcctgctctagcctgagagtggctcaccatggctcttagttctaccttctgggcttttggattctgaatcgtccttctttaaataaaagagaacctgtgtttgcaactgagtggtttctcagcctgcttctggtctgtaaagtttagtgagtcaacagcctattgttttttcatttgtattttctttgttcctttcagtccaggctagctgtgtttctccccgtaggagcctcttaaaaactcctttgttgtcctgtgaatctgctggagtttactccttgacataatattcatacccacaaatgtctttgagataagcccgccttttctactttggttttctagtgagaccactgaggaacaacagttgtaagcttcttagaagccctgttgtttaactgaatggttctctatgatggtgccaccttaggtcttttggaggtcttgcaaagaattttaaaatcacccccttagctttttcttatcctaagagtaccctggatttgatctttacccagaggccatttcgtaattttaacatcatttattgtctggagaggctagaaaggagtaaacaaattgagttctatacatagaatagtagtaataaaaaggaacaaggtattgctatattcaacaacatggatggatctcaacataattatcttgagtgaaagaagccagacaaaaagagtacatactttctgattccatttatataaaagcctagaaagtacaaactaatgtatagtgacagaaagcacaccagtggttccctagggatgggtggtggggagtgcagcaggagggatagattacggaggagcacaaagaaacttttggggttgattgattgtggtgatggtttaatggatgtacacatatgtcaaaactcatcaaattatacacttccatgcttgtgttttcttatttttttttcattcttgtgttgaagacgtgtctcttgaaagcaatatatagttggatcttttaaaatccagtcatcttacctgtattttttactggaaatgctttttatgcttcatttttttattcctttcttttggattatttaagcattttaatcattcaattttttcccttttatcatttgggacttaaatactatttctgtgcctttaactgatacactgaaaataatggtggctatgacttagtagtgcttattttataccagtcattgttttatatgctttacctatattaactctyttaatcatcacaaaaaccctatgggatagatactgttactgtctcaattttacagatggggaaaccatggcatggcgagcttatgtaatctgtccaaggccacagagctatcaagtagtagggctgggatttgaacccaggtcgtgtgctttcagtgtccataatgttaactaatacaggcatacctcagagatattgcaggttcagtttagttgcagaccacaataaagtgaatagcgcaataaagtgagtcacaaatttatttggtgtcccaatgcatgtaaagttatgtttatactctactattgtctattaattgtataatagcattatgtttaaaaaggtacatatcatgatttaaaaatattttattgctaaaaattgctaacaatcaacttgtaatctttttgatcgcaaacgatcttgtctaaatgttgatggctaccggctggtcaggatggtggctgctgaaggctgggatggctgtggcaattttttaaagtaagacagcaatgaagtttgctgcattgattgactcttcctttcacgaaagattactctgtaggatgtgatgctctttaatagcattttacccccagtcgaactccttttagaatcggaaacctctcaaacgctgctactggtttatcaaccaggtttgtgtaatattataaatgctttcttgtcatttcaacaatgtttacaatgttttcaccaaaagtagtttccatctcaagaaaggacattctttgctcatttgtaagaagcaacttctcatccattcaaattttatcatgagatcgcagcaattcagtcccattttcaggttctgcttttagttctggttctcttgtagcttctatcacatctgcattacttcctccactgaagtcttaaatacctcaatgtcatccaggagggctggaatcagcttcttccaaactcttgttaatgttggtattttgacctcccacaaatcacaattgttcttaatggcatctagaatggtgaattctttccagaaggttttcaatttattttgcccaaacccatcagaggaataactatatattgcagctatagccttatgtatttcttagacttcaaagtcaaaattactccttgatccaggggctgcagaatggatgttgtgttagcaggcctggcaacagccttcatctccttgtatatctccatcagagctgttggatgaccaggtgcattgtctttttttctgagtagtaggtttcaacagtgggtttagactatttattatgttggtgcaaaagtaattgtggtttgtgtcattactcaatggcaaaaaccagaataatttttgcaccaacctaaatagtaatacatgctataaaatgatgtgctggcatccaggctttgttccatttatagagcacaggcaaagtagatttagcgtaatattatacttaagaaccytaggattttcagaatggtcgatgagcattggtttgaatttaaagtcaccagctgcattagctcctaacaaaagattcatcctgtcctttgaagctggttttgacatctcctctctagctatgaaagtcctagatggcattttcttctaatataaggtggtttcatctacattgaaaatcttttgttagtgtagccacctttatcaatgatcttagcttgaacttctggataacttgttgcagcttctgcaccaggatttgcagcttcaccttgcacttttttatgttatggagatggcattttcccttaaacctcatgaaccaacctctgctagtttcaaactctcctgcagcttcctcacctctctcagccttcatagaattgaagagagtcagggccttgatgtggatcaggcttttgtgtaagggaatgttgtggctggtttgatctgtccagaccactaaaactttcatgtatcagcaatcaggctgtttcactttattatcattcatgtgttactgaagtagtacttttctttttcttcaagaacatttcctttggattcgcagttgggctgtttggtacaagaagacgaactttgagcctatcttgactttcaatatgccttcgtcactgctaagcttaattatgtttagcttttgatttaaagacatgcaactcctcctttcagttgaatactcagaggccattgtagggtgaattatgggcttaatgtcaatattattgtgtctcaaggaataaggaggcccaaggaagagaaagatgggagaatggctggttggtggaacagtcagaacacacacacatttattgacgaagtttgccatcttatatgggcatggtttatggcaccccaaaacaattacaacagcaacatcaaagatcattgatcactgatcatcataacagatataataataatttaaagagtttgaaatattgcaaaaaattcccaaaatgtgacacagagacakgaaatgacttgctctatccagggttgtcatatactttcaatttgtttttttttttttttttttttttttttttaaagcagtatctttgaagtgcaataaaacaaactatgcccatacaaatcaacagtttctgagaaatttttgcatgtttatttaactttaattggcrtctttaccctcctcctggacaatacaagattgtatattgttttgactttaatcattcccctccttgtttatatggtttttattgttgtgtattttactttaaacatgtaagatattattgatttttttatataaccaatgcttgtttagatttatctgtgtattttctattttctttgttctttgttttttatttttttgagatgaagtctcgctctgtcgcccaagctggagtacagtggggctatctcggctcactgcaacctccgcctcctggttcaaacaattctcctgcctcagcttcctgagtagctgggattacaggtgcatgccaccacgcccagctaatttctgtattttcggtagagacaaggttttgccatattggccaggcaggtctcaaactcctgccctcaagtgatctggccgccttggcctcccaaagtgctgggattacaagtgtgagccactgtgcctggccattttctttgttctttatgtcttcttgcatctcagagttttttcatctgggctaatcttcttgcttgaataatattctttgttagtggcaaatatcttagttttgtttatctgaagatgtccttattctaacctcatattggagatgtcatttcgttgtcttctggcttcctatattgctgttgaagtccctttccattataattaatatttttgtgtcttgttttctagtttagcaatgatatatgtctagcagtggagttttcttcttatatatcttggttaggaccagctttttgaatctgaggacttagaacttcttttttttttggagctttgattacacatatgtctgacattctctttttgtcctttacagttttaaaccattttttttgtgtgttttcaatctgtttctctctgatatattcaataacttcttcaagtctttcttccagtttactagttctctcttcagctgtgtctaattgcttttaaaaccatccatttatggccaggcacagtggcacacaccagtaacctagcactttgggaggccaatgtgaaaggattgcttgaggccaggaattcaagatcagtctgggcaaatagtgagaccctgtctctacaaaaatgaaaacaaacaaaaaacccattgatttagtgtttaattttaattatttttaataagtttcttgagatattcacaaaccatacaatttgcccattaataaaagatataattaatggttttggtatattatttaaattgtggagtaatatgtgtatatataaaacaaaatttgccattttaaatatttttaagtgtaaatttagtggtattaattatgtttaacactgttgtgcagccatcaccactatctgttattaaaatcttttcaacacctcaaataaaaactttgtaatcattaacaataatttcccattttcccttccttcctaacctctggtatcctctatcctattttctgtctctatgaatttgcctattctagtttcctcatataagtggaatcatatattatttgtccttttctgtctggtttatttcacttaccctaatgttttcaagctttattcatgttgtagtatgtacagaacttcattcctctttatggctgaatatttatccattagatgtatatactgcatgttgtttatccattcatctgttgatggacaatttggttatctccacttttcagcaattgtgaataatgctgcaatcaacaatgtcattcattgttggtatatgtttgcatttctgctttcaattcctttgggtatatacctaggaatggcattgctggatcatatggtaattctattttttagctttttgagtaactgccaagctgttttccataacagctgcaccattttatatagccaccagcaatgtgtaaggttccagtttctctacattcttgtcagtggatactgttgtctgtctcttttattatagccattctagtggggatgaagtgacatatcattgttattttgatttgcctttctctaatgcctaattatattgagcatcttttagtgtgcttcttgtatattttctgtggagaaatacctatccagtgactgggtcgtttaaaaaattaccaggttataagggtcctttatatattctagatacaaacctgttatcagatatgtgacttgcaagtactttctcccactttgtaggttaacttttctctttcttgattgtgtcacctgaaacagaagttttcatttcagtgaagtcctatttatctaatatttcttttgttgtttgttctttagtatggtacctaagaaaccattgcccatcctaaagttacaatgatttatttctgtgttttcttctaagtttgtttgtttgtttgtttattaggttttagctcttacatttgggtctataatccattccttttttattcctctttttttttttttttttttttttttggagacaggttctcacttggtcacccaggctggaatacagtggcatgaacttagctcactgcaacctcaacttcccaggctcaaacaatcttcccacctccgctttgcaagtagctgggactacaggtgtatgccaccacacccacttaattttttggggggtgggtagggagagatgaggttttgctattttggccaggctggtcttgaactcctggcctcaagtgattcttctgcctcagcttcccaaagtgttgggattaaaggcatgaaccagtatccccagcctacaatccaaatcaagttgatttttatatatgcttataaggaaggagtctaactttattctttcaaacgtagatagtcaattgcccctgcaccttctgttgaaaagtattaattctccattgagttgttttggtttccttgttgattttttttttgttttttggagacacagccttgctctcttgcccaggctggagtgtagtggcacaaccttgactcactgcaacctctgcctcccgggttcaagagattcttgtgtctcagcctcctgagtagctgggactacaggtgcgtgccagcatgcccagctaattttttgtatttttggtagagatggtgtttcgccatgttggccagcctggtcttgaactactggcttcaagtgatctgtccacctcagcctcccaaagtgctgggattacaggcataagccaccgtgcctggccccttgttgaaaattaattgacaattgtaattgacaattgcaaatatttatttctggactctgaatcctgttcatatcctaatgctgtactatactgtcttgattactgtagatttgtagtaaattttaaaattgagaagtatgagtcctccaattttgttctttttaaagattgtttgactattctgggtcccttgcatctccatatgaattttagtattagcttatcaatttctgcaaaaagcccagctgggattttggtagggatttaattgaatctgtagattcatttggggaggattgtcagcttaacaatattgtgttscaatccatgaatataggatatctttccatttattaaggtaatgtttagggtttttttccccataatgttttgtagttttcagagtataagttttgcaattcccttgttaaatttattcctatttttcttaatctttttgatgttattgtaaatggaaattttgaatttcatttttgtattgttctttgttagtgtatagaaatagaattgatttttaaaaatattgatctattatcctgcagatttgatgaactagtttattagttctaataggtttttagtgaatttcttaggattttctttgtgtaagagtatgtaatgtacaaatcaagatagtactacttctttctttctattcttgatgacttttatttctttttcatacctaattaccctggctagaacctccaatacagtgttgaatagaagtggcagaaatgaatattcttttcttcatccgcatcttaaagagaaacatttagtcttttggcataattatgatattaattatatsrtttttttagatgccctttatcagcttgatgaagttctgttttgtttctagtttgtttaattttttttattatgaaaggatattggattttgtcagatgctttttctgtgtcttttgagatgattgtgtgatttttgttcatcattctctagatacggcttattacattaatctatttttggacgttaaaccaaccttgcattcttgtttttaaaaattctatcgtaagtactttattttaactagaagatacaatctccaaggagtttcatggtttaaaaagctacaattacatcatgttgtaattacgtaaaacacagtgctgtaatggaactacttgactttgattatatacatttttgcacagccctatggaatatatgcaaaggaatattttctccctttgctccaattaattgttcttgtatagaaattgctttatattccagtatatccagaatggtaaaataacaagtccatccatgttgctaaaggtcactccaagcatataggagatgggccatacctgccatagtctttctccactcagtggtattggcagtgcttcaagttatgctcctacaaaactagaaattgtaatgatctggagactattctcccaaatggctgtaacaccatttctactgaaaactctaagctatgcttttgagatttggttctaacaaacataaggtacagtggtaaaagtagacaaaatgactgcaaataaaaatgtttccaacaccaactcttttagctccatatagaacaaaaattacatggaaggagaaacaggacaaaagaaggtagatacagcatttcaaaaatcaagttaccttgtgtgataatgaacttttttaggggatgcatttggtttcactactaaatataatactagattgacagcagctacaaaaccagaacatatgcacaaccatgtcaagtgtgtttacaatattgagaagttctccaagaagaatgatggaatgaagacacttaggataattgaaaatatgcataaaatatgggtataaagtagttttttgatgtcagtatctttcatggtattttcttgagtggctatctctctcgcttggggaagggacttggggaactactgcatcctactatcatgtgggaagggctgtcctggccctaatgcaggcacccaaccttgcattcttaggataaatctcacttggtcatggtgtgtattcctttttttgtgttgctggatttggtttgctagtattaatatattgagtatttttgcatttttagttttcttatatttgtttgcttttggtatcagcataatactggccttatagaatgaattggaaagtttttcttcatattttagtttttgaaagagtttatgaagaattggtattcattcttctttaaatgtttggtagaattctccagtaaagtcatctgagttcatctgttttggtgggaagttttcaaattagtaattcaatctcttgctataggtctattcagattttctgtttcttcttaaatcagttttggtagtttgtatttttctagagatttgtccatttcatatatctaattcattggcacacatttgttcatagcattctctctctctcttttttttttctgctaaaccagaaaacctagacaaattntgaaagagctgtaacattaatattttcttgctcctctgtatttctgcaaatatggtcctcatggttttttcttttacttctcacctctcatacattgtacttgcagccactgcaaagtaattgtcattttcagatgctgtttctttgtctgaaatgtcttttctcttgcctcattggargaattggcatttatcttcaagataattttcttcatgctgccttccctgattgtccagacagactcagtctttccttcctttgaattctggtgtacttctacacatctgtcaacatacttgtttctttcaaagggcagctgagcatcctgttcaccttcttttccctaatgagaaacatgggacttaatacaaattgtttcttgggaattgcatgttgaataaatgaatgaggtatgaaacatttcttctgagctctcaacctgtttggatgcctgaaaagtatctgaaattcaaaatgtctgaattctaactcatgatctgctcattaaactgaatgaagctctggtccccttccactgagcagcacatttaaaaaatcaggtatgcaaactaaaaacctactgcyttcatcctggtcacctgccttcctgctcaccctctatattcaatatatcagaaaaatttgattgatttacctaaatatctttaaaaactaggtatttcttctcaactatcattgtcctaaacctctttctcaccttcccccacccaccctgcaccaattccttcaggtctcacttcagacattaaatcatccttaggggggaaccttttcagatccctaaagtaagcttgttcttacactgtatagtcttgtggcagttatcatagcttatagttacattacttgtgcagttgttagtttgcctgagcttctgtactggaccttaaactctgtgagggtagtgatcacccagtattttcttcaccactgtatgaccagatctcaatattaagaagatttagtgaatatttatggaatgaacaaacactgaaaattaggtaatttatgtggaaatgcctttaaaatgaaaattactggagaaacattattttgatgatctcttaacatttaaaataactgtgattagtttattgaatttataattttttgtttgagtgaagagaaattctaaattctcatggtatttaagggtgcatcatcttggatagatccacttattgctgattagtctttgtttactggaattatggaattggtataacaataacaaagtgtacggtagggtctctctggaaagcactatactactttctaaatgacatcaccttggtaattatcacatttggtttaagatttcacttagcacaaaatgggttgcagaaagtcaaactctcgtatatatttaagtaaaggtgatgactttcttcacaatagggcagagatgaaatagcttccacatttgttattctgaatggagccttgggatgaaattccaagcagcagaatgccacttaacattctgcatgctattttgctctttagtagcataattgtaaaatgaggcaataaaaccagaaaagatataatatttatacctgtgtaggcacttcacatgataaaatgtcacacgagactgtttactccatgctggttatttggataacgccccacctgcctagtaacaggcggtgctgagtcttgcataaatcttggaaagaaggttagggttaatatagtgagttcttcagtaggaaaaaaaatacagcatatgtgataataataatggcgactctttgattactatttttgtaccggcactgtgctaggcccttggggacagagtgtgacaaagagggagataatataagtgagtacctttcatgtgtcagctattctgctatacattttacttacaatatttgtaaaacttataataactctgccaggtaggtggtgttatctccatgtatatatgactgattcttgtttatctcataaaaaattctaacgacctcattggagttctgttataattatcatgtttaaactttggtgcttttttttaagtttaaatagtcttttttttttgagacaaaaaaaattaatgagaagagacaaagaaacatcaaagagctttttcctctgattgctgtgttagaacttttgcctgaaaataggttacattccttctgttttcagctgaatcctcattaactttacattttaatgatgtccagggcaaattacaccatttatggtcagtaccttaaagggatgcttaaaggggacttaaaaaaattttttttgagtggtggatgtatttactccaggaatataaattgatccagaattcttgaaaaaaaaaaaaaatagacaaaaacacttgaaacatggggtcgatgttccatttctaactattataacaatttaattcaaaagaaattattttcaccttaaagtaaattaatcattaaagaacatttataatatttgggagtatgcaactggaaccagtgtcctacatttatttttgaaaatagtttcggtttctcatttacttggatttaaattcaattctactgcttagcttcagaaataattcataggtggtagatgctcaataggaataaatgaagacagcttctcccagttatgaaaaaaacaagggtgattgaaatgctaatatgttgatagacagattgtatttgcacaagaatgagggaatctgctgtaaggtggaactcttcacaggattccaaattattcaatttaaaagaacaatatgaactgtggagctgtgctttcattgtaagctttgaatgcttaattattattagatgataaattggaataaagtgtcgtgttgtgtcaaatactgtttatttccttaacaattattggataagtggattaagggaaattggcctgtctgtcgcggaaactgtaattatgagaatgccccatctaacatcatgtattttataaggtttgtactcctgttttttaaatgtgtttaattgaatcccttctgtgtgccaggcagtgggctaatgtccttgttaaggcgtttttgaatacaaggggtggaatttcactaaaactagctcaggaagggcagggatagaggtggagaggtctgttgtacagtgaaggacaggaagcaaaaccagctgggcttcatgaggaccaattggaaccggaaagtcatgcaccagggtggcttcatctctttcatcatggctttgcctctgctggcttccttcgttcaccacttatcttggtaatggttcaaagtggtctatatgatctttcaagcttggcttcccaccgttaacagacactttttgtctgtacccaaggtcgattcgagcgtgtggctcagcccagacctggatggtccccgtggcctccaggtgctctgctgcactgccccttccgcgtgagcagagtgaaacatgtctgcatggaaaaagatatggctcttgcccatgtgtggctttttgtggagatgataatacacctaaaaagattatttctacttaaatgtgctatggacttccctataaataaaatatttccgttatctgctgtatttgcaaactgaggaaacagtgggagggtttgggcactgccactgagtgagggtgaagtgattttctttcagaatgaggttttcctaggtagggcttcctgagggtctaaatccataattggatcctacttgccactgtacaaggaaactgaatgtagaaggaaaaagaaattttctttgttaggttttctttccaggtaccgccttgaatgattgattggccaacatatctaatgcaatttaaggacatttgggaaatctttgggtctgatctattgttactaatgattcttgatatggctattttttttaagttgtccaaatttcagttttctaaggattcagttaaagcactagcagattctgcaattgctcctcaagtatcatcatttttcttataactgagtattgaaatggagcaaagctcgtggctgtaacttaacgtttgttaagcttctatttgctttatatatatgtatatacatattatatatatacacgcacatatacacatacacagacatatacatatatacacagatgaacaagtatgtgtgtattttttcttattcttcctggagcccataagagattaattattgtcctcattttataagtgttacaaaccaacrcacagaaagatgaagtaacttgccttaaggtaatacagctagtaagtagtggattgttgattcgattctaggtctgtactgtgctgcctgtgtctataatagctctgcttaaggttaatggttaggttgtgtttctggaatgctcaacttctctgttggaacaaggttttgcatcagtatgggttggttaaaagcgtaaattctggttctggtacagccagtttataagctgtgtgacgataggatgtacaagttgtttcntatttttaatttataaaatgggattattaatgggtcccatcatagaggtttcataggaggaatgaaagaaatagtacagtctttttgccacaacatgtgcaggagcagtgtcagaatagtgtagaaattgcattggtttatatgttttatgccatcaggttggattagctgaagtcaaagtagactagcactgtttttcttggtctttacatttgggcaggttctccactttctcagtttttttccttttctttaggaaaagaggtgctgaccttgaggtttaggttgagattgccatgatagagtcagggctcccaaattgtgcttttagccttctttatatagtgttgaacaataattttaaaatagtttggtgtctcagttttcagaaaaactacatatgtataacgtttttattcataccttatccctggatagtagtatctggttgaacagtaattttaaaatagtttggtttttcagttttcagaaaaactacatatatataatgtttgtatccataccttacccctggataggtatctgattgtttctgggttatgctaatgcaacaggactattttgaagttgtgttttctcctttaacttgacctggtttgttgaaagatggtcgatcctcttgggggcaggcaagggggtgctaattgtgaagtatctttgttgagtgatgagacactggtgtctgtgaatgtagtggaatggtgggatcgtttgattattctaattgcagacaatctaggaacataggaaagcagcatgcaaaacataagatgcacaggctttatcctcggttgggaggagtttaaatcctgaccctttcttggccagtaaactgacttggacaaggcacttgacctttttggatctcagttttctcatcagtaatatggaattactatccccttcctattttattatcttgagaatttaatggcataagaaatgtaataatatgaggtattcagagtactttcctcgtagtaggtattcaatatatgtttagtaagggaactatagaagataacaaatgtagttgtattgtagcctattttatgcaataaatattccaaaacgttttatattactatttttgtaaattatctgttaaatgaaacagaaagggaatgaacttcttttgaaaaagtctgggaaattttgtaatgtgaataaacaacttttatttgtaagataacattaaaaattatttataaaaatgtatacctgtatacatttttctgtatagaaatttgttatatgcagtaacattttaktatttcctcaaatttgaaatgaatatcatgtgatattaagtcacttaaaaattctctaatatgagatatgaaaaacttagactcaaactataatatattttacttaaccacctttttggctacctttcttttggtattttattatatatcctttttatttttgtaaaaaagtatattagcttttttcttcttaaccgtatttttcccctctataatttgactgaagaaatgaacttgtgttactttttctctcatattaagccaagtctggtgaataaaatacccatagtcaagaaatttgtgtgagcttggctgcactgtgaactccctgatttccttcagtcttgttaattcatatgtgagcccaggggtattattgcccattagcctttcctcatagttattttatgaaagtgcacaattaatgtgagagtgtcgtgaaacctttggagacagtgccctggacatactgaggtarattttgttcaaaatcaacagatagcaccctactgtaatctgctarcagcttgtttatctaattgtcaataaaatttctggttcaggaaagaatttatgttatcctgaaacttaacataccatgtcccyggaaccaaggagaaataataatagtaactgccaaacacctactgtgtgtcagacaccctgctggatactttacacacagatctctcattctcaaattctgagatagcccttcttcctcattttattgagggaggttgagaaaacaacccctaaccatctcacttttgccaggcttcatagctgaagctctccccacttttatatagcatatataccatataccactttttaccatatcctcaggaagcccaaaggacctaacagaagtcagaatgtattttgatggaaagttagtgattcttttctactaatttttttctatcggagtgaacgaagtgtgtggtggaggagtgtgttttgagagtttttgcagtagaaaggtactcaggttttttcttttttttttttttttcctggaaatcaagaggaaaatgcagatatccaagataaagagttaggtaaacgaatagtagtttgtggatagggtctagatgaactagacttctggaaggatcctttgatttttgaaatgtattattatgattggatagttgtgtgtgtggcagtggtgagggctgtgatgagtgtgcttgaccattataaaactaccttcattactagagggacacagattccccccacctctaccatgattgtattgttgaaagcckccttttatcattttgctgccatatgtgtttgtgaaaatcagctgcgttgtaaaaattcttacttcctggaaaccagaaacccattcagctagtgtccctaccctgaccacttcctcttcgttatttctaaatgacagtgctattctggtagcattccaggcgttcatctagctaggattcctttttcacgtttgctatttggtgcattttctcctgttttatttggtttcattgtcctgattagttcaccgagtataatagaagagacatttgcttttttttttttttttcccctctaaagcaagttattttagagggagagtttaccagtgataagagctgtttatgtcctgagcgattgatttgtaattaatgttgcctgggctcttgcctgttggcagaattggtaacagcttgcagtattttttaaattctcttttctttttggtattttgacaatgtcattcatatctcatgaaaaactacctcagacaggttaaatgtgttaaaacatggaacgaaaaggatggaaggagacccagtgctgcctaraaaccttgatcttttgccaaagtatttaaacaatttagtgttttggtttcctagctccaagctgcttctcaaatcccttgctaattaatccagttaatgctttgtagacttactatatgcggtgctttggcttgctcgtctatcattgagaagtccgttttgtttcttggagaaaacctaagctctgttctggtgcagagctatatacagggcttatgacgtgtgagtagtttggggcctttaaaacccgtatgcatgtgtatctatgtaagcatatatatacgtgttctctgcatttcatagtccttaggcttaaaattttaaaataaagacacaaagtagaaaatagaaatcaggtatttcacaccaaaccaatgaactgattgaaagctccctctgctacttgctttgttaattgtgcaaattatttgatgtctctaagcctcaatttccttatctgtaaaatgggggaagataatttattcctcctcatagtattgttgtgaggatgaagtgagtttcttatatacttagcaagtgtccagaacacagtaaagctcagtaaatgatgactgcttttaygattctgttgtgacccttatgtgttgaataaattaacttcttttggtgcttgctgaattgtggaggaggtagattccttttatctattttcttttggcaaaggtatcaaatgtctcaatttgtatcaaggatttaaaaatcaagcatttgttcatttaacagtagtgataataaaaaatagacaactgtattctatttgagcctgttttttttgagacagagtcttgctctttcgccaggctggagtgcagcggcgtgatctcagcttcctgcaacccccgcctcccaggttcaagcaattctcctgcctcagcctcccgagtagctgggactacaagcatgtgccaccatgcccagctaatttttgtatttttagagagggggtttcaccgtgttggccaggatggtctcgatctcttgaccttgtgatctgcccatgttggcctcccaaagtgctgggattacagtcatgagcctctgtgcccggcctgaagctggttttaagacccattgatgtgagttatcaatacaaaagatctttctaaagtctgaaaggtgaatatctctcatttgcttactagaaagcttaggtgcagaaaaatatataggctatttctttttcccagttaaataattacatcaaacatggaggcacattcaggamtatttactgctagtgaagctcatgatgacttttttttactaaccatttctgaaattcatgtattatgcctaaaaaagctcagagtaggtcttgggaattaggaattggcagggttctcacttgatcattataggaaatttcacatttctcccccctaaggaatttgtggagaaaaaaattgtctgccaaaaagtgtaaaattctgattttttttccagctatttgtttttgtttttatgtttagaaaaacttttttataacatgaaaaacaggaacaaacaggaaaatgcagaaatacaagttaacagtttgatggattatcacaaagttaaaacatccaggtcaagacatagaacattagtaagcatcttgccagccatccttatgtgtctttccaaacaccattccctcaattagagaaccattacctttttgtttttttttctttcgtttccttttttttttttttttttttttttttgagatgaggtctcaccatcgttcagaccggagcgcagtggcgcaatcatagcacactgtagcctcaaactcctgggctcagaggaccctcctacttcagcttcctgagtagtcgtgactacaggcatggaccgctcccccggacccccaacctggctaatttcctgctgtgctgcccaggctggtcttgaacacctgggttcaaatggtcttcccacctcaatcttctgagtagctatgattacagtgtgagcaaatgtgcccagctaaaaccattatcttaacttctaatagcattgatcatttttacctgttgttcaacatatatacatggagttatatagatggagtcatgagtgtatttaatattttacttggtttcttttgctcaacaattgtatttgtgagattatccttgtgtgcacctgtagtttgctccttttcattgctatacactattctgtaatatgaatatgccacaatcgatccattctactgtctgtagagatttatgtttcccctttggttttggttatttcaaataatggagctatgacattatagtaaatatatctggtgtttgtatactcccacttttgtttggtatgtacataggagtgaaatttctgggtcatattgtttgtgtatgtttagcataaaatgccaagttttccaatgtggtggaactgatttgcatcctcatctgctgtgtgagctcctcttgctctatatcatcaccaacacttactattaaaggtctttttaattttagccattctgaatgaatgggtagtgtattttgctttggttttaatttgcattttcctgattacccatgaagttgaacatcttttaatgtacctgctggttatttggctatgttgttttgttgttatttttaaggaattctttgtatactctagatacagtttctttggttatgtgttataatttaccttgtactctgtgccttatctttccactcttttaaaagttaatattatttttaattgacatcataattttatatatttatagagtacaaagtgatgttttgatatatgtgtacaatgtggaatgattaaatcaagtgaatcaacatgtccatcacctcacttattattgttattgtttttttttggagatggagtctcactctgttgcccaggctggagtgcagtggcatgatctcagctcactgcaacctccgcctccagggttcaagagattctcctgcctcagcctcccgagtagctgggattacaggcactcaccaccatgcctgtctcatttttgtacttttagtacggacagggtttcaccatgttggccaggctggtcttgaacacctgacctcaagtgatctgcccacctcagcctcccagagtgctgagattattattttgccatatgaatcttcagtaggcatagcactatttattgcaaagatcatcctttctctacttttccacattgccactttcattaatcaaatgtccatgtatgcaggggtctcttcctggtctctttatctattttaccactaccagctgaatgaattattgaagctttataataagttctaatacctagtagactaagtcttcccattttgttattgttaaaagttttttcttggttattattggtctttgtagtttcatataatttttgaattggtttgttaatttcccttaaagtgccttgctaagatttgtattgggatttcattgaattgatataaatgtgaggagatttgattatttacatatttagtcttcacatgaagactatataatgaacatgacagattcctttatgtaatgtaggtccttttgtcatttctttcagttattatagatattcgtgtataagtcttgcttattttcattatatttatttctgggtatttagtgttctctgctattgtaaatggtatctttgaatttcatactctaaatatttgtggatgtgttgaaatacagttaaattttgaaacctgacgtagtatccagcacatttgctaagctgtyttattgattccaataatttatctgtagatattgtatttttttaaacacaatcatgttgcctgcaaataatagttttatttcctcttctaatccttatgccttcctttcttgttcttattacgtgggcttaagaccagcagtataatgtttaatgagattgatgatggcaggatttcctattcttttctggtttttttttttttttttttttttttttcatttttgagatgaaatttcactcttgtcacccaggctggagtgcagtgggatgatctcggctcgctgcaacctctgcctccygggttcaagtgattctcctgtctcagcctcccgagtakctgggattacaggcgtctgccaccacacccaactaattgttttgtatttttagtagagatggggtttcaccatgttggccaggctggtctcaaaccctgacctcaggtggtccgcccccctcggcctcccaaagtgctgggattacacttgtgagccactgtgcccggccctcttttccctgttttgaagggaaaactttccacatttcacctttcagtaccacggtggctrtaggtttttttaattgagttttttgattgatttataactcacatatagtaaaatgaacaaatcttaagcatacagtttgaattttgaaacatgtatacacctgcgtaattaacacctcagtcaagatgtagctcagtttcccatatactcttctctttatttccaattcctttaccccaccagagacaacaactgttctgatttatgttaccatagattagttttgcttttcttaaaccttatagaaatggtattctatagcatttccttacagaaatggaattctcttggttctggcttctttcactcaacataaagattttttgagaatcatccatattgcttcacctatcagcagtttattctttttactggtaagtagtattccattgtataaatattataatttgcttatccatttggatgaacattcaggtgagacacagtttttaaaaatagataacctttatcagattaagacatctcctttgtgttattggaataaattcaagtaggttgtcatgtattattatttaatatattgctgcattccttttgctaaaattttgtttagaattttcacatcaatgtttaaatgagggataaatttcctttcttgcattgtctttagattttagtatcaaggttttactggcctcaaaacgagtgtttcctctttctctattctctggaaaatttggtgtgatattgatatgtgttgttccttaaaaggttggaagaacttactaatgaagccataagagcttgtagttttctccattaaacatgtcttaattatgtgttccctgtatttaatagttattatacctattcaggttttctatttcttcttgtatcagttctttttttgtacctgtttccttgttttttatttcttcttttgccttttattatccatctgtttgattttcttttcctatcttcaatatttgtcactttactttgaatcccttttagctatttcctcaggattttttgaatttatctccttttaccttctgtttctcttaaggcattatctgttgtggtttgttgttgttgttgttgttactgtgttttctctaattggttttcatattggagatgatttttttcttttaagtctgaattttttttgtgagttcatcacctcatttttacatttttgtaattctgatttgtgtattatttcatgtcatgtgtaattttcttaaagtattttaactaatttgaaaggaaggttatggtttttattttgtgttgatgtttgtctatcatgccttcattgtctctagggacattagtctgaatcttactctgctttttctaatcataacttcctataggatcttacattaacactcatttattgctcatttatatgtgaaattagtttttctgaacctttaggaggagaagtaggtagctgttatacttcactgagctatctcttgtaaagttttcctgtgatgcttaaaagcatatgatttgtggcctaatcttgcctggctccgttcccttctcctgccttttcctgaactttttctttatttcagttctgtggtctctatactgttcaattttgattttacttccagaagcttcactttgctgtaggtccttgtcctagaagagatccctatctttgggaactcagagttttagaaactgtatgacagttctgcaaccttcttgtcagaatctcagtttggtttttgatattttcattgggtatagaaatctagcttggcatttattttctttcaggatctttaaaatatcatctcattgtcttctggcttacattgtttctgctggaaagtcatctgtaagtcttatgsgtgttcctttaatggcaatttttttttcttttttttttttggctacttttaagtttttccttttcatttttaatttttagcagttgcactatgattagtgtaggtgttaatgtctttgcatttgtcctgcttgaggtttagagtgtttcttaaatctgggatctgattttttggtatgaattttgggtatttcttaacattacttattatttcttgtaagccaattctctttctatcttttttctgggactcccaatgacatacaagttagrcctagtcacagtagttcatatataacttactctcccttctctttttcagtgttatccatttgggcttaatctggatatttttttctgacctatctgttcacttgtttttttcttcaactaatctattgtccactgagttattaattcatttttttgttctaaaatctaatttatcagttttaattttatgcaaaactctcaatctttttaaactttcttcccctccctgtcttccatcttatctccctctctctctcccttccacgtctttctttctttctcatattgagcaaagttatttcagtctgtgaaataactgtgtctgaggccagtattatttgaatcccttctgggtctgtttctrttgctttgaatctctgttgtcacctttcttttgtccctgtttacttsgtaattttttattgagtgccaattgttgtatattcaaaaccaggtatattttaaggtctagggtaatattatcctcctccagagaggatttatattaattttgttttttaaggctagtcatgctagcaattgtctcatccccttgctccatccttccttccttcccaattaggggtttaggtgatttgaagatgggcttagtctctgaggattcatctatttcctttttacccatctcatgaggtataattatttgaggtccaacccaaagcctaaagcacttactgggacctcttctattctgtgggccctacaaaaaattacagttttgtcttcttcatcctgttggggatttgaaacctctgatcacctttgagccccttagttgcctcttcagtaatcagcccatatccttgggagaaacatgttcttaaatgctagaattttgtgtctgtgtgtacatgtacatgtgtgtgtgacaaggtctcactctggttgcccaggctggagtgcagtggcatgatcatggctcactgcatcaccagcctcgacctcccagggtcaggtgttcctcccacctatatatatatatatatatatatattatatatccattaatgaaattattcaaggtcacaacaaaatctttttcctgaggccactaaataatcttattctagttcttcttttctttcagacttaggactttaggctaacaagtaccctgacattataaggcaggtatacaggaactataagtgaaagagaaaagaggccaaataggatgcatgtgatgtgggtgtatatgtgtaatatagactgcagaaaacctataattaattttttatatgcatgaataactacatatgaatcctcccacataattagttgagttgtgttgagttctttttcaatggaaaaatattttttcaggaatttgtcatacattacaagctttgattttttttaagctctctacatgtagatgtatacttttaaatccacactgtataattaatcatgggtttgttggaattacagaagttattttctagctttaagttaggtttacattattgcttatttctagagtcatactttgtatttcctcgtctgtttctatagtgctttgtaccatcatcagtttaaaagaagagtttaaagaatgctttttgataggcctcccactaagagaatctagttggtgcttaatcctcacacctgataaatgggtgagatgcttgtccacagggctgtgcagaagttgcaggttttgggaacatggcagatgggacagagtggagaataggtttaattagaggggaagccaaggggtatcttgaaccaagtctgagaggcaaggtgaaaaggggagagctaatactgagaacctcagccaagagaatcaagggtatcatggaatgtggtgtgaggaatggtttgatacaagtattctggaagtaaggtggaggaaaggaaatgtgtattgcagcagtggcttgaggggcatgggggagaacatggtggcttataggagtctttctggcccaggacattaggaaatactttttatttattttatttttatttttatagagacagggtctcgctctgtcattgtgctgtagtgcagtggagtgatcacagttcattgcatcctccacctcccaggctcaagcaatcatctgactccagcctcctgagaagttgggactacaggtgcaaaccactgcacctggctaatatttgtattttttgtagagataggggtctcactttgttgcccaggctgtggaaataatttttagagtccatagttcacatcaaggatcttttgtattagttaacttcccctagcttatgctgcctgaagaaattaacaaaaaggaccccagaaatctcaggggactgagaaaaacaaaagttcattacattcctacagtaccttttggttatagctctgctctagggtcagctttgactctcactcaggtatccaagctgaaagagcagccctcatctgggacatccttttctcatggcagcagaaaaagaaaactgatggaaccatgtgatagctcgtaaagctttagctgcaaattggcacaggccacttgcattcacatttctttggccactgctttcacagagaagggcactgtaagtcacatgccaacaggcaaggatgtataattttctccaggaaagaggggtgaaaaatcggatacaaaattacagtcaaccacatcttcctttctggatgaaactttacatgtgataaatatacactcttacagaattagatacaatttaccattttatattggcttttaagatatgcattttctcccaagttaaggtctgaaatcgtgatgcatcttacggtagatggggtcttataatcactgcaagccaggcagctgttgtgatgtcattgcctaggcatgagagaacttggctgctagtcctggtggtaggattggacacctgcaaccattgacatttcaggatcatttgagaaaggaatatgagtcctgactttcatttgaaaattttctgttgacaccccctagtaagatcagcatccattacagaatgggtgtcaccagcttgagaaaaaaaatctcagaggcagtagttgcgcttttcttcttttttcttttctttctttttttttttttaaaagaagagctgtgtcatcagtgttcccaggagcattgggaacacgaatactttcactaattgattgtgcttatgttttactttttatgtatgtatagtagtattatataaaaaatctagagaactgtatcaataagtgtaagttaattttacgtgataagaaaccatggtaccaaactttaattgctctctcttcttttttgttttggtgtttcatgactaatggtgcattttattctcagtggcacttagactctgaaatatggtaacttgcttcttgcccacttaaaaatattcattatttattgggtaaatggagccaagctttctttcttagaaggccttcttataggacatattttaaaatgaactttgaactaattttactcattctagctttaaataaaatttataagagataggtaaaacctatgttcttgaaatgaaattttattctattgtttggtaccacataatgaagttaatctttttctccaaaacagtaaacttttagtaaggagataggttttattttattttctaatcatttaatcttacactagaatcgatagctaaagcttttttccccaataaattaacagtttacagtagtaccttagatatagattgggaggtatgctggtgttattaaaaaatcagatgaactctataaacacccatttggaaaaatagctattttgacatctttmttttctttactttttggctttctcagttttgaagctacccaatgtattttgagtttaaattacatatattggtgaaaaaaaaaagttaacagtatgtagtccattggtgattttccaaatccaaaaattgatttaccagcaggtactatacaaaatttcttcacatcgcattcagcaaacaactactgagatattatgttagaatttacaaagatgaatagaacaccactgtcccgccttcagagaactttcaatctattgttggcaagtgattgcgagttaaaggtcttgttaccccactctggatttgagtggtactgkggtttagagtgtaagagcttaagttttggggtgtttctagatctgagattaagtcctggttctgctcctttgtcagattctccctactttacctctctgagcctgtttcttctgtagggttactgtgaatacctagcacattgtagatgttcagtaaatgttagctggtgataatgagaattatcaccttgataattctcatcttcatttcagtgttatgaaagaactttgattttcatgtcaaatagacctggccagatttcagttctgatgtttattaggtgtgcgataccacagtgcctactgaatggctcttcttgactttcttctcatagacatctcaaattgaacttaggatcattctcctaattttgcttattcaacagggttcccctcttagagtttcttgtgccagaaacctgggaattgttctcttttccctccgtctctcttggtgtttcttctgtcttacatactcactcacctttcccattcagttctatcatcttatctcaagccggctgacttccttctgctcccacgctatcacctgcatcaagtcctgcaccacttcccactcaggctactgtggttacccagctaatcttatatttcattttgcctaattccagtccattctccacagaacagctagagttatgtttggaagacacatgggatcttttcgctaccttttactcctttttgcttaaagcttctcaggggcttccttttatacccgaatgaagtcctcagtccttagtgtgccccatgagaccctgtgtgacttggcacaagcttccttctctggccttatttcttacctctggctcccttgtgctcagtgatcaacatattgggcttctgttctttcttcttttgacccgcattccttcctgcctcaagtctgcctatagtcagtgctgttccatctgcccagaccactttccttttccctacttttgcctatccaattcctttgcatccatcaaggctactcgtgggataattcctggggaagccttttaattcttctcaaagttgaatctctttgttaagtatttttataaagcatgctgtgctttttcttttttgcgtttacctcccatttaatgttttccttccatacactctagttttttgacggtatagactgtgttttattcactgctcagttgttcccgagtttagcacagtacctgagacatagtaagtacacaataagtatctgttgaaaggatgagtaaataaatgagcattacttgcctcatagagttgatgtgagacttaaattgggacacaaaaggtgtcttactgtatattagatagcacacagtgggtttgtaatattctcttcttttcttttctccctgccccctgtatcgtaagcgttaagaaaggcccacaagtagttgccaaacaatagattgtgacctgctggtgggtaataaaaccagtttartgggtcttgaagtgaatttttaaaaatgaaatggaataaaatagcaattatcagagaaaataacatatagtaaggacaggtatagttttctgaaactttctgtgtgtgaatgtgtttatgtagtaggtgtcatatgtatcttaatgtgggcaatggttaaaaattttgaaagccaccattgtaacaaatagctcagtgtcatgtagcctttaggcaatcctgtgtttgagttagtgcagctaaatgaggatatatcccatttttaaagaaatgtaattctgcctttgctgacttagtacaaggttcagggtcctagaatcctccttagtcgtaaatgcatctacaaaagctcctgtgattactaatttccccccttctatagaggctgtatccatttctaacctgtgtattttcaaagtaatttttacttctatatgttgtataccatggccttttccactatgttgaaaagatatcttcaatattgttaatatttagtgttgggacacctgtctcatataaagtttatagtgatggtagtaacattatattgtgtttatcataaagaaattctctgatagctcaaattattgctcttattaaattttattgctttagtgactttataggctttagtattatcagtttgatagaaagccagtgctatacagatatataaaaactcagattatayatggggacatagaaagccagacccagacaaaaggaagccaaagcgtctaaggattaagacaataatagttatgattgtggtagcttggtaagtgatttcatttttcagttaattctttacatcaggttggtaaacatttgtgttactgaactatgattttcttctttaaggccagtggtcagttgaaaacctttgatgctgttgattttctcagcattaatcattgttttatactccagtctccaaggatgcataaattataatagcaacaaggggagggctggagccgggtggttgctgctgcattattgtgtccacagggatggtatttgtgtgcttgtcctctgcatattgttggactgaggaactagatcctgtcctccgcaaagctggagacaacaatgaattataaacagcatcagaaagcagtgctgttaagtggtctgtttgaaactgttagagttgatggagtaacattattctgggactcttatgaaatctcatgaaagcttaggttgtctcctttcttatagttaatctgttttgtagacattaatggcaaatgttcaaataatacagattgttacctctaatccaccataaggaaagattgtggtcaagtcacataattcagttttcacattttcttacaactggtttctgttagccatgacagactagtaagctagatgctgtcgtattcttagaacagaagctacacaatggtttcttgtttattcttcacataattttttttcattttgaaaatgacatttattttggaaaatttagaaaataaaaaatgtaagagatatatatataattttccaacactcagatatttcctgttactttattatatttcagtctattgtctatttatatgtaagagaatactgcatatttttttctgatgaatttgagatgaaatgaatatttttagggaaaatacacattagtcaagttaactcaaaaagagattttaaaaaacttacctggaacaatattcatggaagaatttgataaagttgtcaaaacagtattcctaaaaagttgccagttccagatggtttagcttgtcagtattcacatctttgcagataatgcctgtgctattcaaactgttctaaaatattttttcaatggtatgcttcttcattttactaagttgtaacccaaatatgaaaatgttaaggcaaaaggtaagacagaaaagaaagtgcaggctagtcttaattatgacaagggaactgacatggataagcagtgattgcgctattgctccaatgattttttgaagctccacaagaaaatcaattttgtgatatgaacaattgctattacattatttgctatggataaaaatgacataaattaaaactttaatcctacaaaagatgatcacatataagatatgggaaataacaataaaaaaatttaatttttagttgtcagtaccaaaaagaaaaaaagtaccccaaaactcagtgacttaacacaacaatgatttattatctctcatgcttctgtggattggctgggctaccttgggtggttctgctccatgagatgtaagctggggtcagtcattcagcagggagctcgccatgtccaagatgaattcagctcacacgtctcatacttcacctgggtgcctggaacagtaggactctggtctgggcctttcattgtccatgtggcctctctgcattcagaagtccagcctgagacacacagcagccagaccctaaaaggatgaaagcagaagttgccaagtctctaaaggcctatacccaataatgactcggcataattcctgctgtattccrtggttcaaagcaagtcacgaagtcagcccccttgaaggatcctggaaacagactccatggcttgatgggagaattggcatgtgccatagggatgggactaaagttggtgacatttttgaaggcaacctatcatactggcttacatagaacattactaagcctaaagccctctatgtgcctctttctgccctctttttgtccctcacttttacccccagatcatcactgtcccctctcaatatgtttttccctcccaatattgtttcatcattttcttgctttccattatttcttttttaccatatatgtaggtatctccaaatagtgtcatttagttttacatgattgatatgcatttatttcttaaaattttaagtttcaatttagaataattatttatttgaagattatttataaaattcagaaaagtaaaagagaaaaattaaaatatcttctaatcccagctgggcatggtggctcacacctgtaagcctagcactctaggatccgaggctggctgatcacctgaggccaggagtttgagaccagcgtggacaacatggtgaaaccstgtctctactaaaaatacaaaacttagccagtcatggtggcatgcacctgtagtcctagctacttgcgaggccgaggcaggagaattgcttgaacccaggaggcagaggttgcagtgagccaagatcgtgccactgaactctagccactgaacccccacctgggcaacagagtgagaccctgtctcaaaaataaaaaaataaaatattttttaatcccagtctttaagatataatcattggtaatattctgggatatgttaatacctgtgtacccaccccagattcatatcatgtatctgttgttctctgaatctctttcagtggcaagggctatcacattatctggatctatagtattcagtttctgaattttggattatacatagcaagaattccgatttgtgagggattcagccaaacatttgactctgttaggatggtgagagtttggatagtgaaggatacttttgtgtgtgtgcatgtgtttgtatggtgtgtaatgttaagaaaaggaggtagagtattatatagtaacattccttttaaaaatttagaagggaaaacagtctcagtggattgttgttaaatactctgcagtgttccaaaactttactgtgcatgataatcacctgaagagcttgttgaagcccagcttcctggaccccatgcccagagatggattaagtaggtcttgtgtgggcctaagaatttgtatttttaacaagtttgtaggtgatgctgacttgctggcctacggatgacactttgagagcttctgttctatgatatgacttttaatggatatattgtggtttatcacataaatgcatcataattcgtttaatcagtcccttataagacacttagtagtctaaatagttttgttattacaggttgaacatccctaatctaaaartttgaaatccaaaatgctccaaaatgctgcagaatctgaagccttgtggtgctgacatgatgccacaaatggacgattccacacatgagtacttaacacaaactttgtttcatgtgcaaaattattaaaaatatatgaaattaccttcaggctatgtgtgtaaggtatgtacgaaatgtaaatgaattttgtgtttagacttgggtgccattccaagatctcattttatatatatatatatgtgtgtgtgtgtgtgtgtgtgtgtgtgtgtgtgtgtgtgtgtatgtatgtatatatatgccaatattccaaaatccaaaaaaatctgaaatctgaatcacttctgatctcaagtgtttcggataagggatactcaacctgtattaacaatactataggccaggtgcggtggctcacgcctgtaatcccagcactttgagaggcctaggcgggcggatcataaggtcaggagatcaagaccatccctgctaaaacggtgaaaccccgtctgtactaaaaatacaaaaaattagccgggtgtggtggcaggcgcctgtagtcccagctactcgggaggctgaggcaggagaatggtgtgaacctgggaggcggagcttgcagtgagccgagatcgcgccactgcatgcactccagcctgggcgacagcgagactctgtctcaaaacaaaacaaaacgaaaaacaatactataatgaccaataaattatacacatttatttgcattttcttatagtatatttcttttcttttttttttaacggagtctcactctgttggtcaggctggagtgcagtggtgtgatgtcggctcaccgcaacttccgcctcccaggtttaagcgattctcctgcctcagcctcccaagtagctgggattacaggcgcctgccaccaagcctggctaatttttgtatttttagtatagaggaggtttcaccttgttggccaggctggtctcgaattcctgacctcaggtgatccacccacctcggcctcccaaagtactgggattacaggcatgagccaccacgcccagccagcattttctatagtatatttctaaaagttgagttacctggtcaaagggttagtacacatttttaagatgtttataatgtaatacctaatcatattccagagagctrtatcctttatattccaactaggaaaacatgagaaatttaagttaacgttctgaggtctctgagggaagttttcaaaaggggactcccaaaataatttaacatgtgcattggctcattaaggttattatcttgtgagggcaatactcatttgcatgtaaaaattctaatatattaaaatgttggttgccttatcttacagttataccttgcacgtggatgattaacatttttaagtgttcagataaaagtgtctattgtttccttaaaccccccggcgtgtggaccaacacatttatcttttttaacctcctacagtgaaatcccactgaaattttacattgcctattgtaatttggtataaagatgagtcatctttcatagggctcaaagcagttctagggaaggtaataatctctgatcttgagggacaaagactgggtacaaatctttgtcccttttcacttatattttgaccatggagatcatctaggctttaaacctcaatgttaccattgggtaacattaccatcggggttaccattgaggttattatagagaggttgggtattactggaacagagtgttatttcctttttggagcccatggaattctgccaggaagtaacctgcttcctctggccttgaggagggactgcagataagagactagttagctgtctacaggtccttaccttctagtggctgtatttttgcccctgagaaggtataggaatggagttcgccctgggactgacaggtactactgtctgcatttacagtgcctctctattttcctcttttatgtatctactatgttcctttaaccctttcaatgtagtttttggaggactttatgaattctaaagaatgtgaaagagcttggaaagttgtacagagttttgtgaattcaaaataacattgcatttggtcctattcaaggcactattgaaatgacttactcattggccctcaagggtagtgtgagaggaccaggtaattatttttccaaattgatttctaatatttgttagtgatctcacagatttgtgttctttcaaacattcccaatttaagaaaggatcatattatattataataagtttgtaaaacactatttggaagttgatttataaacctcccttaaaacttcatccgcagcatttaacctttctggctagaccaggaagcctatatcacccattttattgtggggagagcttggtgcagatgaaagtttgaaatttggaatcatacaaacctgagattaaatcctcactctgacactgaatagatgtgtgaccttggggaaattagtgaacttgtaagatttggtttcagctgggcgtggtggctcatacctataaccccaggactttgggatgccaaggctggcagatcacttgaacccaggagttcgagaccagcctgacaaacatggtgaaaccccatctctacaaaaaaatacaaaaattagttgggtgtggtggcgcaagcctttggccccagctactcaggaggctaaagtgggaggaccgcttgagcccaggaggtcgaggttacagtgagccaggattgtgccaccgcactccagcctgggtgacacagtgagacactgtctcaaaaaaaaaaaaaaaaaaaaaaaaagtmcagtcactttgagggcccagtgccaaataggttcttgataattgttgtttctttttctgcttactctctttgaacatgtagctgtaagttttctgttctttttgagttattatagcagttgggttatgttttgcacagacttctagattgtcctgaaatacaaaattacggacacgttttagcctcctcacattgtagaatgttatacaataaaggagaatacggtcagtttggaaaattacatagatcataatgtgtatcttcgggaattttcttagaaaacgtgattttaatacgctaaaactatttagttttaagtaataaagtaaatattaaattaatatttttaccccttcctttctcagctattagaacttaacttattgagaatatcattttaaacagtatttctttgcaaatgttatactgcaagtgctatataattatctttcaggctgcaaattttttgaagggggcttattagaagttatttctggtctgtagcacagtggctgtttgcagtgactgaccttctgatcatttttgagtagaatttgtttagtgtgttaaagttgtttctagtcatgtgaatttactgagacagttatatggtcagatgtgtattttgcagggggatgtcagactttacacatttgctgattagttaggaatatttcgtctgctggtcagtggttcctgctgatttaaaaacaaaaggtgcatctgtagacagtgcttagattgtataaattcagttgcattagcatctgacactgcaggagagcaaattatatcttgagcaaataactgtaaagaatacagctgtttgtgatatctttattatgaaggtactgttttatttccacccacagtttgagtaagatttaatttcccgcctaaccacatcgctttcttttctagtgagattttgtctttgtaggctgaattgtttttagttttatattttaatgaagaagattgtcagcattaggrattcctttaatttcatttgctttcagcaaacattggaattattgttaaactctcaaaactatcattcaatgaataatayctaattatcagttgtaaaaacattttattaatattgatgctattccaatgattgcatctttagctttccttgtttaagtattttttaggtagcgtcacttggacacaggaaactagagtgcatttttccattaataaagaagtggttgttctctgatttgattgtttggattgtgtgaattggagagtaatgtttttttagcatgacactttgagaactgctacttggttaggatacttttgttccaaggtctctttgagtcagttcctattaaaagtgaaatgtgacaacctatataacaatgagaatatttgaacaatacaatacttgtattattattgtatggctttgaggaaaacctcatactgtgtctaattgaatttattatgcttaatgaattttttgaaccaaagagtaccttttttgtttacttgaccattgagtttgtttttaagtatatataaaatatgctataaaacatgtacaatgctgaaaatttgcagcctgaaagataattatacagcagctgcagtataacatttgcaaagaaatgctgttaaaaatgatattctcaataagttaggttccaatagatggctggatgaagaaggggtaaaaatattaaattaacatttgcttttattaagagttcctgtgaatttttataatagaattgatcacaatgaatttatttggtaaattattaatgtccgtgttacataccctcttaagaataccttacagtgtcatattcagaaacatattattaacttaaaatggtgttctttttcaagagaacaaagaattcaaatttagctggttgatactagttacattatgtaaattatggtaaatgtaacattatgtaaaaatctgtaagtagttatacaggatttatatcagtaaaataattttggttagcttatgcaagaatatcacaatcaaatttagtgatgattgcagtagtatcagttaggcatttctcttcttaatgctgtaactattgagataagcgtcttcctaagtggcccttttctaaatctaagttttggaaaggagtggaaaactgatgtgagattgtgaattttgagggctaggtaaaaagtttgtttgtgagtctgcacgaaactctcttaaaacttggtatcttatgagtattaaaaaagctggtagaaatgtctgttttacttttgcctaattttttttacttattagacaatccagtatctgtttggattctttgtgcttttctttggataattgtgaacgcagatcttttttttcgggtctaagtaaagccgactcagtatattctggtatgttctgtcctaccaaatgtcattagttatgacttgtcatatttaagtattaaatagtacaccttttccctaatttttttttttagatgagaagggctttgccagctgcccttaggaattagaaataaaaaggttatcaccaggcaattcctctatttgagagagaatttactggtcctttggaaaaaaaaaaagtcctactcacagccttgataaaaataaattacaagtagattaaagatgtacattaaaaagcagaagttcatagaaaatgtgaaaatatttttagaagtcttacgaaaggatttcttgactaagatgtaaaaaagcacaaacaaagccagatacagtggctcacacctgtaatcccacatattgggaggctgagacaggaagattgcttgagttcaggagttcgagaccagcctggacaacatagtgagatccctgtctctacagaaaaccaaaaaattagctgagaccacaggtgcmtgtggtggtgtgcgcctgtggtcccagctactggagaggctgaggtgggaggatcccttgagtctggaggtcaaggctgcagtgagccatgatcatgccactgccctccagcctggaagatagagtgagaccctttccaaaaaccacaaagaaacatcacaaaccatgttgaaaaagacttgactcttgatttgagtacactaaaatctgaaactttggtatggcaaaaaagaactattaacaaaataaaaagacaattattagattgaaaatttttacaaggcttaggatccagaatacataaggtactcgaaagaaagaaattttttagataggcaaaaaatattagatgaaataataaaataataaatccaagtagttaagagtcatttaaaaagattatgattctatcactaaaatgaaggaaatataaattaaaatcctaagagagtattttatacatgagagtggcagaaaatgtcaaaaatcaaccagtaccagtattaataagaatgtggaagggcaaaaactcttatgtgctttgataatatctagtgaagtggaaggtgctcacgttctagcaaccactcattccactcactgtatattgcagtgaaattctcatttgtgtacaaagtgtcatatcaagaatgttcatagcatctttttttttttgtaactgaaaaatccttaaaacctaaatgatcatcaacagggaaaaaatggataaattgtgacttattaatatagaataaagaattatatagctgaatagaagaattttatagcaattaaaaggaatggatccaatctgcttgaagcaacatgagtaattctcaaaaacataattttgaattagaaaaacaggctaaaagtactatctgcaaaatatcagatatataaatgttaaaaatacaaaacaactctattttatcatgggtgcatttatatatattaaacgtacaacagtatggatggaaagactgcatgccaaccttaaaaaatggttacttctggaaagggaaggaggaggataatgggataaggggtggaaggtggtgctttagctataccatatagtgtagatgtgtagtagactgtatcattctaagcttgttaagtacactctatgatattcacataatgacaacattgcctaatgatgcatttctcagggtgcattctcattgttaagtgacacatcactgtatttcagaggtccaattacaaattattaaaaagggcaactttccatgtcatttatagttctaaatcactttattttaaaaatatattgatggatgtttggcaaagaggcaaacccacaaaccttttttatttttatttttgagttggagtcttgctctgtcgccctggctggaatgcagtggtgcgatctccgctcactgcaagctccgccttccaggttcacgccgttctcctgcctcagcctcccaagtagctaggactacaggcgcccaccaccacgcctggctaattttttgtatgtttagtagagacggggtttcaccatgttagccacaatggtcttgatctcctgaccttgtgatctgcccgcctcagcctcccaaagtgctgsgattacaggcatgagccaccatgcccagccgtggatgctttcttgtaagtgaaattggtggattataaggcatggaaatttaaaattcattctatttgtgctgcagaaaattgtaccaaattactttccatccagccatactcttagttatcaattataggagactgcttatttccccagatccttcagtctccagatgtttcccacacttctaacctttgccagtcttatggggaaaaatgacatgagttataagattataaaacttgagcacctatttgcatcccttttttggcatctttcaagatggtaaagtggtggatctggcattccatcattttgagaaatgtgttcaactttggaggctgtgagtagaagagagcagattgaatgcataacagggtctagtccaggcttcaagcaagatggatgaaaaggttcagggatttggccgggcgtggtggctcacacctgtaatcccggcactttgggaggccgaggtgggtgcatcacctgaggtcaggggatcaagaccagcctggccaacatggtgaaaccctgtctctactaaatgtacaaaaattagccgggcgtggtggtaggtgcctgtaattctagctactcaggaggctgaggcaggagaatcacttgaacccgggaggcagaggttgcagtgagccaagattgcaccactgcactccagcctgggtgacaagagcgagacttcatctcaaaaaaaaaaaaaaaaagggatttaagttcaaattgaaatgttggcttcctaggtaattctagatcaagtttgtccaacccatggcctggggctgtatgtggcccaggatggctttcaatgtggcttaacacaaatttgtaaactttcttaaaatattaatagttttttttttcctttagtttatcagctttcgttagtatgtttgttttttttttttttttttttgtagagacatggttttcaccatgttgctcaggctggtctcgatctcttgagctcaagtgatcctccctcctcggcctcccaaaatgctgggattacaggtgtgagccaccattcctggccttttctttctctttttaaaaactttgtttgtgtacctgccttccccaatactgcacatttcctgtgtgctctgcttctcaagccctggcatctcacctgtcagtcagcatggatgcagagttcaggcgcaagagacagcctgaggagttccacccagaaaagagttgccttgcgacatgaaagagagacatgatggccaacaccatgaggccaaaacatgagatgatggaggaaatgcaaattgaggaggagagatcttttaagatagaattaccccaggccagtaatctttgttattccatataggttttactggtcctcaaaaaggaggtctttacagaaatgcagattttacattaatagcaagagggaggaaacccctccagataatgaagcgaaaatcatgaagcaaagtcaggcagacaggacaaaaggagcctttaaaattctcattgttgaccagaccggtggctcctgcctaaatcccagcactttgggaggctgaggtaggcggatcacttgatcaagttcaggagttcgagaccagcctggccgacgtggtgaaaccctgtctctagtaaaaatacagaaattagctgggcagggtggtgcatgcctgtaatcccagctactctggaggctgaggcgcgagaattgctggaactcagggggtggaggttgcagtgatccgagatcatgccactgcactacagcctgggtgacagagcaagaaggcataaatagaatgacatttaagtagccactgctgcttaaatttagaatttttctccattgaaaaatctttaataattgttttctttcttttgtgagaggcttgttaattctacagagtggttagccacacagaaaaccagaaagaagtacttttcctcagggccattttcctttataggatacttataggcattgatgttttaccaaagcaatgagttgtctcaggcttttagatcatagaatgatagaattttagagtcaaaaaaactcagtaaacatttttagtttatatgtgagagaattcaggtttagagatgtatttaagatcagatagtggcagaatctaggtctgctgatttccagtccaacattttaagattcatgccaaatcttttaaatattataatggctattgtgattttctgaaagcttactaaaaatgattgtgtgctatgagtctaatattgttctaggcatagcagataggaagataaataagtactcggaggaacatgcagggggcagtgcatcagtcatggtccagctgaagataatagaaaccatcgtgccgttccttctaggtttgtatcagaaaaatgggttcctcctgttgcctcctgtctccccacatccctgagctttcaggtctcactaggtggatctgactggcagaacctaaatcatacccaggatcttagttgcaggggctttttggaaaatagtttgtagctttccagcttctgtgatactggagggcccacagaatgttgtgagagagatagagtgagccagtctgcagaatgcttagggttaacacataggacgggcactgaacctgccagtgtggggttgttggcttgagagctttcactgggaagtattatagaacctgagctgagactagaaggatggagttgaagatgtctcaccttttctaaggaactttgatgagtggattcctgttgctagtttttttatcaagtctgtataacagtaattctcaaagtgtagtcccccagaccaggggcgtcaacatcacctgggaacttagaaatgaaaattaggcagggggattgcttgatctcaggtgtttgagaccagcctgggcaacatggcaaaaccctgcctctacaaaaaaatacaaatattagtcaggcatagtggcgtttgcctgtaggtccagctacttgggaggctgaggcgggaggatcatttgagcccaggagtttgaggctgcagtgaactgtgatcctgccactgcattgcagcttgggtgacagagtgagactgtcttaaaaaaaaaaaaaaaagcaaattattggatactattttagacttactgaaacagaaactgatcaagcccatcaggtgactttgatgcatgctaaaggctgataacctctgccatgtaagcataatgattaagatgataggttttttggtgttttttttggtttgttttttgttggagacggagttttgctcttgtcacctaggctggggtacaatggcatgatctcagctcactgcaacctctgacccccgagttcaagcaattctcctgcctcagcctcctgagtagttgggattacaggtgcccaccaccacacccggctaatttttgtatttttagtagagacgtggtttcaccatgttgggcaggctggtctcgaactcctgacctcaagggatcctcctgccttggcctcccaaagtgctgggcttgcaggtgtgagctactgtgcccggccaagaatataggttttaaagttaaatctgagtttgaatcttagcttttgcatttaccattggtgtgattatgagccaggaatttcatctctcctgatcttctggggatagcaacacttaccttgtagagttacagagttgtgaagcttaagtggcatgacatggactatgcttatcacagtgtgtgacacagaataggcattccatgaagtctgttgaaggagagttggctggagtgcccctgaattaatctatcccaggaaatttaataagggcaattcagatagaattcarttcagcaaacatgtatggaaggcagcctactctgtgctgtgcactgtgcttgaagtctgtggtgcctttatctgtggcaagagcacagatggtaaggagacatgggttctggtcattggagtggcttattttacttactggggagacaagtacttaaatgaaagaattaacagtcgaagacgagaaatgattaggtgcataatcaggtgcttagtcatttattatgctgccaaagtagcgaatattacagaagcttagggaggagaccagtcaaatgtgggctgacgtagtcagggatggattcctggaagaggcagatggggacattataaactgttgtaatgtaaatctaatttcccaggaacatatttatttgcaaagttcatttaaaaaattatgaatcttattaaaaatatagaaaattcagaatataaggccaaaaaaaatcaccaataatcctacaactcactcatggctagatattttgatgagttaaattttagtctggatttagaacattaaaaaatgataactgctattacagtatgataaatctttgtattttgagttaattcttcataatgcaatgatgtatttccacatgttatggtgatgtaaatattgcatcacttgaacttattaacactctttcaatttttgcaatgatgcttgaaaaaatttttaaaaagtacctacatttcagactatttccttcagatagattttaaggtttggaattactagggtatagagtgaggacattgataatgcttttggtacatgttgccaaaagaggtatttgagaagaaagggtattactccctttattccttcattccttctttttttcattcagtatttatatgctaggcctttttccaggcgctggggatacagtagtgaacaaaataagcgaagatccttgcctttataaagtgtataatttaggaggggaaaacagataataagtacaggttaagcattcctaatctgaaaatccraaatgctccaaaatccaaaacttcctgagtgctgatgtgatgtcacaagttactctgaacatgttattttttcactctattaacagtatgtcagggctgggcacggtggctcacacctgtaatcccagcactttgggagaccgaggcgggcagatcacctgaggtcaggagttcgagaccaacctggccaatgtggtgaaaccccgtctctactaaaaatgcaaatattagctgggcgtagtggcgggcacctgtaatcccaactactcggggaggctgaggcgggagaatcgcttgaacccaggaggcagaggttgcggtgagccaagatcacgccactgcactccagcctcggtgacagagcgagactctgtctcaataaaacaacaaacaaacagtatgttggccgggcatggtggccataatcccagcactttgggaggctgaggcgggtggatcccttgaggtcaggagttcaagaccagcctgcccaacatggcaaaaccccatctctactgaaaatacaaaaattagccaggcatggtggcgggtgcttgtaatcccagctacttgggaggctgaggcaggagaatcacttgaacctggaaggtggaggttgcagtgaggagagatagtgccactgcactccagcctgggtgatagagcgagactccatctgaaaacaaaaaacaaccccccaaaaccagtatgtcatattttttactgttaggtacttatatgtaaataggtacaagaaaataattgcttattggtagcatataaattcacagttgggaatgatggtgatgccaaaccacagattgtccacatgggtggctaagacagtgacatctttgctttctgatggttaattgtacaaactttgtttaatgcacaaaattattaaaataatatataggatggtgcagtggctcccacctgtaatcccagtgctttcggaggtcaaggtgggcaggtcacttgaggtcaggagtttgagaccagcctggccaacacgatgaaaccccgactctaataataattcaaaaattagctgggcatggtggcaggcgcctgtaatcccaactactcgggaggctaaggcaggataatcgcttgaacccaggaggcagaagttgcagtgagctgagatcatgccattacagtccatcttgggtgacagagtgagactctgtctcaaaaaaaaaaaaaattgtataaattaccttcaggctatgtgtatatggtatatatgaaatataaattttgcatttagacttggggcccatcctcaagatatctcattatgtatatgaaatattacaaaatctgaaaaaacacttctagtcccaagcattttgaaaaagagaagctactctacctgtatataatatgttgcatggtgaaatgcactaaagagaaacataacccaggaaaatggaatgaggaatggtggggataggaaaattataaatttaaataaggtgattagggaaggccacattgggaaactaccttgtgaataaaatctgatagcacatgccttattccttgatattttatcagacagagtgaattgtgtgggtataagccatgaagtggaagcatggcatgcatgtttgagaagcagcaagcagaccagcaaggcgggaacaaagttaggagaggagagttaggaagtgagtgcagaggtatgctggtgaagggaggacgttgtagaggaggccctgtattgagttttacaggattcctctagatgctatttgagaacagactacaggaaattggaaccagaagcaggaaaacctgttaggaagctattggtagttaatccaggtggaaaatgatggtggcttaaatcagggtgttagtggtggagatagagtgaaatggkcagaatttgaatatattttgaagatttagttggcaggagtggctgatacattggctctgggatgtgagagaaagatcaggagttccattttggatatgttaaatttgagacgtcaagtggagatgttgagtagacagttagataaatgagtctagaattggaagagataggagctggagaaataaatttaaaattgatagtgcrtatttgaagtgatgggactgaaagaggaccagcaaaggaaagaaagtcaagtccaaggactgagttctggagctcttcaatagggagagatcagcaaggagcctgcagaagccagtgaggcaggagagtgggatgctttggaagccgcctgaagaaagaaagtgactccaggagtgtattggtccattttcatgctgctataaagacatacccgagactgggcaatttataaaagaaagaggtttaatgagacttacagttccacatgcctggggaggcctcacaatcatggtagaaggcaaggaggaacaagtcacgtattacatggatggcagcaggcaaagacagagcttgtgcatggaaattcccatttttaaaaccatcagatctcatgagactcattcactatcacgagaacattgcaggaaagacccacccttataattcaatcaccttccacgggttcctcccataacatgtgggaattgcgggagttacaattcaagatgagatttggttggggacacagccaaactgtatcaaggaagaagcaatcatgggtgtgaaattgtgcttgtagatcaagactaaagattgataattgatgttagcagtaaaagaaggtcattggtgtggctgttggtatgtgagtagtttcagagaagcggtgaggtgaaagcttggttgtcatgggtccaagagagtaggaggcgacaaagtggtgactgtgggtatagacactgtttcaaagaatatagctacaaagaaaaggagagaaatggggtggtagctgttggaaagtgggcttgaccttttaagaaatatctgtagaaataacagcatgtttctatgctgatgggaaagatcctatagagaggtaaaatgaataaaacaggaggattggtggagctctgtctgagttggcaagaggggatggagtcctctttcacaagtggacaaaggacctttgcaagggtcacgtaataagacgaaggcagagtctgtggggcagaggtggtgggagaatagaggtggtggtggggcttgtgggagttctcttctgattcctctgttttctcagggaagtggccagtaagggaatcagtggcaattgaggttggagaagatttgagggaagagaagaaagtataaaatagtcaccaaggagagagagaaaaagaaagtgaatgaatgaaggaaaatgtgttataattactgagttgcattaaagctcacttacagttactaaccacagatttaaggtgagattaatcggcatagctgtgtgtttttgtccagccacataccttaaactataaggtgtcaggagtttccaagtatacatgaaacagctatgaaaatggaccccctgttagctatatgggtgcaggcgggtagttggatttaacaatgactggagtttgccaagagagratgacaaagaggcacaaggcagatgagaatgtgtataaaggaacagttataacaatagaatttaagctatgtaaggagaatcatgtagacctgaggtggatcaaaggcagtgaaaagggctgagtgtggtggctcacgcctataatcccagcactttgggaggctgaggagggcagatcacctgaggttgggagttagagaccagcctgaccaacacagagaaaccccgactctactaaaagtacaaaattagctgggtgtggtggtgcctgcctgtaatcccagctacttgggaggctgaggcaggagaatcgcttgaacccgggaggcgaaggttgcggtgagccgagatcgcgccattgaactccagcctgggcaacaagcgtgaaactctgtgtcaaaaaaaaaaaaaaggcagtagtgaaaagatggatagagtatatgcccctgtggaatagaagaaggaagagtgctacaggggttgaatggaaagagagaaggtggatcatggttggagactgagatgcttgaaatttgcaattactaaggggatttcaattattggtagtggtagagtttagggtgtgaccgtaggagtagagggtgagattgttgtggggagtggcctaggttagagttatagggatttggaaggatcatccccaagagtcaaggatgaggaataaccctggaattagtaggtgacaacaaagcagaatggtggtggtggtgttggtgtggtagggaggagggcatggtctggtgaccagaggttaaaatctagggttttggagagtaaggaaggtgaatggcctgtaagtggctctaatgaacagaggccatctatcccacctccaggccagtgggcggagaggtagggaagaaacatccaactcttgaaaggaccccagaggaagtgagcattcggttgcagtaagaaggtaaggatgtaaagggagcttagaagaggttgcaagttttgcttctggctgaccaggagtgccaaaagcaagttagttttgtgagttggggagccatagacgtgagtgtgccagttttgctgttcctgtggcaacctcattaaaaattcagtgtacttttgatggaagacatagttctttgtcttttgaatttttaaaaagtgttggtatgattgactgttaattcatgtaagaatatacaatkggtcacatttatgagtgatgcctaagtgcatcttttgaaagatttggatagtgggaagatgagaaaggtgaatagagcatgtcaagttttgtgggaaagttaaatgattaagctggccaggtttagggatttatatttaagacacagatatgaaattggctgggttggtcttaatgtctgcactaaggattgtaggctgttaggatagctttactacataaagttcttaaaacattaaaaatggtaaaggtcctcaaaaaattaatgtagaattattatatgatccagtaatttgacttgtggatatatrtgcaaaagaagtgaaagcagggacctgaatagacatttgcacatgcatgttcatagcagcattattcacaatagccaaaaggtggaaataacccatatgtccattgatggaataataagcaatgtggtatctacatacaatggaatgttactcatctgtgaaaaggaagggaattgtgacacatgcgacatcatgaatgaaccctgaagacatcatgctaagtgattccacttatatcatgtaactagactattcaaattcatagagacagaaagtagattggtggttgccaggggctgggagaaggagataatgaagagttggtgtttaatgggttcaaggtttcagttggggaagatgagaaatttctggagatggatagtggtgattgtggcacaacaatgtgaatgtactcaatgtcacaacatggtacttaaagatggtcaaaatagtaaattgtatgtatattttactacaacaacaaaagtctcaaaggacataggcactgcttctctaatggtacagataagggctaggcagcagtggcttgttccctggaagcagggtggagtggggaagacaggattttggtataaggaaggctctgtttgatgggcatgtgcttcccctgcagagatgtccgcattgtctctcctgtatgaatgggaactccagcattggggttctcattgtggtttagaacacacgatgagaacatgttttcttaagtaggaagacattttctctgtgtttttatttactctatttgtttagcaattttttttcatagatgagataaggataactctagccttcaaaattattctaagtttttaatatgaattcatcttttaaatattgtatttactagttgaatagagtgccagttactttggagtcattttatttatatcctgaacttggcagaggactataaataaagaaattggaaagctgtcattcataatccgctaaggcctgtttcatgaaaacatgttgtagttatttgtccagatgtattcttattgttgagtcacagtaatgactagaagacagatcaacaggaggatgtaaataaataaagccaaaaagaaaagccagtgttggattctttggggcctgatggattcaggctgaatcccagctctgttacttaactctgaatttgttcattgtgagcctcactcttcttatttattaaatagagagcttctacttacctggaagagtcattttgatgaaataggataaaaattaagccacctatggcaatggtatacctaagaggtagctggtagtattataattgttactgcaaaaatgtttagtgggactcttcctgaaacccagtatgcaaacttagaaagcaaaggaattagcagaagggtccttcaatttatacagattcacctcagggtttctgtaaatctgggggagtcccttgtgtatttgatgtttacagatcattagcaaaacagatgccaggaggcgaataaactgtagcttaaagattttggaactactgacaatgtagagaaaatcagtttctgataaagttatagtgtttctaagtaagcagtagaaggcaatgggaaaattttaattgggtttataaaagtttatttcaggaacacatgtatttccaatttgaggcacacctatacatctgtagtcattgaatttatagtgcttgcttatttctccattggggttaataatataacaacaactaatatttattgtgtgcttacgacatgtcagtgtgatctttaggaagtctgtagcattcaaaggcttgttttcatttggatatttggaaattggccttttatccacttggagacacagggtgtttaatgagttcattttgttctattaattctattacactccaaatatttgttcggtatttataacagttaagacattttgtaggagacaaagttaagtaagacatggaacttggcctcataacagacctattcactatattgtatatgcttcagaagtgggcgtgccgtgttatgggatgagccctgatctagtcctggactctacccctggctctactacttcttcgtggaacctttttctgcccccttaggacaaggccagatgcccctgtgctgattaactcctagtatcacacttaccaagccccatggtacctgcttgtttaattctgtgtgttctccattagggctagactgtaaactcctggagggtgaggactgtgtcttatttatcaacagggccagccacagcagagcatttgttccacgagtgactactaattttctaactttggacaagtgataacctattgctttaactatgataaaattgatttgatagtctctatagcatagctttgtcaggaaggtaaaatcagaaaatttctctaaaatgcctgtcacagtgcctggcaaatagtgggtgttccatcaaatagtttttttatatttgaataaataagttatctcttttcaccaaatttgacacatatgatacatctatttatgaagaccatatggagtgatgtcatatttgtaatacataaagggcacagctgtcgtttaggcaaagtataaagtaattattcatattggcataaaaatgtgacacttcaggttactcattcaaaaaagtgggataaaatgaatcctaactcatagagaaattacatggaagcctgagattataatcataaaaaaactcatctataattatctatcaatttgatagattttaggaattgtttccaataattttgaagtaattttaaaaaattccaaatatttaaatttaagtaataatgaaagttgaaaactaagatattcagtagagaaaaaggtaaatgtaagtgaacatatccttttgattttttttttttttttttttttttgcctccagcacaccctacccttccttttgcattttaaagctccctttggaatttcacttatgtttgatttttggattcacatagcataaatttgtttaaggatcagacttatattccttttgtagatgaagttataaaaaatatttcaaactatcagtaagtagtggcatttgctggttaaaatccttccatattctccagaaagaaagatgaaactccctagattttactgtataatgtcaatggactcattatttgtacaacagctgatgtatttaggacttgttgattcacttaattggtaactgtactacattcataacttcaacaactgaaaacaataggtcagtgtctgctgtttatgcataaatagtcacatcggagcaggatatgtctgaatggcagaatatgttagtctgaggaggaatctggcatgtgaatggctccattgcttgccatactgaggtgggtttttgctgtctttccttgaataatgttatttgtgtttttattatgggtgttgatggttaactgttcctatgttatcaggctggctgctgtgaaattgcatttgattatactttaaatgccagtgttgggggaaaatggtagactagactcatggttaaaaattgggatgatttaaagtttttatgtcttacagccttcatgtgctaaagcaaaaagttacacctagaatagattttttttaaataacaaatttcatttgtacgtggaatccaaataaatgttcatttatagtccttcaaaatgattttttttctaatttatgaattagacgtctttcaaattttagagtcaaatctgcattttagaatcagtattttttgaaaagagtaatttttaattaaaaaaattcaaaaggaaaaacaacctaaacctttttgtttcattgtcaaaaaaaggaaaacatgctggtgatttttaaactctgtaaaacatttcaaacattcttttcaaaaatatattatttgtaacaagtaaattttaacaatcgaacaatataatttactagaataattgtgtttagttattacaaaatgctaacctaatgagtcaggtattttacaatgtaaaataaatgaagctgagtttttatagctatagtaagtttactagtgtccttgaaacgctatatttaatgcagtccagtttgcggtcatcttatcaagaaactttaattttgcataatacaaaaaaattttcttcttgaggattaaaagaaagcttatttctgggtgtattttggggaaaatttgagcttgttctcaaactatacaacttcttagactattttctgaaagtctgcatttttagtgtataaaatttggaaatgtcattagtgaaagagcagtgtagtggactgttatcctgtttgcagcatattcccatcttctcatctggaaaattaaatctgattacagcttggattaacatttatggttgtggggagaggaagatagtatctcaaactccatgaaattgaacaatgagattatatggtgtatagctaatgttaaagtcctgcttcttaaagggcagaatttgtaattgtaagctttaaatatgttcaatattttgtctcttattgattgaaatatcctagagataatgattgggtaaattcagcgggcattaaatgtaatgttttctgccttgaatacctaacatgttaaaagtgaaagcagtgtagattcccgtgttaactgctacatttgcagtttctcttaaatttcctaaaagaggtcctattataggagatgatggcgtttggttagtatgcagttgttaacgtgttttgtacaaagtgaagtcggtgtattttttaatcagtttaaaaatatgtcatgccttgactctttaaatgaagtcattggtatgacagagggaaacaggaaaataatttggtaagatgtgtgtgtgtgtgtgtgtgtgtgtgtgtgtgtgtatgtacacataggagttaccaatgtacaaatgagccctcatacgtaaccacagcacttttatgaattattttgcatttctgttgtaaaagatctgtctaccacgttttctaggaactttaagcctaaggcagaactcagggtttttggagcctgtgtaaaataatttatagcacctttccagtaagtcttgcmcacactcttattctattaattaaacattctgtrgcaatctggtatatcttaaagatttaaaagtatgtatagtagaagactggaaaacatagactgttgagatggaagaagattagcctttcttaaaagaaaaaatgttagacatgtttgtttaggagatcagttttttcctgctgtgaagacatagctttttaagcatggtcatgttctgtgcctgagtgagattgtgcttttgggagtcctatactgtgaaatgtgtgtgttcaaatatggaaatgcttcttgtggccttcagtgaaagtgatrcacacttttctgtggggacagcctctttgatggccatggtgctgtgacatcacaatgacatgatacgaaaccttgtctgagagctacctgcctctttggttaagagatgcatggactctattagggcgtacatattattagcaagatattttaaatacaatatttttttcctgttgaaaagtattttcctgggagttgatgacattgatttttaagtttgtgagttatctattgtctgaagtaggagaaagttgttgagagaaaaggataaggaaagaagggtgtgctatgtaccactagattcttaattttctgtcagcaggacaattcttgggtaaaagcttgacatacgctgattattcttactgccaatcgcctaagcaaattatgttactttcttccatggtagtactcttccctgcagatttttgtrttgaaagttagctgtttgataacactgcatttgatgatgaacttatgaatgtgagaaggtgttttggaacgttagcaattatagcattgagtggtggataaagaaatagatatataaatattagaccgatgcacagttttccagtgtatgttattttccatataaagatatagaacatttcataaaatgttcccagaccatttaaaactcaaagaaatgcagctgacgcaatgaaatacatagagtacttgtaaaaacatacagacacgcaagtggattgctgccagacagaaaatttaaaggcggtttgcttaactgcagggtgctaggttttgtacatgtgccatgctgaaactgttagtaaggcgggtgttgtgttgcttgagaaaagcagattgtatttggacctttttaactcagatgtttccaatgtcgatattttggtgacattatggcattgcgattgactcaatgtgaaaaaagatttcagcctcctgtgttagacattttaagaaaattcaaataaattatttgcagtttttgtgttaatctttccaaaatggctttcgtagttttatgaactatcggactgaatctttgagctaattgaatggaacttgataggttgacttggttttaaaaagcattgcttttctttctttttaaaaatgtattatattgctttggtgaatgttaaagacctatgaagtttgttttttgtaaatgttagtggccttaatgaaaagaaaccaagagttgtatacttgaatcatagtaactaataatgcatgtattctcttggaacgttattgtgttaaaacctggtaatttcattgtagagagtcttaggacaattgaaggaatctaattgatggcgtttatattgctttccattgaggcagtattgggaatgatacagtttgaatggcctccttcttggcattccatggtcatctttatcttcaatgtgttaagataggttgattttttttcttttcattaattttcccatgcttttttcaatgctatgttgtatatattaatcaaaaatattttttaaatgagtttattatggtttcttattaatatagttgactgaaaagatttaagaagcatctgccacctaggaataagaatggtatttttaaaaattgaagaatatactacaaattttggtttcggacatatagtctttcacaaaatggtgatagaaaagtagtctttggttttgttttcatgggtattttgtagttcccaagaagcacaaattactgcaagaaagagggcatgatagtaacgattggcatgaaagtaatttttgtatgaagtttggtagctgaagaataagtgttaaaccacatgtcaattggaagaaaaagaataagccttagatgatttagtggctttcccagcctctgttttattatgtccctcagtggcttagagctacattttttgggtctctggaccaaattttaagttctgtatgtatgttttagggattatagccactgctcttttttaggccccttgttccccgttgttcaccccctttcccctcactgtacactggtagaggattcttgggcaacaggctgcccctttgtctcctgctggcgaattcttctccgccagcctagtccttttcctgccacactcttggtgcccgctggcctcctctctcacgagggctgagtccttgggcagtttcagtccttcaggccaaagacaggtcaagtgaagaaactgctgcctatcagggaagccctgagttggtactgcaggggcattactccagagttctctagtcrgtctaggcacatcattgattccttcccagtagttgaagaygagggtgaagaaagaaattgattcccagcttttaagtcaagcaaaatacacgtcaagagttgaaatcacttgcagatagtttcaacttttttgcaccactcatttcgagaggctctayktttggcataaccttttgaatattcctgcttttattattagtcttgtgttttaaaaaataatacacattggttttaatgacttgaaaactggtatttctaggatcctagtagtttgtgaataggcccttagttttttcccttcttgattattcactgaagaaatggactgcagtgaacttttacgtggattcattttcacaaggatgtaaattagtgttttagtatggtgtttaaaggtagccatgggtagcatatattgtgaccactgttagacgggagaccctcaaatctatgattttccataagcctttgaattgatacatgatttctcaaatagatattattctgacctctgatcacttcccttaacatgtctcaaaggaatcaaatcttttccttattagaaatgattgaatgttttcctaatcgatagtaaatggaatgctaatagcttttaatttgttcacttctgtattgacttacagaagatggcattggatcatcttgcttatgatttaagaataaagtgatccctttagtaactccattttaaataggtgatcatgaaaggtattttctgccatgtatttgtatagtttctgagmaagtttaattatgtcagctggaacataattttttcatattttgtttacactgacaagccaaaagcgttggtcctcttttgaagaaaacttccatccagttttatctgcattttcataagagtgtacaagcattttgagaaggatatatttcatttattaaagcgatgagttttgcatttattccttgaaagaattctctcactccccctttctccccagtctgaaaccagtgcttaaggtggtttatcaagcccacatctgtaactatgcaaaggaggcttctgattagagaagaaaagtcaagcagatttaagactcattttctctggaaaaatatattgagggcaatttgcagctggcaagatttttgcattaggtaatagtctaaagttaacagtagcatcaggtctttaaaatttttcttttttatatttctggaggagggtaatgggagtgccttgccgagtccttccttgtgctcatcaacatagcagcctcagctgccccccttggatcccctgccagggctgctatcatcttctgatcaaatattaatgtgtgatcctctgcttgctcactaatccaaagccaattaatattatctgtcaattatttacagatcctgaggtgcagaggcaattcccggaggactacagtgaccaggttcggaatgcgtaattaattttttacatgacaaaatttatttcagagttgttcaacatattattactgttctttttactgaaagagataaatgaatttttagaagggaagaaaagcagtaattaggaaccaaagacaaaaagtaaaacgtattgaagtaggactgaaaatattggtgctagatttggggtgtttccttcagggagaaaatgaacacaaaataaggaagaaaacctatcacaaattttactcttcactttgaggtttgctacagtctacacttcattaggaaatcctttttgcattgcctgtgaactttttaaaaaaatgctatttcaggagtcaagaagcagtgtaacaaaaaagagggaagagggaagtttataacatttcctggaatttgaaatagatgatgaaattatgtgttatggtagtattggaaggagaagatgcacgtgcagaaatggacttaagggtgagggtggtgctgatgaggatagtgagttaaggttggccagttggctctaccatcttgaattgacagcattctgcaagcatagaatggggtagaaggaacgattttactcacaagatagtgctgaagttctgatgttgctgtattttttataattagttctaggttatacattcaggattctagtttctatcttgagagatattgaagatgttttgtagcttttttggggcaccttacatttttagttcaaatatgcaatttggtatactttttaaagcagctttgaaataaaagcattcttgattacactgaataagacaactttataaaacctttcacatgtgaaataccatatacagtaaaagcatcttccttaagcacatctatttaatttttttattaaaagtctttgaatgaggataagtmcaatagaatagaaatacccagtacagtgatagtaacacctttgcagtgtgtcttgttgtatagagagcaaggtatctgatacatctttatgaataaaggggacataatgtgaccaggaatagaactggataatcagtataatgagatgctttgtaatgagatcttatagtacaagaacccaagagaactggtatggtttgctttgtgtttgatctcaagacttttaaataagattttaaaaaatattaaaatcttctgactctgtctcttgcttcatcttctactaggagagttaaatttttattttatcttaaatttctatgagattgggctctttagatycaaactacgcaatccaaggattataggaccttttcattaatgaatttcctttctttagacaatatataaaggctggaaaatcttaacgtattatttagaatacacttgagtccacagattttaacaaaattattgttctaaagtcttgtgtctaggtaaataacctttgtagttccatgatctgaattctcagtgagagggaattttataggagaaacttaaaatagcatagttaccatctgggtctattccgttcaacatagtttcttactatatctgaaagtttttgaacaacatgatttcttttttagtataactttaaaaaactgcatgggtaatatgttcatgacaaaacatgtagaaactatagataaagcaaaaataaatttacaaaagaatgaaaagaaagaaaatacaaatcatcagttattatactgcacagagataaccactgtaacaatttggtgtttagctttccatgtttatttccctgagtacacatagaagtttgtgcgtttaaggagagtgtatgtgtacgtatatgcatacacatgtactattcttgcatatgtgtgtactgagagaaatataggctattatcaattccatcattgtatacagagctcagttgactgattagatattatcttatgaacgtaattctctttgctttagttaatggatggtcttacaagtatttcatatattgaagttggaattattagaattatagtaggaacctaaataataatgatagctttagttattttaaaggtgcgcatagtatagtagtatttgttttctttgttgaaatcattgacatcgttttgaaatttggagaatggtcctcatggaccagaggtagacttataagagtgcacacaactcagcctcacttagcagagatttatttatctcttccaacttgacacatacgatttccttttttttttcgcctcctataacccaagaaatgattaatgaaggatctactttgttttgtagacattatcttcaaattcccagaaatatgtttgagagttgtatctactgggaaagaaagtgagaactgtgtgttttttaatttatctttttatcatttaggttgtaatcttagttttttctccttcacatttgttaaattatcttttcctacagtaaaactattataaaggaattcttagaaatatttctattacatacaaaccttaaatgctgaatatgcacttaatctcgacaacatttctagtattaaaacatttatgatgtaatccttaaggaatatttgagataattcaccacaaagtatagcacttattaccacacagacacacagacacacacacacacacacacaaattccccctcccccagtttttctcattcgcctaaactaccagtgcttgtttttacatatagtgtatttcccatgtaccagcacattgatcagagacgcttgctgctgctagatgttttattctgtgtgttctttgtaccttacagtaaaagaatctgtcacaaattattgtggctcactgctttagaaactgagaaaaaagggaggttagattgacatctgtgactgaataatgatgaccagccttttggctctccttgagccacaaagctagcactgcctttagagtggaaaaagaagtaagaagaaaggggagggataaaagagagttacaaatctgtggtcccggagatgtattactgttgggccagttgtctgcgtgggatgataatccattttgatcttctctgtcttaattgtctgctaaagacaaatgggcagtaaaagttcatcagtttcatctttttgcttctcgtttagaagcagaataaatgatccatcactacagaagaagcctttctttctgtcacggaagtaatgcagacccaacacgttttattaaaatgttttcccctcattatttcagtcctctcagctctgatagatcttactgtttcataaaaaatgtaatctgaaatgtaaataagggtctcgatacagaaggaagaagtaatgagcagcctgattgtaattactgacaaagtgatttctctgtgccccattttttttcctccttaagttgtctgtgacaccctcagaccacaatgacatctatggtttaaaaccattaaatcactgtagcactcaatatttcatttaaaatctggtaagcctgctatctttaaacctggaaatacaggctttgttaattcctgaaagtcatgcgttgcctatattttttttaaaagaaaaaaaaaaaaacaaggcaaaagcaggggtttttcagagttcatattatttattcatctgcttttgtttaatgcttagctagtttaaatactaaaacatcaacattggtaggatcctgacttgaaaagaatcctgtatttttgaaaaattttaataacagcttacttatgaaattttcttaaattctatctcccttaactgtaatatgacgtagtctaaaatgtctttttagggttaagattactaaattacagtgtaagttttcagttactttggatttgcatagcttggactagattcttttcagtctcttactrtaactttaggtaatgtggctcttaataaaagccaattggaaaattttgttaaaggactgaagcacaataataatgtatttctttcatttctagaaattggtttctcaaatatatcatgtcaatcagacattaaaagtaagaaaaaaatgaatagctttccctgctgaaaatagtcttgtagttaattaagtgggtttataattattctattatgtttactgtgttcattcatagttatggaaataattggtaaaactttacttattgtgattagttcagttttaatgaatactaattgaattaaaggagaaaagaatggttaaattaacatgttagcaaattatggtcaccactctcatcaaaatcccatctttggtctcaaaacattatatgattttttcagattaaaaaacatgagcctttattaattayaatatttagtatgggatggtttgaaattaagagataataacctatcggagagatttccataaatagtcttgtaatgtgtcaagtataataggtattacacataccgttttgaaatgtattagttataatatgattacttcttatacgaaaacacgtagaattaataatttgtcctcacaattgtactttcatagcctgttttttctaagagtggcaattagagttgagtgtgctaaaagttgcttctccagtgtgctcatccacactttgatggaatacagtgagcctcttagagccctttaaagagtggtccaggcacagttacctacccctgtatatgtagattgctgtttagagttgcaggtaatttttctttccactggcactgaaacagagtgttataatgaaaccaacaatctttatgcgtttatagaaactataacaattttatggaaatctttatatagaaactaacagtgtttcttgtacaagctctataagcaatgtagaaacatggcacattgggaaaaattaaaaggtgccctttctcttaaggttttatattgcctatgtgatttcaaaatttcactataggcagttaaacaaattataaaaacatataccaactatatactaaaaaggaacaaaaatatgttgcataactcaggctaattgtgatggaaattggcatttctgagttgcatgtaattgcttaaatatggagttttcatctgttcatgcttgaggtatgctccatgcaaaacatttcttaagcttatagttattcacaatataaccaatgtaaatcagctggaagattctgattagagagacggtagagataatatttaaacaagayttgcaacttgtatgttgaagattgccttgttcttttggtgagagctcctgtgtatgaaaactttcatgttactttcttcaaaattttgataagccagagataaaacatttctattgtaaaacttactcatgccctgattcattgaaagaatactatttcataagaaaattatagatataatctagttcctaaatttttgttactatgaaaagaagccacattataccaacattgtatgacacaaatgtataatatttacaggaagtataaaacaaatgataaattttgattttttttgcatcattattaggcagagaaacataagmagcagtgtggtgtataaaatgtgactttgattccacaaaggttctgccagtctttcgacagtggcttgtttaaaccatgggtcttcacattggaattgagattttgggtttgtggtccttggggccttgtattcaccaagctcacaaagaatggaattgaacttgggtgtatcccatttctcttggaaacttttgagctttcttgttttttttttaattcttttccaaagtgggtgttgtcatgcttccagtactcgcaggttctcttcaaactagatccactttaaatggtgaggtcacctttgatcttggaaactttttatagcactatataccatggaacagaatttgtaaattcatttgactctcatccaaaggacttatataagggtcaaatggatcacattttaaaatggttctataatctggtcttaaaaagagcaacttatggttacaagtgatgatatgttctgattcttttttcatcatatctgtgtttggcagcagaaacagtctaggagactaggtctgattttgtatattaattgagagattgctgagtgtactatctgcagactttgagccagacaacgtagcaggtaaagaggaggagagaagtagattccgtctctcccttgaaggaacttactgcctagtaggctatagagtaatgcatgtctaggatgttttgtggaataatggcatggccacaacacttgaaagtgggaatgtctctgaaaactagaacccttgggtggtgctgccatgatcacattcctgcaatttcttgttctctgtcacatgaagccgtagaagttagtagagttaagtggtatagagaagcaagtggaaagtcttggagctgcccttaaaggtcaccttttaggttgttttagatatgtgcatttctttctttcttttttttttttgagacagtcttgctctgttgcctagactggagtacaatggcacaatctcagatcactgccaacctccacctcctaggttcaagcaattcttatgtctcagcctcccgagtagctggaattacaagtgtgtgccaacatactctgctaatttttgtrtttttagtagagatggggtttcatcatgttgaccaggctggtctccatctcctgacctcaggtgatccwcacaccttggcctcctgaagtgctaagatttcaggtgtaagccgcagtgcctggccagatgtgtgcttttctaagagtcactgttgattcttgggtttttcaacctcttgcccaaaaggctcactttccgtatttcttagtaacttggcagtctggaaacgtaggtggaaatgtarttttttcatctgcaggtataaactctcaatctctttagactattcggcctaagagctgattgttagcatgatagccacagggtgctctgctgaagcgggtttcttgaagtggatatcagtatttgtgaatgccaccaaatgtagctgttctgaaggactgcattacagatttctaaggttcattgatagattacagatgtagaaatacatcccagcttaaatatctgcttcttttgtatatgtttaaaagtgtcccattgttgacaattagctagtttaaatgttttctaagtataggttcatagataggtaaaaaaaaatagtctatcacaggttgcctcttatttttccccgtgttgttactagtaaaatatatcaccttggacaaatgtcaaggtgctttttaaagtgtttgctgaagaaaaaacacttttttgtttggttttgtgttttagagttggggtctcatctcagtctgtcacccaggctggagtgcagtggtgcaatcatagctcactgtatcctcaaacatctggactggtctcaggcaattctcctacctcagcctcccgagtagctgggacttcggggtgtgtaccaccatgctgcctaatttaaaaaaaaaatctttttttagagacgggggtcttactatgttgcccaggatgaccttcaactcctggcctcaagcaatcctcttccctcagcctcccaaagtgctgggattccatgctcagcctcagaaaaactactttgtatataagaggtactattcagtaatgtccatatgctgagtttttgtccatttccagagaagggtgaatttaagaatgggatggggttgaactgacatcttaacgaaagtatatttcaaccttaaacatttagccaaactcaattgaaaaattgagacattttctgacttaaggctcttcttttaagttgaagatttcttcccaatttggtcactccccagctgttacagttatgtagaaggaactcattaaaaagacaaattctttttgagccattctttctgaaagcacgccaagctatacagctatgttgtactactacttatttgaatctgactccaggaaatggtaattatgcaatccttacttacacattcttatgagaatgttctcttgggtttattctggatcccaaaaagccccactaaatttttgtctgttgagtactattggatggtcttgtttctagtaagttatgctatgattaaaactaaatggaccaagtctgcttttgagagaggcagtctctgttttctcttagcctcatagaatcagtcccggttgckccttggacacacctacaagtcctgttcattatttttcctaaactgctctctagtctgtcctattcttctgtttccctctgcattcacactcaaagcttctctcacatggactcttcctaatggtctacaagccagtgacgctacaatcaccaccctctctaagatggccggagatgactttctaaaacctaaatcaaatcacataacttctctttagtcaaaactcttgatggttccctggtaccttaaagatcaactccaaatctcttaacttggatttaaggctggtcacagtctgactttgacccagcctctagtcttgtctcctgccgcctccccttacagcccagacataggatgcctcatcatttcccagcttgcttggcttttcctctcctgtatattttttgtccaaactggcttttggttgaaatatttttctccttgctgtcctgcaactcctacctcagtatacttctgtttatacaccttgtctcaccttctctgtgaaacttgccctgatgaaattagtcacttcagccttagcttttaggcagcaatgggaggatccacgcctatgtcgtcttgcttgtatatctgtgtcttcatcaatctgtgaacgcttcaaatgtagaaatggctatggccaatgttacagacccctttgagcagctaggacagattgggggctcagtgaacaacatgaggtatgtgatacacagatgtaattgctcaagagttaagattccagaaagagtgcagaggaatgattgtggtgattaagagcttggactttggagtgagactgctagggtctgaatcctggctctgccatttacaggggtttaccacttggggatttgatttcctcatctagaaagtagagatagtcatagtaactaccttgtaggatagctatgagggtgtcatgatttaaaatgtgtgaagtgcttagaataacacctgacaccaaatcataaccaataattatgtcgtgtctcctattactgggcatagatttaagtaaggcagcaaagtaacctggttttggtgcctttgtcaggtgttagggttgtgtatgataacctttgcctctagaatttcagactgatccaggaaggattctggaaatgcctccctttctaaacccacactgtttcagaacaaaatttagagaagtcacaaaggtaaaagtgaatattttgtcaagtaaggatgaagagacataatcagaaacaattcctgaatatttatgttctaaaatgtactgaaaatataaaaaccctttaaatggtgatgaaggggtttcagataattactttttatttattttattccagttgtgaaatctatatgttgagattcccatgttcaaaacttcagaaatttagtaatgggaccactgtccttgtaaatgagcccttttggttgtgtgtagtattttgtattactgcggtagctttcatttttcaaatatttatatacagtacagtaaagattcctctgactattataattttcaactgtgtaacttcagtcagtttcagatttcagaagtggtataacatgaagcccagactgtgggcctgaatatatgtatgtatgtgtatgtgagsggggggagctgggggttggtaggtagaaatgaaaaggtgtttgtaaaatgagaatctcttaaaattgatttatcaaagattatttacataaattgtgtgatataatgttgtttcacagtgcttttatccctggaatattcttatctaggttgtttgtctagaagatactaattggtttttcaaaagttagttcaaatgccacctcctttgaggaatcttttacatcccccaggtagatttctatcagaaaacctaaaccactttatacttgtttacctgtcctctccctttcccaggcaggaagtcagagattcttgccggcttcgtgtccagatctctaggacctggtaactaactgtgcatggctgttaggaggccaagtatttaatatataataagtgactgaatagtcttcacactgtaatctttgggctcagaatttaagctaggtaggacaaaccaagacatacctttattaaatcccattttacctagagaggcttaaccagatgtgtttatgattctcatatttgagtgtatatcrgacatgatgcctctttgtgtagtatctagttttagcggtataacttgtaaagcgttgagaacattttttatcagagcactcttccaacctgccagatacttatcatttctggagatctaaacccctggcaaattgagaaatagctttcagatttaatggcagctagaaatactttttattattcatgtattatttatgtcttaagaaatatcccctaccccttaaaatattacatttttatttttattattatttttttttagacagagtcttacccagtcacccaggctaatgtacagtggtgtgatcttggctcactgcaacctctgtctcccaggttcaagcgattcttcttcctcatcctcctgagtagctgggactacaggcatgtgtcaccacgcctggctaatttttgaatttttagtagagacagggttttgccatgttgcccagacaggtcttgaactcctgacctcaggtgatccacccaccttggcctcccaaagtgctgggattataggcatgagtcaccgtgctcggcctttttttaaataaaatgtttaactcaaagaaaagttaggaggcaaatatccccatgttatatgagatttgacttttgatatgacactttgggcaaagactacattttttggcttcatctttttcatctgtaaaatgaaaaagtattaataatactaactttgtagaattggcaggaaaagtagccataatgtttacataatacctgaattcatctagtttaataaatgttttctgatgtagtatgaggaagaagaagtttgatgcttctgtgtaattgatgatgtctgatattgtatctacatcccagaatgtagacaagtccttcctgtagataaagagcctgaagtccagtgataaaacctcactattttagcaccactctccagtttctcatcacaaggcagatgaaacaactgtttattattttattgccctccagacaagccatggtttcccctctaagattctggtggccatagcatccaatccaggatacttttgagactgaaagggagcactgtgactacacagaaatcgtgggcataactgggatgtcctgggcaaactggcaggtgaggttaccctaccctaaggcccttcaacagaacagcacaaacatttcactctattcctgcaagttggaagtgaggttggagaaaggctttatctgcattcaacatggagggctagtactgcacaaaatcttagctgtgtgaatgcctgtgaccctggagacagaatgctaatcaagattctcaatctccatcctttagtagagaggtaggcaagttacttcaccagtctacctgaaactaatttaacttagttttcaaggtgcattccatcgataggaggataatatctgcataaaattagtggtaggatcactgggtatgtaacacttctagcaagacctgacacatagtagttgctttatcagtccctttccacttgttacttaaccccctcacccacagccgccccaagaaaagataaccattggtagatgaggaaccaaataaagtctaaataggttagttccacaatcagaagaaactcctataggtcaatttagatactttatatatataattcatgttattaggcaaaaatggtaaacctttgacaaaaatgtgatattacatttatacaaactttaatagtcttccccattcctttcattttcaatgtcaagaataaatatttaaagtttgattctctgatcaattcaagtctgtgctttggcccatgtggtctcactgcttcctatgaggattaaacaaggaggcatgtagactttagcacagtgcatggcaatagtaagtgctcagtcaatgctatttcttcccttcttaatccgawctatcatccaatcatttttttcagcaccatcattcactggatgtttcctctgtgccagatactctggggaacactggtaatgagtgtaacccccatcattcttaactcattctagagataatggtcaatttgatgataggaattatagacacaggacaggattctggggtgtcaacttgggagaggcgagaagctcactgagaatagcctctaagtcctcctggggtccggaacatgtggggtggacggagggttagaaagtcttgtgcaagactgggcatggtggctcacgcctgtaatcccagtactttgggacgctgaggcaggcagatcacttgacgtcaggagttcgagactagcctggccaacatggcgaaaccctgtctctactaaaaatacaaaaattagctggcgtggtgggggggcgcctgtaatcccagctactcaggaggctgagcaggaaaatcggttgaaccctgggttgcagtgagccgagatctcgccactgcactccagcctgggygacagagcgagactccgtctcaaaaaaaagtctcatgcaagtggaatgtgaaaggatctaatccatgatctggcccctgccaccctgtctagtctcctctgttccagaataccaggctgcttttcagttccttgaatgtgccaaggagcagaagtgggtgaatcgcttgagttcaggagttctaggtcagcctgagcaacatggcaaaaccccacctctaccaaaaatacaaaaattagccaagcgtggtagtccgcgcctatggtctcaggtactcaggaggctgaggtgagaggactgcttgagcccaggaggcagagattgcagtgagccaagattgcaccacttccctccagcatgggcaacacagtgagaccctgttttgttttgtattttacaaaacagaacaaaaaagaataggaamccggagctggagaggtagttcagaagtgaacacttgaatttgagagtcatttaccttgtgctgttaattgaaactaagktataggtaaactgctaatagaggaggacgcagagagagaaggagaaagataaagtcctggaaaggagttgagaaggggcccagaaatagagcagtgagagaggcaggaggaggcccttctgtagtcttcatctaatggaacgtcattggacaagcaatgtgttttgagtgagtggggagtagagcaccagaaaaggctttctgctctttcaatattgctttaaaaatattctaagccaaacaaaccccaaattgaagagctctccattatccatagagcatgaattcatttatctgtcaagaaaacccatggaccttacctatagaaatgaactatattgatctaagaattgtctctatgaagagtccatgccacaaaacagttgtgagttttggatggtggaaacatgttttatttttaattatttatactttaaacatttttttaaaaatagcatatttgtatgcggtaggcatttggtcatttggcaacaatcacatttgaatcgttgaattaccagagaaccaacatgactggcattggcattttaccttttaggatttctgaatttgggtttttgggtgttggtgagtttgtttgggttatgcggtgtggccaggctccttaacactctagatcgggtttggcagactatagcctgaagccagctggtcacatcctgcccggggctggattttgtatggcctatgaggtaagaaggttttttacccttgttaaggattgttaaaaaaacaaacaagaacatgtgacagagaccataagtggcccgcaaagcctaaaatatttacaatctggcccttttgagaaaagtttgccggctccttccttaggttataagttacacatgaaaggaatccaaaatttcataggataagctcaaactgatgacttcaattccagaatgtcttaacactttgaaagagtgacttacctgttgaatcaggagaacacatttttggtggtgaaatgaagacttgatcgaaagactgccttgtatgatttgacagtacagtcagatggtaaaagaacttctgtactgtatgatgtttcagaatagttctgtaaagtgtctgaatgtactctggtaccaytgttgtgtttaatttgtccgaggcagcctcaggtaaacactagaatctgttgcagcaagatatgcaaagtaaaatgaaatatgtatgtgagattgtattattttattgtattttgctggacttctgaagggacttttttttctacttgcaaaaaattaaaacccttgagtgttagatgttagaaaactttttgaattatataatttctttatttcagtagtgtttcatatcacctccttctgtctttgtaatgaaatgtcatcaatctgttctgagcataatttttttcagttctgaatcctccttatcctccttatatcttcctattctttctatcagaatctgcaagttgtaggaaataaaagttgatttgaaacagttctgtaacactaaacagatgactgtttagtgagacgttctaatcaattgctaaataattctctctcaaaagcagatttgatatttacattttgattttcatattctgctcacagtgtttgttgacggtggctaacattccctgccactggataaataaagcctattatttccttttcaacattttaggctattattctcatacaagagctaataagcagaaggttaggtatattaccaaacyatgatcctgtctatcagaagaaaccaggaaccttgattaatatgccttgttaactgatgatttcagttccatattggtagtgctagaataatttgtataaaccaagcagtacagattccttattttagcactaagacttacaaaagcttcttttagcagcctttaattttgtacttatgtatgtgacatagcctgtggctgtgatagctactgtgaagctgcagttgttttgggatgaaaggaagaggcagctggaaactcggtagctacatctagctgtctacctagagaaggccttgatttcaagtttatctaaacaagctcgactaatcccaactatctagggggatccactgtcaaaacaagcagcgtggccctgaggcaaacacagctatacagaaatgaaggctggggcttccaatactccaatgactgcatactggaggcctttttcccccctgaaagagggtaagagaggtagaatttgcataatgccttttcattggaaacttttggaaagctgacagaccttcagcttatagatctgtagccacaatacagagtctataggagaatccttgaatgacctaaccatattgaaagaaaatataaaagcgtccaagtatagccaagtgagagaggaaaagaggctgatgcattgtctaacatctgctgtacttctcgttagttttgttctttgctattctgtgtggactttggagaagcctaagacagcctaacatgaatcctataatcttccttctgaatatttatgtagcgtgccagcttctaagctgtcctttgcgttttcctacttccccctcattttcatgctctcaaatgaggccaacatttcaaaagctaaataaatgtttgtgaatgtttataaaagatttgcataaatttgtccttgtctgacaaagatcacttttttcttatgccagttctgaaaaaaaatttttttaaggttttggtgcttgtcttgacaacagagtcctgcatcccagaacaatgattgctgattaagtgggtatgcaattgtgactgaataggctttcaagattctgagtaaaaagacctatcatctgaaggctgaattatagaatttagaaaatgttatcagaagtacacatttgaatctattttttggtaccatatcattaggtaagacaaagcattcttacaagttaaaagtatagccacccatgatttaaaaaattatcctgtataaattttaataattagaatgtttcaataactcagtatatcacttttcttccctatgtttgaacatatttaaaaataatttttagacctttaggtactttttggaaactgtaactctaccagttgtatgcgttaatacggttactggggtggtgatcagagggaatttaccaggcagtcctttaagatatctgaatgctcaatcataccttgagaaaatataaactacatgaagtatgtgttagggcttaattataggacacacatacacagcgcccagacacttatgccaccgacgggtgtttgctgaattcatttatcttttacaattagaatggattttgtggggtggcaggggaagttgtgggtagaggtgctaatttagttcagagatatttgaagattggcaggagagagaggtaacagccagttctgttagtcctttggttgtattggtttagaggtttaagttgtcattaaggcacaaactagagccacttctctgacacagtttttatcacatctgctaggcttgtgtcccaagaggagacgtggagagcagcgaattcagcatgggcccattatcgactgctttttcgtgtgttgtaaaaggagtgagacctcagggaggcttggagcctcctcccgtgtaatgtccaagtcagatttgaaggactggtggcaggaaagctttggccttggggtgtgaattctaagaaatagaggcacaattaagtttaaaaaattcaaggactttgagcttgrtaatgaaagatttttctctagactaatgtgagcagaaaagttgcccatctgtgcacatttttgtgtgcatttaaaatatttaaaagctgacagcttttaatatgcttacaaaatagtatttctatcagtgctcttttttttttccccttttcttttaaaatagtatcttcctaagggcaagttgcctcttcaatgaaatcatgtttgcagttttactgttgggacccctattcctttggtatgttctgacttgtgtcccctcctccccccttcctttcagaaatattgataacataaatgtgcagataacaggaatttaaatgcttaaggaaatgagcaagagaaactattttagagtaatcatattaagtccaaggaattaccactgaattctgattagccactgaatgctaattgtaagagatcataaccaaatcatttgttcatcttggaagtacagtatttgaagcatgtgtgaagaattttattggcatttcatgctgaccttataaatatagctctcattttcaaccactttgtgtaagatttaaaattaataaaaggaatcttggaatagaggatgttatataatatcatgattatggaacaactttgttttagctaagtttgagaaagaggaggatgcaaaaggataaagttaattttgttaaaaagttttaaaaataagatggagtatttttgcttcagacttcaaaggtcatgaaggtgtataaagtggtttcagaggggtctctttcactgttgaaagccttcttcttctgcacttaatgtccttgataatttagatacacagtttatatgaaacatgtttatagagtatgatgaatttattatatttatctttgaattacaacattaatactgcatattaggtattacatataaaattgcataattataacatgtatatgactcaattaactgaagtttataaaaagtaaactaggggtaaatattgaaatgtaccaaagaaaggaagcagactctgtagcatttgagcagcatgttagaaatttgacccggcttttatgtttgggtgttgaaaggcctttctgtaaaaccccttattccaggcttctttttcccactgaaaaaaaataaaaatttggttgtaattatactatggatcttagatttaatttgacacttatagtgaaggagaaaaattttatttcctgtgttcacatttaggaaacttctgatcaacattcttgaacttggtgctaattaagcttccaggaacaactgctttacccttcttaatcataagcatttaaaacctttgtgagctttcactggaagcccctggttttaacttgaaatggcttaaggtagaaattttgttagcttttttgtatgtttggattttgtgtgtgttctgtttttaactttcaacttgagttttaagatcgtcaatcaggcttttctttcaagtcagtggcactgcttgyaattgcaggacttagagggtcagcatttcccttatggtattaaaaaaaattaaacatagggagtattttaggaatttgagctccactgatcttttcatcacacacctacattttgaaatgaacaaataaattagatataagaaacccaggaaatgttctcccatggtttcccttccccttcctctttcactgtcgtttttggacaaaggtaaattatcaactgctatatcggctttcagcaagccacaaagaggctaattgtggctttacatattttaaaatacattcatttattcaagctatctcttctctttatttaaatgttttcctgcaccatgtttttccctttgaactattgcaaatatgcctcatctccctgcattctgtaactccagtggacactataatcactctgcacttttatctttcagatggcatttatttatggggtgtgtatgtctgtgtctgactgtcagttgttttcatctgccaaataaagctaatttttgtttataagtttcaatgaagcaatgaaaacaaagtatttgacatctggaatgttggtcgttgcaggatttcctatagccccctacctagcaccccaaggtcagggtgaattagtctagccttctcattaataatcccagttaacttcattgaatttggtcttcgagattttgcttccagataggattctataatggataatattatacatttaaaactttactgggttcttaggctcagtatcaacagaatgtaatctaatttctccagattggagtaaattcgggccttctgaccggatgagaattagaattggatgaagtgaatccaragtagactgaaatgaatcttgagttcatttctgaatttcatttgcaagtgtatccagcgttaggtgtgttaatttcatattttggttcrtactctgaggcttggtgtctcttgtgggcagagctttgtagatgttacttttctattacactatgcaatctgctgcttcatgtatgcataactgaaagatttgtgcaactgcctctctaacacacttcctccctgccccctctgctcttatttcttcctacatgaagtatcatatattttgttaggaagaaaaacccttttggaaattgcctatttcataaattgtctggtgacacaaaggggttgaatgctgtattcttgtctcatttattttgaaaactttgctactgaactcaccttaatcaatgagctcagtgttgtctccaataagttatgtgttggatatattgattgggagggattttagaaaacccgtctggggtttataatgtcagcagtgttttgattatgaaaagagttggaaccaggggacatggaaccaggtggcgaatgtcctaaagccagtggtgacatggtggactggtttcctcctgggatctagttcatgccctgcactttaactgtggtgactggctactatagattcacttttttgctcattaaaatgttaaaaaatcaaactgtacataaaaagatttgtgaaaatataaacttgggaattgatctggagagctggcacacagtcctccccaccccctgccttagcaatgaggtcatttacatttcatcagctgtgcagcatccccaagatccgatttatgtggcagtagttgaagttgcaccgaggctggttgtctaaaagagcttgtgtaggcaagagaaacgggaaagagaacaagaaaattaccttctacaaagaaagtgccctagccaaagacacaagttctagagagaaaaaggggttggtaactggttaatgactgttgtcccaataaagttaatattgaaagactgtgggacactgccatgaatgtggtactcaaaatatatttaaatcaggattttaaagcccccactcttggagagtggtacttttcatattcgaataattttatttttctttgggaaaagatgataagrcatgaatgtttatgtgtaaggaaaacatcagtattaagaaaatgggtttatttaattgatttattaaattggtttattgcagtttttatttacagagaacattgcttgtttttccctccctcttcctgtcctccccttctcaaattaagaagtagatacctcagttccaattgcgataatatgtgaatatgcagaacacagagtagatgctcatttttgttttttcttctgacagcacaccaccatcttgtttgacttaaattggaatatcaagctcttgtaatatcacaaacatgaaggaacatattgtaatgtaccaacatgtgcctacattgcctatattccctttccccctcccctccccccatcctattgcttaattagatttactgctgtttgcttagataaaaaggaaagctggtgggtggttacactcagcctacattgggtattttgatatttgttctaatattatctgacagacaagttcaaggttggttattactcttgacattagagagtggtaagaagtttctatattgtagtgagtaataagttgggcatattagattcctttgactctgctgtaaagcacaatgccttctcgtagccaagggggtcctttctttcaaaaatctttgaggccttttgccagtacaactccagcatagagtagagaagtgctttctgcacctataacttttgaggggtaaaagatagctttctttgtagctgatattggcaatgagtgagcactgaatactgagttttaaagaatggctgtttcatatactgaagttaagagatgctttctgttactattcaaaacttgaagtggaaggaaatttgtaaggaatttgtgtgtgtgtaaatcataagggttttgtgtatgtgaattgtagtatactttataattagcacagcaggcattaaatgttttatgtgatctgttttcctatctttgcctgataataacattatgcactgaaaaattgcctttgttctgattctgtattacctattgcagtttatctaagcatgattagtttataaacaatatatatgcctgaatgccacattataaagttaactaatatataagtaatgtttcttaggatatgctgaggtgttctcatccactctttttcacttcttagtttcctattcattaattacattatttcatgacatttcttagcagtgctgtgatatacatagtaccagtccaagatgatattaaaaaataggatatgctcaattgaattatgtaggcggaacatgctctggcagagcaagtcaatgtgctttctgcttcattgagtgggttattagattgatgtggtttatttcttgaatgatagaactggttttaaaaataaatgaagcgagaagcatcaattcagttagcattgataattcattattattggttagaaaagtgctacatttgtaagctgatctttaatttatcacttggattagggtttgcaatgggcaggtttgttttaatttgaaccagcttttcaatgactgaaaaatgtgttcttcattttgtcttgaagttgggattttaaatagttaaaaagcaaatcaagtgcatgaaaggaatacttttttaaaatttataacattggtctatgaacttatgataagcaccaaccgtgggctgtccaagtctgaagttaaattaagttaagctaaggaaaattctgtgaaggaaataataactaactacctgtctatgtggttagctgtgtgtatatgtgctatatatatgaaatgtgtcttttagggaaagttatacaccactgtttattgtgtgtcatgtactgtttttttctgtggtaatgtaagaagattgtcttctatgaataagttgttaaaatgtcaccttactttgtgtaccctaatcctgaataatgtgcttggctttatgtacctatatatgtatttttttagaaagacatttaaactggtagtttgctttagatttyaatacattaaaattaggtgagtatgttcaaatatggtgatatttcaataagaatagtatatacttaaaactgttacagtttggttccaaaataaatatatgcccaaaatggcaacttctttgtaaagtaagtaaatgaagttttaaactctaaaaaatgtagctgacagtgttcagggacaattatcttcaagttggctttcgattctgctgtgatttggcctattgatgttgggaagcgttgtctaatcctggccccctctgttcctaggtaacaggcaaaaacggtgccagcaacagcggccctgccaggccaaacccatgtggctcggtgttattcactctgatccatatggtcaggctggagatgttccctggaggggtgttaacactcagcaacccaaccgcctccctcccttsagagctttcctgcatggctcctgctgcttgcccatgtgtgattcttgattaatttttcatttttaatgaagtttgatcatgtttattatttctcatgattgactgcctggtactcctcccatgtaattgataaagcccatatttcttcatctgtctcctctttctttagggtaaagttgctagattgtgtgctgtggttaatgttagatttactggtcccattagatgtataaattatctctctttctctccacaggaagttctacagactttgaccaagttttgtttccccttctatgtggacaggtagtgtcagattttcaaactttactagaaaaaaagtrtcaataaacctgctatagaaaataaaaaccrtaccattcttaacattctgtctgtttaaccatgatttaagatacctgtgttccaaggagagttgcaatattctcccttcctggggtttttattgacactgtcaaaaagtttaaagcttagagctttgcattggttagtttgtgagatgtattttgtatggcattaaagttttgattttgttatcagacttaaactgtgattaagaatggttggtatttaatctcttgctatttaattgttatttaaatatgaatatatttggcttaaacaagtaatattacttgattccaacgttttgtattatatagactttgtttttcctagacttcaacttataatttaaatcagcctagccctatcttgtttaaaagtattcagcagggaatattgctaaatagtattttatattttgtttaagtggytaagaatggtatctctgggaaaaagagaattttctatagattttgagattaaaagtacaaaaccacctaaacatttccttagtatttacattgtgataaactgtttcttagataggtacaaatatgagaactctaagacaattaaaatagtctgaggttttttttttttctttttarcgagccactggttaatgataagaattttagaggagytttttttttttactttataaaactartgtattaactatattaataaaataacaattatttyattttcaaaaaatgtctactctttttcattmmagttgaakcattagttttttacattcatttatttgcccatttgattgttgtctcttcagttttctcttaatggaaatttgaactatgaaactgtacatacattacatcttaacaaacccacttttattgacagaaaggttatagaaaataacattgtaagtaagaaatgccataatatggtccaagaaagctataaaatttgtgcttatcttcaggaagattctatcatgtattttagtgtacccaaacaaggcaaagcctgtaagatttcagtgatttagagtatatgtgggtagtatgctgtttgcatcttttctacacattgtaataccactgtcgtggtttatttggcataaacctaaaaatggtatgagatgagaattggtagccaaaggagtttaaaaggtactaaaaagcaactctggaatgttgccagccacttctaatcactgctctccctggttctaacattttattttttcttaagccaatcaaccattatagtatttccagactcagaccttgtaaatcctggtaccaggaatatttcagtagcaggttgatgctcaaaaaagaatagccttaattctaagagggtcagtctttgtaatgggagtcgtcttgtctcttctttagcctattcctcctaaaaatgcaaggaagtaaggttttgtttagagatatttaatgcaaacttcacatttatatgtatgaattagctatgcatgaaatctcctccagccacttataaaatgtatgacaaattatggcaaagacatatttataaaaagtaataaaactgaaatgttttataaatgcagttaggtgtttaataaagaaaaataagagaatacatttttacatgacttcttgttagagtggtgatttgttttggataggtgtttcttaattgactttgttaactgcttaaggaagtgagcaagagaaaatattttagagtaatcctattaatgtttactaatgttagaagaaatgcatagagattaaacctctgtcttccccaccaacacacatgtgcaggtgtgtgtgtgcatacacacatacacacactgattcatatttctttttcttagatgtataccatacacacacttctacttacctacctgtctgggtgattacattctgaaatggaagaaaagcagagtccttaagtgataattctaaaatcttttttgttaccaaaaatatctgatgcctttttgttgttgttagaaatatgtttttcttccagaatccttctctccaaattatgttcccctaatcatgttccttttttttttcttttttacaaaaggatttgaggacagaaatgtttctttttgaatatttcattccttaccatgtacaatagttctttcttacattgtattatattacataccctatgggtgttgataacttttattgataccaaaaaatcattttatgtggggactatatattttctttctgttcccccacctctaaccttggtatactttaatacagaagagataataataatgaataaagttcatttgtaagaaatataaaggtttcaatgtcttaatttttttattagtttgcagttagcactgtcaaatggatatccccagattctgaggcccataaagtcccctagatgggtttatgatattgtttgacttagaaaatatgccagcctgggagacaagtaatgccccaggtgattgcgttcaaaaaagaaagcttcctgatcttttcagtatctgtgcttttctaccccaaggaacagtcataaaactttctgacatttctagtctatatcaagaggtggattttcacagtcatcatcaaatcacccgttaacattgacatcttgctgtctcgtgtgttgttttaagatttttctttttsaaactaggacttaggaaaaataataaagccagtagcttttcaaaagaatgtgcttcctcatatattatctcattttatcctcctatcataagagataagagcaggtgccattatcttcatttgaacaaaattctaagctgcagagaaattgggacttgcccaaggttctctgagcacaacctagatttccatctcccagacaaatacgtttcagtagaccaccttgcagggaagaccagtcaccaaatatatagagaagaaggaaaggaaggaaacgaggtttgatttccttatcgattctagtcaaagtgctggatgctgccacatcactgtctcatttattcttcctagaagctctaggagatagatggtggtatcttttttacaaaagagcaaaggaaggttcaggatgtagagcattgtgttgggtaatatgggggataacggaaatggtctcagacttggagccctgccctcccagtctagtccaggaattataaagacatattaaacaggatcgacccaaaggatagtgaggttagagaagaccaaaatggtcagagaaaacttcttatggtgggggagacttgtattgagtctgccaggacagcaagaagtgggcaagtgggagggagagcctaacaccccatcagcactgaaaagcaaagcagaggagaagccccgagtgagcctagagcttgttcagccagagcagatggagctcgctggggagagggtgactgtgagaacctgggctctggccacaggaggccttgaaaatgtgtggaaacaagaccacaggattttaaaactgaaattcatctggttcaaactccccattttatagaaggaaaaccatgatccacagaggtgaaatgacttgcttatggtcacaactatataatttacagggccaggaaaggcactggtactctattcctaatccagagttatttctaccctacagtgtacgtgaagctgttggtgagagggagtagtgaagtgtcagtgttgagattcctgtatcaatctcaaaaactcattattactaataaaaatagtctcttaaaaaaagacttgtaccattccatatcatgtttgctacttgcttgcccttgatagctgacaaccagcttcagttactcaaagcacttgagacatgcattggatgatggaaaagctattctcttccatttttgtgtttatcctctttcagaaccctgaaagtcagctaccattccattttcctgtaaattatactggcacacacaactgacaggatagtcaaatgcaatgaaataatcttttcagggccagaggcatcatttaatggtcaggatgtaaccccagatgcaaatgtggctcaaatgctacttaccattttattgggcatctgttttgtgccaggcattgccctatgttcttttcctgtaataaaagattacaaatttgtaaggttaccattatcctcatgccacacaggaggaaacagaggctcagataggcttgataactacccaaggtctcactaccagttagtggtatagctgcttgcagaaccctcatttgtctgacctccaactccaccatactttccctgttttaccatactgcctccataagatccatcacagcataagtagcctaacaaacggttttatttcaaaagcaataaascaatatatatttattgtagagaagtaggaaactgagagaaagaaaaaaatgaaacccacacagacataggaccagtgtattaacatcttatcttcccagacctctcctctgcagattcaccctgctctcctttctaaacctgaacccactgggcccttgaagtcccttggtttagcatacaatataggttcagctgtgccccatgattattttctacagtgttgatgacaacgaagcagctgggccttagtggacagactattgtaggcagcaagcaggagatctgggttttggttttggttttaccactgccctgctctgtgctgtgaggcaagtgacttctcccctgaggttcttcattttttcatggataaaatgagggaattggattccatcaatctctgctgttccttctgcttttgatacttttaaattctgcagttatgcttcatgttgactttgtcaggctcatgtagagggaatggacagagctctgctcttagaattgtctggtgagtttctccagcaggtaggcattgcgttctgtctygaagtgtgtcacttactgttggtcccctcatattttgggtccatgtcattctcaccacttggatctttgagcagggaaggtgagaaacttgaggcctaggcagatgtaaggtgtgtttgtggaaggaagctttgaggcttacggaactaaaggctgggagatgtggtagtttgatgaagcttcattcctgcctcatgcctcatacgcactgaaggaaaggaaaagtgtctgttaggtgccctgccatggacaacagataattgtcggtaagctataatacatagagggggacaaaatgcttcagttctatctcttgaattttataattgcataacagtagtgatgatcatttttgtcaggtacctactatatgctagttatcttgtatacattatctctaatctgcaaccactctgcaaagtgatgtgattattctgatgatttacagatgagatcagagaagtataataacttgtctatgcccacataactgctgagtaacatgtctgggattctgatgtaaggtccaggccttaatgttttctcttctgtcctgcatcataaatctctgcctctgctgaatcatttccaacagcttaaaaacaagttctggtattcatcctaaaaataataaccaccactcagttgctttctgattctctattttttgaacgagttatctacacacttcaacttatccttcagccttcttcagcttgtcttctgcttctgtcattcaactagagctgtttttatcgaggtcatctaaaacctccatattgcttaattcagtagacattgttttttcttcttctcatctttgatgcatcaatacagttgaccactccctcttgtttgttctgctggctattctcctttctttggtctcttctccacccatcttctaaattggtgtttctataaattagtcctggatcctcttttgtttctctgaactccctccctaagtgatcccagtctttaccatggtgttaaataccatctgtttgtagatgacttccaaatttgtagtttcaatccaaacgtttcctctgatttcctaactagtgtattcaactctgtacttgacatttctatttagatgttttacaggcttctcagacttaacatatcccaaatggaactcttggatcttcccccaaacttgttagtctttcctatcttcaaatggtaatattctgcctttttgctccccaattcccagtccatctgcaagcctgtcattcatatctgctaactataacttgaactatccatccctctccatctctactctccctacatgagttaagccaccatccagtctcacctggactactgcaatcacttccagattattttctctactcctacttacaccttcttccaaactgctctctgtataagtcagttgaaatatttgaagctataaaccagactgtgtttttctcttgatcaaaatcattcagtggcattctattgcctccccccaccgccaaaaaaaaaaaaaaaatctgaattctttaccatgacctgtgggactctctgtgtgatctggagcttgctttatctagcagcttaatgtgatgccactttcccctttatctcctgtgcattagcaggactcctgtccttttggttccttgatcataactagytctttccagtccccagaatctctgcctagttcttttctctgcctgaaacaacccagtgccctgtttcttgagtggctkctccatttcatcctttggtcaatattgttgccatccctgagaagctacctctgaccacattatctcagtagggcctttccttcccttccattttcctctatcttcgtttcttctttggttttgtaataccactattacaagctgtatgttttgtggtatacttgtttattacttgtctctatctagacagaaagcctgcaaaggcaggggccctgcctatattgttcagtgttgtatatccagcacttgttacagtgcccagtgtagttgtagctcaatttgcaaaatggataatgaaacttaaagtgaagctcacatgtaaaagtttgtttctcactgggagactagaatcaaactgtccatcctcatgcttcataccattcatgcactggccctgtaaacaacttcaagattaagcaaaatgctactggagaggccctgaatggctgataggcatttaaaaggaagcatgaaggtttaggtctgtggcttgaatagctattgcttttctcccttgtttttcatattcacctaggcacgggaagctacaagaagcacagctaaggctggtcttggccctggtctcctgggtttatttctggagaacttcaaatgtggtctccctagcttagtgaaaaatatggttttttgttaagacaactatctgaattcctcgcataccttagttccttaaaccgagttgaaagcttcccagggaggattttcattgtgtttagtgcagcgtggcagaatggaaaggactttgaaccagaagttggcttggatttttgtcctagtcctgataaccttggaaaacaaaatgaaagtaaaccctaaatatcagttttctcatctgtgaaacatgagaattgggtgagatggtttctcctagcttccatcatcctgaaatctctggttcctttggaaattatggatgctgaggtaaactcaaactgcagactttaaggaagcagaccctttccccaaggtcatttttatggagaaatagtgaacactcccatagactaccccagcaagtaggagagagagaatgataaattccttggagattcagaacccttttaagttaacctctttgacttcccttgccagacctttagtttattggaaattgtccaaggaaacaatcttttagagcctactggtttkgggcttttgtcgacttctacttcaccctaccaggaattaaaaaagggaatcaattgagaataagtacctcctggtaagctgtggcaccccaaaaagaatctttttcactgtaaggcaagcatcagtcacttggtcacccagaggactagcctttcctgaaaaatatgcaacaggcaagagagaaaagaaagcagacttcttcctctactcacagatattataaagctgaatcaggaagattctaagcaaaggcctagtttttaatgtgagttttagttttcacagttggcaacagcttgcgtccctctttttaattgttcctactctggactgacctttatactaaattcttttccatttattctcaaaacatcctttgggttggatggtagtgtctcattgttattccaggtgaagaaactcaggtgcttaaaggttttaagtaacttgctaaatttagtcagtgattgagttgggatttgaaccaggtaaatgagtaatgattctttctctgagcctgtagggtagctaaacacatttccagcatttttaataggartaaaaagagagtaggaaattaatgacacacaattcacaagtcaggtgcattcattctctgtctttttcctggagaatcctgggtgttttcttttcatcgagtcctatcgatacccttcctttctaggatgatacttagtattcattttaaacattctagaagtgaaatcaaaacctgagttaaaacactgaacaatcatattttgtatgatcacgtagtagtgtttcttaaaagcacaaccttatttgtaacttggaatcatccagacctgttgctttaaatattttaataaaacaggatttcccctcccccattgaggcccacttttctccccaatcactttaattatgtgagctagaatgctgtttctcacacatcttcagttctcaaccttgttaaaattaatcatataatccccctttaaaacatagtattaaatcaccatagtaacacagtatccaagctttatggataaaacataacaggcataggaaggtagcgtttggtgtccccttgacggccctataacttttatagaaatgtgtttcttctcctggctgtgtaaggtggagggatagcattacttacacctgctttatgaccacgttgcttttaaattgccaccttgtttttgttcaccttcctagttaaataaggagagtggaacactttttctttctgaattattttcttgtactctctaaccactctctaagagatggagttgtctccttaaatatgaccaggcagagtccattgacctttgtattggaataccttgaaaattcctttaattttaattatttatgtggctgtataagggagttttagaaagtctaccctatctttgaaaactttattcatatcatatccaaagactcaataagaattctacctttggaaaaagcttggtaaaccatgatttttaaatttcttctgataatttataaagtaataattgatagcatagatttgactattttaccaatttgaatacactttgtaaaatacaatatgagttgatgagttcctttgaataactcagtgttgaattctagcatattacgttaatataaattcatgtattagaatttggattttttaaccaaaaatacctttattttaatcttcagagaaaaaactcttttcttctttttctgagataattactgtaacttacaaaaatggatatacatcttcaaaggatttcccttgaatgcgaaatttagctttatgggatctaagcatttaaaggtaaaaagcaaattctattttgttgccattataagacaaaactgaatctagcataaggtagggaaacccattcactcttcaggttcttctctgacaggaactagcattgttatattatttccacttagcaaaatctgctctaatttaattatacttcttcctggccaggcggtaatcccagcactttgagaggctgaggcaagcggatcacttaaggccaggagtttgagaccagcctggccaacatggcaaaaccttctgtctactaaaaatgcaaaaattagctgggcgtgttggtgcacgcttgaaattccagctactcaggaggctgagacatgagaatcacttgaacccgggaggcagaggttgcagtgagccaatattgtgccactgtaccccagcctgggtgacagaacaagactgtgtctcaaagtaatagtaataataataacaacaatagtacttcttccttctggtgtgatttcaaactcagtgacctcttctagtccatcttgacaaagtcatcaactcctagaagagtacccacgatttcttaatgactcttcaccacaatgtgaattcttgagcctatacatttgtctacaagctctagcagcaacagctgggcaagtaggtggtagccttagccgccataactgtgacggaagcgggatgtttaaatttttaaaatggaatgaaatccaagctaactggtaaactgattttaaaaactggatttttagacattttacaactttaaaaaaagagtttggccgggcgcggtggctcacgcctgtaatcccagcactttgggaggccgaggcaggtggatcacgaggtcaggagatcaagaccatcctggctaacatggagaaaccccgtctctactaaaaatataaaaaaattagctgggcatggtggcgggcacctgtagttccaggtactcgggaggctgaggcaggagaattgtgtgaaccagggaggtggaggttgcagtgagctgagatcacaccactgcactccagcctggcaacagagcgagactacatctcaaaacagaaaaacaaaacaaagagtttctgtaatctgattagtattgtttttaaaatttttaaaaatagatattttaatgttgcgtttatgtgtggtttttaaatttttgtattgatatatttttagcttttttcctttaacgtctttctttaaaatgttgtttccatttcttagaaaacaccatgcaatgctagacattttggttatttctgtcctctaaaataggaaatatgtttctcataaattcagaaattatgaaagatataggaatttaggaaagtaacacctaagcttgccctgttttctttccagtttcaatttcagctcctcctctttgtagctgtgtgaacgtgattcagttactaaggatgtattctggtccttagtttccttttctgtaaaatgggaacatcctctaaattccatggttgtcctgagagtcagggagatggtctacgcatatatgatgtctaactttgtggctggcacatagtaacatttaccttttgctctggcaagcactcttattttctgaactagggaagttctcaggtgaggattgttagcagcaagctggtagagtggcctgtggaatcagcgcgagggttaaaatccagctttttgccactgatcagctgaccttaggcaatgcctctctagactatttcttcatcagcaaaatgaggttaatagagggcacctttcggaattgatgggctgactaacagagctgcctcagagactgaactcagtaaggagaaggtatgatagctctgattatttgatttctgaggtggtcactagaataggctgctggctgtcttttttttttttttttttttaactagcttacagtctgttcccttgaaatgtgtaaattttaagagttccactgagagaggaaatgttataagttcaacgactcattgtgattagatactttatcaagaaacttactgcacattcattttcccctttgttctgcctttgctgcagcctcacagttagccaagttggccagaacttcacrttcgtgctcactgacattgacagcaaacagagattcgggttctgccgcttatcttcaggagcgaagagctgcttctgtatcttaaggtaagggagaaggcttgggctgttggcttgttctctgaagcaatgtcagcttctgcattgctcttccrtaattaaatcttccagctgttcatttcattttcctatctgtttcccacaagtcactgcatttggggagaaggacttcacagtgttgttcttgcactgtaagttctgcagataattgtatttatttatttgtatcacatcccttgggtgggaaaggggaccatctcttctgagtagtttgtggaagccagagagtcagtgtggcttcagtgccttctgctgttatctggagctgtcagaaattagcctgttagactttctcttggacattttgtgtatgtaagattattaataaagtatgtgtctgtagctcaggacatcttgcagacacagactgtgtccgccttaaagtaacacccttgccccctttgggtcggtgaatgaagaactgtgtcccattttggctacctctgtagaggtttgaaaaaattaagaatcgtgtaagaaggcttcttcaggtcttctaaaagcccctcatacaccagagccacacttgcttaaggctctgtttcctcctgccagaggggtaaggcatgttctgaggtgggaggatgtgtggaaatccgattttggagctgctggctctgtggactcctgctgggctcctcctgagggggaagtaaaggcatcccccatgctcccctctccatctgccttggttaagtaggtgtcagaggggcctgcctcctgtctctctctgctcatgtggaacagccagggcacagcagcaggaggtgcccatgacaaaacccgggcccccaggcttgggttgggcctgggcctgggaataaaaggccagaccctctatggattccagaaagggtagctctctgcggcactagtctctgcactttcttcttctcatcaagaaaagactcccccactgacttctgttccccaaacccacacaccctcacaccacaggggaggaggggctgactttggaagttcccaagctcactaactgtcaatctggactgctatacatttgcatttctctacacaaatcttagtatcattagtgcttttaatcagtgaagtcgactctcttctgcaccaagcatagcatttgtaacctgggcacaggaggatgactgctggggaggctttaggaaggaggctgctttgggagattctgtgtgttctgttgttctcaagcacgccttagtagcccaggcccaagaattacctgcccagagcattagaatttgatgtaaatgattatttacatttggattgaacagtgcagtctttttctttttaaagaaaaatttstctttcagttttgtctgttatatttcagccctggccaggccactgcatatttatacagttgacccttgaacaatatgggtttaagggtactggtaccctcacacagttgaaaatccacatataactttgactcctcaaaaactcaactatggccgggcacggtagctcacgactgtaatcctagcactttgggacgctgaggtgggtggatcacctgtggtcaggagtttgagaccagcctgagcaacatggagaaacctgtctctaactaaaaaatacaaaaattagctgggtgtgatggcacatgcctgtaatcccagctacttgggaggctgaggcaggagaattgcttgaatccgagacrtggaggttgcagtgagccaagatcgtgccactgtactccagcttgagtgacaagagcgaaactccatctcaaaaacaaaacaacacaaaacccacaaaaacttaactactattccatagcctactgtttactggtagccttacctgtaacataaacagttgactaacacatatttgtatgttgcatgtcttatatactgtattcttacaataattaaggaagggaaaagttattaagaaaatcataaggaagagaaaatatatgtactgttcattaagtggaagtggatcatcataaaggccttcatcctcagcatcttcacaccgaggaagaagaggaggggttggtcttgctgtctcagggatagcagaggtggaagaggtggaagggaggcaggagaggaaggtataacttttactttaaaaaatccacatattggccaggcacgtgggctcactcctgtaatcctagcagtttgggaggctgaggtggaagaggaggaagggaggcaggagaggaaggtataacttttactttaaaaaaatccacatattggccaggcatgtgggctcactcctgtaatcctagcagtttgggaggctgaggtgggcagatcacctgaggtcaggagttcaagaacagcctggcccacatggcaaaaccccatctctactgaaaaaaaaaaaaagaaagaaagaaaatacaaaaattagccggagtggtggcaggtgcctgtaatcccaactacttgggtggctgaggcatgagaatcgcttgaacccaggaggtggaggttgcagtgagctgagatcatgccacttcactccagtctgggcgacagagcaagactctgtctcaaaaaaaaaaaaaaaaaaatctgtgtataactggacctcagcagctcaagcctgtgttgtccaaggtgaactatgtattcatttggaggtggtgaggcttaaactgagttcttagagttttgcaaaaaggtttttctctataatatgtttgggttacagtgtttctttctaagctgtgtgtgtgtatgtatatgtatattctaaactggcactatcactcagcaaattttgataaaagtattcatttaaaaatttacatttgaatttgcttgtctctgattctgatgtgtgactttgtgtgcctatacaagtagggtcctggatttcatatttgtgagaagccagttgaatagtcttcgtgctttcatcctttagaatgaaaaatggcagcaattgatgtgttttttaaatctgttatagtaggttagaactatggagaaaaattcggtgggttaattcattcatttgtgtgtcagttcttaattgaattcctactattagctagtcactgtccttgagtagttcccagactagctggggagatggatgatcacaatacagtatgctgtatctaatacacagaatgatcccaaggcatagtgtcgtcttgctgttgcttttctagtgccagaggatagtgactgtggctaaaaataaaagagtcctagatgaattgtggaacatgaattttatgagtatttaatatgagggtagagaagctatcttttccagcttgtgtggaaataaagggcacacccactgacactttccctctgttgggtttgggaacattgctaggctgagactagcatgtaaatggaagggtttactgttaaagctggatgactggttgacggtgtatccactggggagtggagaggtctgccaagagaatgagagctcagtttgggtctaggttacattgttgtattgtcctcttctgctgctcagtctccttgcttcctttagatactttctctttagttaacctgtgccttgaggtccaatcacccttcacagtgtgcccagggctgtggctcaagtctgctcataaactacctctacttttgctttccatttcttctcaagggatgtagctctcagttatggcatctgtgcagacgtagcccctgtggttccaggatttagcttcacttcctccttgtctgacattccaaacttctatgctttctggtccatgtgaaccactcaacagtctctgctttcacatgtttacccatcctcccagactcagcctaggcacctctgcagagtagccttccccatgtagaggtaatcattccctctctggcacacccagcgtgctttgcattctttagttacacactcataaccttggtcctcctttgttttcctcctattggaaggtcaactcttcaggggtaaaggctggatcttaattaactatgcatgcatctccagcagttagtgtagtgcttatccaagatattgtgtgcattgggatcagagacagggaaatgcatcaagaatgggagggcagggcaccaaagactttgaatgagaggacaggtgtcatgggacgtaaattcagagaggaaataagaaatagttgttggaagaagtgtagttcacattaccaaactcatttcatgctagttgtaagagatgcaccttttaatctcacaatggaggttcaatattgagtgatagacattttgtccatgaagggttaagccatctgtattttaaaatttaaacttaatttcacaatgaaaggtttttagacaccctttgtgcaacataacctacttattaggttcctttttattttctgttcctccccactagggcatgagctccatgaaggctgggaatttttatgtttttttctcctcccacaaatacatccaaagtttattgaagaatattctggcacatagctgacattcccagctagtctgggaactcttcaaggacaaggacttagctagtacttgttttatgaaggaatgaatggggaaataagcccatgtttattaaaaaacattagaaactttggtatgaactcttattaccagctaaccttggcagaaacctagtcgtaccaaacaagtcctattaacacaaatgccactataaatcaaatgcrttatttcctcccatggttgactagttcctgccactgaagaattttactcctccttgagatttgccacattatttaatgagttcctggatgggagttgatactaaattaaaaacaccagmtaggagaacagtagttacggattagttagtctccatcataaacacagggatgtgagagcattttagcattttcatattgtaccatctgagtctgatgcaatatatgcatttacctctgaaatctttaaatattataaaacaaagtgacctagaattgaaatttgttatggcacttgatatttgatttgccccaatggcacatactccatcaaggccaaaactgtaatgaaagatgcgatttctagccaacttctagttctggatcaacagaaggaacacaggagttcaaaggtttaaatttgtgtttgagggttatggggagatatgtcatacaataattaaataccttttgtcttttataaaggaactacacaaatatttgccctacagttttctcctgcttccattgggatcttattgaagctcttaagaaagattgagtaactgtccttacacccaaataaaactaattttattatacattttggaaagaaaaaacttttttcctcaagatgctgtctaaatttttttagtttaactttttaaatttttattcaattaaaaagtatctgagtacctagtatatacccagaatgggcaatacataacacttggtctctggccttcacttgtttcaaggtcccttaacatgaacacagagatctagccccagatctccatttgaaaactcttcagatatcacactcatccaagattttgatgagctgaactttctgaacttggtagtacaaaatgaaaaaaaaaagtatttcttgtcatttaccaaatataaaatctaatgtgcttctaggtgcactgttcatggaccacctctgattttgatatccatctcccactgcacttctgctaccctcactcttttaggaactgctcaatctttggggtgggaaaatgtaaacaagtaatgaaaacataatgcgatcagtgttgttttaagaaaacatatttatgtgtaaggttcttcaaagtcacagattagacagtgcccatctctaacttgagaataagggaaagtgttgctgatgagttccagttaaactgagtcttgcagaatgagtgggggcttggctggaggaaaatgggagaacagctctctaggcagtgagaactgatacacaaagtccccaagaaatgaaaggtatagcaagatgaaaggatgctgagaatgcagtgagggagcaatagcaagagatgataccatcgaagtctggggtccaattgtgagtgcttctggggcgtgctcaagattttagatttatccggtagcaaatggaatactgtcagctggtttcgggtagacattagagatgatgatgtttttagaccaaggcaaaagtgattttttgaatgtgaaatgtgcttgggtttttctggttattgtttgaagggatgttgcgtgtcactttggaggtagcacccagatttagactggatttttcaaacctcaactgcagggggtttttttgttttcttttaaaaacaaggatagtgattatcccttcttccatgctagttggcatatggacttgattctaaacctgagtggtgttcagtgacaaccttcttccttctggagcactttctgatctcaagactggaatgaccattgcatccattctcagctgtgttacattcattttcactcgaaacacagaaaagctccatttccacggagcaaaaaagaagctagaagtaataaaggagtctggctttaagaactttggctttccttgctgactgttccagtgtttttaaacaacacatacagttcaggaataaaatcaaaggactctgtttcctcaggcaggtgcggtggcagaagcccttttgggttgtgtgttagctgctttagtttaaaataagtgtttgggaggtgggggagggagtcggggaggaaggctgtggggacagctcccagatttttaccttgaaagcaggtgctgctgaaatattccagaaacagatggaatctcctattcttgttttaagctgtttatggttgtctcgcccgagggtaccctgctatacaaaaatgcacagcctgatgtttgagggcagttgggcatcaaagccggggcccctctgggagaaatcagcctttcttcccagtgccttaaatgccattctggaaacctgggtctttcataccgtttaacagaggactttcctttgccttttgagtgtttctgtctctctggaactgtttgatttctttttaattcttctccttaaaagtaagctggatactgtgttgttcttgttattctctggatggtcagttggcagaaggccccactgctaaggcagattgataatttcaccgactgtgggtctcagaacatggcatctgtcagaagctgaacatagaggatgggccagggagtctgctctttcctaggcccagggcccttctgagttcctcagtattttgaaaggcttgtgtgggtgcagggcatggggtgctcttcagaacatcagtttgtgggagtttataactagtttttctgaattaaaaaatgaagtggttggggaatgttgcatgttttattgccatacagatgccttcatacttagaaacatatataatcctctggggagccacaactcaacaatagtaacaagctgtacagtttaaagaaaatcacctttgaagagaagaaagagaaatagccgaaactgcccttgcactcccagtggcctgctgttggaggttgatttgagggctgggaagctgcgcagttggaaggacaggtgtgtcttctgcagtggccatgggggctggaacaagcagccagcctcaggctgtccactgcaggaggaagctccctttctcctcctgattcttttcagaggacaccagcctggcacagccttccctcaagcaacctgaccctagggttgtagggtatttgtaactctaagactttggctaaaagggattttttatttttgagacggagtgaattctaaaccttacaagagatgtgatactttctctgttttggaaacagaacacttccttgtcattaatcctcatgaagcttagtacagggcaggaagtgaaaccacctcaagaactccaggagtgtagttctgccttgttttttgctctctacccacccccgcattcttcaatcatcttgctacctctagtgactgctgctgatggctcatgttacttcatcattttgaacatggatagactaactctggataactcactacagaggatttggagtggaaggcaggaattaacatttatcagcatttatttaatatgccagctggtttatgtaattttcatttatttttatagcaatcttatgaaattatctccattgtagagataaagggattgagactgagagagatacagtgacttgcccaagatctcaaggagaaagttaaggaatctggtttggaagctaaaatccaacccaaaatttatactctcaactgcaaattctgtcttcctgccaccaaagcaacttttactgctttcaaaaggttatttgtcctctctttctatatgtatatacttagtttaaaaagacataatgggtagtttgcccttgcagaatgaactcagaggtgagcttaaagagctttcagaaataatgttctacagctcaccctcatcttataaatgatgaaaatgaaacatgaatgagacaggaagatttttgttccaagctctttggctggtgaatgacagtcttctgacctccaacccagggttttgcccgtgatatggcaatgattcttccaactcaggagaatgagcccaaggccagctggaactaatgttttttcaagactcagtagcccctggttagtgtcaaggagtcacattcccttttggttagcatcattatgagcaatgtgaataatccaactatgtgattatagagtgaacaagatgatcagttctgtttaaatccgatgcaaggtatgtttgaatggaaaaccagtgaaatagagcctgtcttttgaaaggatctcagaattcgacatgagggaccctttttgggagatgaaaaagcattctacaggagaggctcctcggtgctttttgattgagtttgagtgtcaacaatttttcttggacctccctgcaagccagccactttccttcaacagcaataagcagaaggcatttatctgagcctgatctttgcttttcactgggtgggaggtagaaaagaaaatggctcaaaatacacctcactcctaaaattgccctttgcttctaagctacactcttaagagcaagatggatttgtgaatacaggagtctgaatttaagttgtctggccctttcagggatcagttttagaagcagtaggaagcctaacattctctccatcatggagaggccccataagactgcaataataggtacttctttacagaaaaatcgtagtaccatgattgaagtttgaagaagtttgaagactctacaattctagcaatcaattatgagccacttatttttrggatgttattttttaagattataaagatacactttctcattagagaaatttagaaaactgcagaaaagaaaagaaatctctcatcccaccatgctgataatgactaagggtgtttccttccctgaattgggatggtgctgtaggtataactttgtatctagctttttcacttattaaattgtaaccatctttacatgtcattaaatattctttcctgagagtgtttttaactacataatttatttgtgtgagattgatttataatacaaggaaagaagctcttagtaatgtgaaagaatatttcttgctaaggcttatcttctttttaaaaatgcatttgctataatgttgtcattcagctaactacttggtatttttttaaaagaaacactcaacttttttttttatcttaacatgtgagctattacctgattcttgacaatgaagaatagttactagcttctgaaacaatgaacagaagagtatggaaatagtatcaaaagtcttggttaaaatcaagtggcaaataatgtgttgagtttacgtttccgtattttattttgtatatttacatcttcagagtaagtaattttattagcatgagttgtaaaatgcaaattgtaacattaagggaactcttttgaagttagatagcartataattttgaaattagaatatattgcattctaagtgaaagcaaattacatgtatcttaaaactttacgtaaacttatggaatttttaaacattgtggagaaaattaaattctatatattgtagtatgcagtggaaattaagtaggtttttattttctactcatggacttgaatctaccagtgatcttaygcaaaaccaagggcaattgttgtgctttagctcaatccacaagtcttaaactaccacatagagattttaaatcccttatctataatacaaagcaatatttattacagaattaattctgagaggcatcatttatggtttctaatccattctatttcagatgcctttgaagtaaagtggtggagttttgcatgtgaggttaattgtcctattgttcatttatgcagtctggtattttaactacctctttatgtgaattaatggacccaaaatacagcaaaaatgcttgacttgaaaaattttacattttttaaaaaccgatttaagagtgtggtgggagaagaagttgggtgaaattcagtgtcctgcagtttgttgtctaagctccttgggatgactgactgattttttttttattttaagtttttaattttaaaattctggtcccatcagaaaacaagtttttaagtggttaaaaaacaaaaaaacactgcaaacaaaaacaaccccaagccaaaacagactctaaagaatgtatgtttgctagtatactgttttctgctgagctaggatttttactgtcacttttgtaaattttgtaattttggataccaactttggagaaaatttaatttgtgctttttcttttttattagtatatgaaaaatatagccaatattgattatccttattgagtaaagataactgttgtcccgtgaccactgaaaacaaaacttttataaatatcttttcattgtactctttgttaacattctccagagattgcaattctaggtctttttgtttgaagggacagtttaactttcaaggactcccatgaacttgtgcgttcctcagatttagtgtactcaagtatccctaatctgaacatccaaaattcaaaatgctctaaaagctttttgagcaccaacatgatgctcaaatgaaatgtccatcggagcattttggatttccaaattagcggtgctcaactggtatatattctgcaaatattccaaaatccaaacaaatctaaaatctgaaacatttctggtcccatatgttttggataagggatattcaaactgtttttgtgttgtaatgaaacaaacattggtgctatactttgattttttttcaatctttttaaaacatggatttataataaaaatatttttacttggctgtcatttggtttttgtctcagttatttcagtggcaaattgtggacaatactaatgcagaatattgttctaaagattaaataaaacagtaaatacttgataaagtccctgtatgctatatctattgtgtaaatgtttgatcacaaccctgtgtttttcccttttgtaaattgtgaaatataacctgcaaacagaaaagggcgtcaaatgtacatatacacattatacacacataagtaaacataaatatacagcaaatacccatgtaatcaccattgaagttcagaaattactagcaccctgatattaattttttcacctatgtatacatccctaaatagtatagtatagctttgtttggttttgaactctgtgagttgcattatgcaatttagaattgttattttcagtcttacttcttttgcttaaccttgagattcacccatgctgttgcttatggttatagtctgtcttctttgctatctagtgttctgtgttgtatgatgatataccacagctggtttatgtaattttcatttatttttatagcaatcttatgaaattatctccattgtagagataaaggggttgagttgtttatgcatgtaactgtaggtggccatttggactgtttctagcgtgtgacttttatgaacattcttgaagagctatactggtgcacatagacttaacttctgtgtactgtatgtacctaaggagttgaatagttgtgtcataggacatgtatatcgttgacttcattgggataaatgccaaattgggcaattttattctattaagctcaatcaactttattgagataatgccaaattgtttccttcagtggtttcaccattttctgcttctgcaagctgtgcatgagcattccatgcaccacactgctgccactagctccttgctttttaaagaagactcgccagcatacacttcacttttctcaaagcccatgagatctaggtattattgcccttatttacttctccaaacattaatctggtctcatcgtttgcagaggtgttgctagagaaagaggcagtccctggagttgtgagagaaagttgatcattatctgaaaggtaaaatgagttacacggtggcatggcataagagtgtggtctagtgtcagagtagggcctgcattccagtcctcctgatttggaaatgagcttctgattactccatttactctgtctgagccttaatttcctcatatctatttttttggtgaggattagagataatataagtaggccaggcacggtggctcacgcctgtaatccctgcactttgggaggccgaggcgggtcgatcacctgaggtcgggaattcgagaccagcctggccaacatggtgaaaccctgtctctcctaaaaatacaaaaattagctgggcatggtggtgtgcgcctgtaatcccagctactcgggagactgaggcagaagaattgcttgaacctgggaggcggaggttgcagtgagctgagattgcaccattgcactccagcctgggcaataggagcaagactctgtgtcaaaaaaaaaaaaaaaaaaaaaagagctaatataagtaaagaatattggtaaggtggtcgtggacatctcaccacatcacatagtatagtagatattgaaaggtagaccaattgtcataggtgagatgtatgtgggcatacatgtgacaaagtgtacatgagcctaggttatgctagcttgcagatgacacttggtaatgaggtaggcacttacacactgttgatcaggttgtaaaatggtccaacattcttggaaaacaattggcaatatatattcaaaacctttaacattttttccactttggggaatctgttttatgaaaaactcagaaatataagtacggatatatggacaaggacatttagcatatagagtgaaaagttagaaacaattttaaggcctagaaatagaggatagttaaatttaattagataccatgtagccattaaaattggttttggtgattatttgatgacatggaaaatatccagtacttatagaagaaaagcaagagacaaatttttatatgtgatgtgatctccattttgtaaaaagtatgtagaaaaaaatgacgtgggggatcggatcccaaagtattaatgagaatagttaagtaatgttatcatgggtgtttttaattctctttaatgaagtagttatcctggctgttctatcaagcccaatccaaatattcactgcacaataatttacatattttttagtttggaaaaattataaccaccttcatatatctatctcatgatttcaaatatagaatgccacaaacggcagtactttagctaccaaaatagtaactgatactctaatgtgtgtttccccactaagtttgtgaaacggacttacgctctgaaatcagaactgtgttcaaattttgattctaccccttactagatctaaggccaaaacatgtcatgtcacctttctgagcctgtttccttaactgtaaaacagaaagtacatctcatggtagccttaaagattacgaggtatatatatttttaatttaaatttaaatttttttattttttattttttttttgagatgcagtttcacttttgttgcccaggttgaagtgcaattgcgtggtctcagctcactgcaacctctgccttccaggktcaagtgattctcctgcctcagcctcccaagtagctgagcttacaggcacccacgaccatgctcagctaagttttgtagttttagtagagacagggtttcaccatattggtcaggctggtctcaaacccctgacctcaggtgatgcacccaccccagcctcccaaagtgctgggattacaggagtgagccaccgcgcccggcctatgtttttatttttattatttatttatttatttatttatttatcttttgggactgagtcttactccatcgctcaggctggagtgcagtggcacgatctcggctcactgcagcctctgcctcctgagttcaagtgattctcccacctcagcctcccaagtagctgggattacaggtgcacgacaccatatccagctaatttatttttagtagagacagggttttgtcatgttggccaggctgaccttgaactcctgacctcaagtgatctgcctgtctcaacctcccaaagtgctgggattacaggtgtgagccaccatgcctcgctcaggagagatttttttttaatggacataccacgcacagtgcatagcacatctttggtactcagtccaaggcagttattcccatgttgtctgccaagacttaaaaataccattagttatacactgcaccattgatgtaaaaatattttttcagggggagaaatgactgtgttaaatttttagtttgttcccaaaatgcattttgatttcagagatgttaaaggagttcctcttaattgagaaatgttagtattaatttccaagtgggatatttagcatctgtcctatgcattatcaccattctctactcacctagttgacctgttaattttctcagaaatttttatcttatttctgtaaaatgactaggaacctattcccaatgtgtgtctcaaacctgctttttatggcctcaggatctctgtcataacctgttttatgctttcacaaactgagcccctggggagctgtctgcacttttcagtgtgatccagctgaattccttcccttccccactcaagccctttgatttgccaggtttttgttcgtctaccctaaggatgaactgagattgctgagcatggcctctcttgtggtgcaaagtgagaattgtttttaattgagcagaaacatgtggaaggatcaggaatatctcaagggattacagaaaaattccaaatttgtactacttacagcttgtgtttagaacagggtctgctgggaataaatgttagttagtgtggcctgtgaccttaaaaactgttgacatggacttcagccagaaactagccacagacctcctttgttaaactcattcatagctccttgaaaactctagtcagtgaaagttgccagctccaatctaagcatagccttttttttttttttcccatgctttggaaacagaggacgccccttaaccagcaggccttctttaataggactacatggcctaaacgcaattggaattgacaacttcctggcttgggtttgccaactggcagagctgtgaggccgaggggacaaacagcgttggggcgctatgcacttgtgtttatgtatgtgcagaggagactgaactctagagcatggtgatacccttcgctctgagagcaacgctctggcctgaattggacacgtctttcaaatgttctgctggaatagacacatcagaattatccctcagtactttctttttaaaggaaagaaaagagaaaataactgccctttcttttttgataggaatgatcatggcctttcccctctctgctcagaatccttgatttaatcctctttttgtcagcgttgtgctatgttgctcaaatataaaatgagaacttgaaactcggattggggaattatcatttgttgaatgacactcagcacccactcactctggagctttatttaacaaagtttagtttcatatcaaggtgaagggataaccaggatatctgtctattttactcattgaggagactgagcaatgaggaagttaagcaatttcttctcctttcctatcaaaagaaccctaaggaagggccttaaacaattatgatgctgcctctgtaaaccagcatagtaactgagttagaaattaatattttccttagttcttgtctttaatccaaaagactacattgtctgaaatacctgaaattttgaaaaatggataaatggatcaggctaaaaagaggaagtagttattctgcttacagagtttcctttgacattgttgacattgatggtgggtagggaagctagcttagttatggattgtcattctgagatatccgatcatatccgttcatatctctttccactttaatcacttgtaaaattttggttgttggagtagaatatttatttccaggtatgccgttgaaattgtttttaacataaatactctagcagacttatcacttttaaaagttgctgaggtttggcatgatttcagccaggcatgtgtgaggagaaaaaaggaatgtcacattggcctaggaatatggaaactttgaaagaagaaattatataatttccttgagagggtacaagaatttagatgccattgagagaacccttgagagtagctgacccctagtagattctacataagtacttattgaatgaataaaagttgctgaaataactatttcctagtcctggtacttgcctgtccatactctctctctctctctctctctctctctctctctctctctctctcactttcccttcctcagcatctttctttaccytagaacatttatttcttccgcagaaagtaggtgatgccatcatgtttaattacctaacattctaaagcacagcttgtagattgagacctagattcaaattctgacttacgagccatgtgacaaatcatataacctgtctcatctgatccttgtttcccacatctgtaaaagaaagataatgaggcctactttgtaaagttgttaacatatgtgtaaatatgttatataagatacctaatttaggagttagcaacagagaattttttttttctaagaaggaatttcatatgtttttccacatatgctttttctcctgctctctatcaaagggaataataagaaaaggtctcaaagactttgctacctctacagatctccttgctcattcagggaaagtagttactgggtagaccagctaagagtaattgaaagtgtcccagactctaaatgggagatttataatagcctatgggagttgtttaatgcttatcttctgtacctgtgctctatactgagagtagattagatagttagaaaatatatttagacaggttattaagaaaaccagatttctatttttgctgcttttttgacaaaaagataatctcagaacattaagcagcatagagaattgtggagaattatctgaacttaagttctgttttgcacaggattttttttttatttccaacttttacgtagaggggcatatgcacaggacatgcagggttgttacataggtaaacatgttgcgcaagattgcactgtaagtgctccccttcttaaacacacttaaaggtggttttgtaagaattaattctaaaactctccccaatgtaagctgatacatccatgtggtcttataacctctgtgtacattatgtgactctaacccttggtgttttgtgtgaatagcaaattatatgaagcctttttttttttttttctcctatgtaccagggaattaagaacacactctggaaaaggatgaagaactctggtgtgtagaagagggaagaacttttttgtcagattttattttactggaatatattcccttaagatttcataagatgagagtatgtcatctttttttctaaagattttccccctaatgctacctcattttctaaactttcattaatagttctttgcagctgaagcaaatattttagatctttcttgtactctcctccagctgggagtgtctttcacacatcaaaggcagatatgagcctctcattaaaagatagtatgagttcatcatcttagaagagtaggacctgaaaacctgagataactttcagctgcaagtcatatctaagctggactgagatttttctgttggttaccgcatttcttttctcaattcatcactcccaggtgctctaaaatctgactttctctcttagttttgtttataactgaaagttatctttattcagaatacaaagttagttgtagaggttaggaaagataaatattttaacacttatttttaataagaaaatcaggactctggaaacttaggaagaaagcccggggtctgcttgttattttccctctctgtctttctgcacactttttgtgcgaggccttattaataccctctcactgcactgcctgctccagtgtctataaggtaattatttgaaactcataagtcagccctgaaaactccacaaatcctcctcttcctaacttttgctaatgaaaagcaaccctgaaatcagagtggttgaacagatttcttgagagtatggagaacaatgattatgtccttcagattttatttttgaaaaaaaattctagatccctatgaaggctggaatgtgacattctatctaaaagccacacgaaaggtttttagctccttttttgtgtatatgtacatatgcatgcttgtgaacaagttattgcaaaatgttgcaggttccatcgtttgagtaatagccacatcaaatcccaattcttttccatagtatttacttttcttactttgctcaatttcaagctctgtgttagtattttctagccaaaggtgaaagttgtccccagataaatattaggatggcctgccagccaaatcccaggcaacccagtgaattactctctttgatagtagacaggtccagttcaagttgctctgaatggcatttaactataaaacaatagccttaacaaaagttgctggtatccttgaaatggtttcataccagtagccaattctttcagcactttaggatatgaggcttgttccatcagagtgccagcttttggagctttacatagccaatgaatggtgaaagagggaagagaaaagtatgtagatgtattgaaaatgcataaaataaaaaatgaaaagcaaacaaacaaaaacatcactacacacacacacacacacacacacacacacacacacacagaagctgttgacacggcagtttttcattctttatggctctagggacaagtttaaattgggaaaaatttttttattctcttgtgctgtgttgaacaggaaggcaatgtttgatgtaatctggcccagatgtcagcagtgtgcagccttgtgatgattatttatcttcaggtttttattttgtaaaaggagaatccacaaacaattgtttagagtcataagctgtatttaatgactgtttttgacattttgtgtatgcaacgaacaaacatattagtttaaatatgttttacatttaatttcattttagctattatcttaaaatcctctttaacaaatactggttatgagtcccttgatagatgttaacatgttcagtgctttacattcaggatagcgtttctcttatttcaatttcttactcttctaggaagttttctcagctaagactgtcaaactagtgggctcttttaaatggtgtttgaaagaattttctcatataaatttcccagaaggatatcagtattttggggttagaaaatggcttagaatgtaagtggcaaaacttcaataacagctcccaaatggcagtccatttactcacatttgaggggattaattatcttggaattcaggtgtctttgttttaacagtattgttttcaaaatattttgaaagatgagcattgcttatgatttatacctgtctcttgtctaccccctttgaagtgctgctgatggctgctaagacccctggaaagagtggattttgaaatttcattttggggatgggaggagcggggagtacttttgccacataatactcttttaaagatcgaggaatgtgtacaaaaatcttagcttctgctacgttttttccaaacacaactaagctttctcagtaaatttaatttggactactcagttgtatagtgggttgccctttaaaaactgagttcaggctgggtgtggtggctcacatctgtaatcctagtgctttgggaggtcaaggcaggaggattacctgaacccaggagttcgagaacagcctgagcaacataatgagaccccatgtttacaaaaaattagccaggcatggtagtgcacacctgtagttccagctacttgggaggctgaggaaggaagattgcttgagccccaggagttcaaggatgcagtgagctatgattgcaccactgcactccagtgtgggcgacagagtgagaccctgtctcttaaacaagtacaacaacaacaaccaaaactgagttgaattaaaggttaaattaaacattttaaatatattccatatgagatgccaatattaattctaacctagcacaataataattttaacccaggcaggattaactcctattctccattagctcacctcattgacttcaatggaatttttgtcttaaaaaataccgaataaattatattgacattttataacttctagatcagtaacctcacagcattggtagttagtccattaaggtaatcttcattggcatcagtgtaggatagcagaaagatgagtagttttaggacctggattcaagtcctgtatgtactgccaataggcccagtgacattgggcaagacgtctgacctgtatctacctcatctgaaaaatgagggttgtcagtgtcccttaagactgagatattctgtgattcaaaaaaattcaaatcaaaataatgttattaaattccaatgagctcattagggctttattgccataattcatttttttgacaattgttttcttattcccatgaatgtgtttgagatgcatgatcagagggattacagaagttttagtgcagtcttgctaatgcatggcagtatttctaaaaaaaatgtaattgtatcttattatcagcattgtcatcacttttagataggacattaaatatgaggcctcatttattccttaaaatataggaacagtgactctatgctgttctcttaccttccctaacagctctcctgaggaagctaagacacagggcaagggactttttccttgtgacatcatagcatgacctggcctggaattctgatgtagtaaggaaagaaccactaagttggcagagagaccctcaatctagactccgcccggagcctgttggactctgactttgggtatgattctgggcttctctccttccagaaaatggaaatgataacattagcccttctgagcttacaacatagctcttacaggtcatgtgttctcatacactgacttgaagaccttcttttgtttatttgtacctttagccttgataaagacaaaactgctattggtgtgtatagttactataaggatttttagttctcattagaactacttatccagctatgagtacattggtagagaaggtgcagtctaactagctagcttcagtgatttttcttttttctttttttggagacagggccttactctgtcacccaggatggagtgcagtggcagtggcacaatctcggctcactgcaacctctgcctcccaggttcaagcaattctcccaccacagcctcccgagtagctgggactacaggtgtacaccatcatgcccggctaatttttgtatttttggaagagacagggtttcaccatgttggccaggctggtctygaactcctgacytcaagtgatccacccatcttggcctcccaaagtgctgggattataggtgtgagccaccacgcccagccaagcttcagtatttttttctaaaaggtgactgttgttttgggaattcagaattcttgattaacaataaaaacttttaaaaaaggaaacatctcaccacttactgttttgttactcatgagaggacaatttctagaatatcaggcaaatactgagtgtggtatgtgtcacggacgacctgaggaaatcatgatgctggcttttttgactaggacttcagagatcatgggagcatcgggaagtctctgcaagtgagtgcagagagtgtgagctgtggagtcagaggggtttgcatttgcttaccagctcttgcccacttatgatcttcttacctaacatcttgcaacttatttttgtcatctttgacattcagagataaggactcacctcaaagggttgcgagagagagagagtgtacaaattattcagcagagtgtctgatatatagtggggactccatgaactcgttccttcctggatgagctggtttagaacatctagaaatggtcatagtggaaataggggtattttaatttttatcacctggttaatattgggaagttcactgagcctttagatagatgtgccctttgatatcttccttgattttcttggggggagaaaagcttagaatataaactcagaaggttcaaatcccatctcctcttttcccagcaacatctccatgagcatctccaacttttctggcttctccttctccatctacgtaatgagrgcaatcataagtccttggaggattgtagcgaggatcaaatcataacgtatgatgctgcctggtagtagtaactggttcctacacaagttttacctagtgacaacttgaaagctaacacggctttttttaaaaaataaaaaaaattattttcccaagccctctcttgggatgtgctcatgtgagaggatgaggcagaaacttgctgtaatacacacccatcatatgtctagaaccaagtgccctgaacattcacgtgcattctctcctccactcttcacagcagtcccgcrraggaagaattatcctcgtcttacagaagaggaaaaggaaccttagagaatcattattagctgatattgwcagtatttgaacctagctctgtttgactctgaagtccatgttcctcccattcttttgtcttgcccccatcccaaacttggtgccttatttgacttaggctaaggaaacgtgtattgttatttggtgtctgtaggtgtcctatactccactgcagacactgaggatgcagtgatccccgagacatgcactttccccactttcacatggcccaggatctgaaggcagacatataattaaacaattagttgcaatattgaactctgataaagaaagttaaattattatgtaaatgagtagtcatctgtgtattttaaacaggcaatttcctctgaataggtgacttctgttggtttcagggtatcacataatcttaaagtagttctccttttggggtgaatgtaacatcctgtatttccataacttaycttgctaaaatatgaataaaaacttaataatgactctgcctctacataaaaaaataaaaatgttacctgggcttggtggcagacatctgtagtctcagctacttgggagactgaggtgggaggatcacttgagtccaggagttcgaggctacagtgaactatgaactatgtgcctctctgtactctagcctgggcagcagagtgagactgtcttgaaaagaagcaaacaagaggcctggcacggtggctcatgcctgtaataccagcactttgggaagctgaggcaggtggattacgaggtcaggacttcgagaccagcctggccaacatggtgaaaccctgtctctgctaaaaagtacaaaaaattagctggtcatggtggcatgtgcctgtagtctcagctgcttgggaggctgaggcaggagaattgcttgaaaccaggagatggaggttgcagtgagccaagactgtgccattgcactccagcctgggcaacagagcaagactctgtctcaaaaaaaaaaaaataaccaacaagaatatgattctataaaaagtaacattcaggaataaaaaaaggaagttcttaaaaattaagaaagtgaaagcaaggctggatgtgatggctcctgcctgtaatctcagtgctttggaaggccaaggtgggaggatcgcttgaggccaggagtttgagaccagcctggccaacatagtgagaccctgtttctactaaaaataaaaaatataaaaattagctgggtgtggtggcacatacctgtagtcccaattacttaggaggctgagatgggaggatcacttgagcccaggagtttgaggctacagaaacctatgatcacaccactgcactccagcctgggcaacagagtcagatcctgtctttaaaaaacaaacaaactggccgggtgcggtggctcacacctgtaatcccagcactttgggaggctgaggcgggcaggtcacctgaggttgggagtttgagacccgcctgacctacatggagaaaccccgtctctactaaaaatacaaaattagccgagtgtggtggcgtgtgcctataatcccagctacttgggaggctgagtcaggagaattgcttgaacccaggaggcagaggttgcggtgagccgagatcgcgccattgcactccagcctgggcaacaagagcaaaactcccatctcaaaacaacaacaataaacttagtagccactcatttattgaatgcttactatttgcttagtgctgtccatgcgctctctcatttaatcctcattaaaaactctttgagaaagcactatggcccccattatacagatgaagaaacctaggtttggacagattaagtaacttgccaaaagtgatacagcaaaaccttggcaggattctcattccagagcctctattcctaactaaattcaatcagataagtgtattacaagagttgcaatgtattcatttttcaaaattaatagatttggtgagacttttctatttttatttttaatttgtgtacagtaaaatttcctcattttgtataatttactgagttttgacaaatatgtagtcatatatctgccaccataaccaccatacgagcacttctgtcctctcccactccagttctcttgtgttgcccctgtgtggtcaaacccttctcctactcttaacccctcttctccgtctctatagttttaccttttccacagtgtcacaaaaatgtaatcatatggtattaccttttggagactgtcttctttcacatagtaaaatgcatttgagatccatccatgttggtgtgtgtatctgtgatttattcccttttattattgagtaggtattccactgtagaatgtgttcatagtttgtttattcgctattgaaggacatttaggttgtttgggggttttatgattatgaataaaactgttacaaacatttgcacacagattttggtgtgaacacaagtttttgtttcttttggacgaatacctaagagtggaattgctgggtgtatgttgccaagcgtatgttcaactttgtaagaaactgcctgctttccaaagtggttgttgtatcattttgcattcccacaagcaaggtgtcagagttccagttgtcccacgtactcacaagcattttagctattctatgtgtgtagtaggagctattgtgattttttaatttgcgttttcctaataatcagtgattggggcatatcgtgcttatttgtcatttgtatatcttctttggtaaagtattcaaatcttttgcccatttaaaaaaattgatttgtttccttattgttgagtttcaagtgttctttaagtttcttgacataaatcttttttcagatatatgatttgcaaatcacatattgtcccagcctgtgatttctctttttattctcttaacagtgattttctacagaacaaatgattttaattttgataaaatcataacacatcaatcttaccttttatggatcatgtttttggtgtcatatctaggaactctttgcctatcccaaggtcacaaagattttctcctatcttttcttctcaaagttttatagttttatgttttacctgtaggtctgtgatccatttagagttaattatttttaaggtataaagtataggttgaatttttttgtagattgtttttgttttgcatatgagcatctagttgttccagcaccatttgttgaaaagaccatcttttctcgattgagtcatccttgtgccttcgcaaaaattaatggactacgcagtgtttgtgtggatctgtttctggactctattctgttccattgttctgcgtatccatcagtattatactgtcttgattgtggcttcacagtaagtcttgaaatcagatagcattaatcttccagctgtgtttttcattaaaaatttttttttaaattatactttaagttctgggatacatgtgcagaacgtgcaggtttgttacataggtatacacgtgccatggtggtttgctgcacccatcaacccgtcatctacattaggtatttctcctaatgctattcctcccctagctccccacccccacaacagaccccggtgtgtgatgttcccctccgtgtccatgtgttctcactgttcaacccccacttatgagtgaaaacatgcagtgtttggttttctgtttgtgtgttagtttgccgagaatgatggtttccagcttcatccatgtcgctgcaaagaacatgaactcatcttttttttatggctgcatagtattccatggtgtttatgtgccacattttctttatccagtctatcattcatgggcatttgggttggttccaagtctttgctgttgtgagcagtgccgcaataaatatatgtgtgcatgtgtctttatagtagaatgatttataatcctttgggtatataaccagtaatgggattgctgggtcaaatggtatttctggttctagatccttgaggaatcgccacactgtcttccacaatggttgaactcatttacactcccaccaacagagtaaaagcgttcctacttctacacatcctctcctgcatctgttgtttcctgactttttaatgattgccattctaactggggtgagatggtatctcattgtcsttttgatttgcatttctctgatggccagtgatgttgagctttttttcatatgtttgttggctgtataaatgtcttcttttgaaaagtgtctgttcatatcctttgccctctttttgatggggttgtttgttttttttcttgtaaatttaagttctctatatattctggatattagccctttgtcagatggatagattgcaaaaattttctcccattctgtaggttgcctgttcactctgatgatagtctcttttgctgtgcagaagctctttagtttaattagatcccatttgccaattttggcttttgttgccattgcttttgttgttttagtcatgaagtctttgcccatgcctatgtcctgaatggtattgtctagactttattctaggatttttgtggttttaggtcttacatttaagtctttaatccatctcgagttaatttttgtttaaggtgtaaggaaggggtccagttttagtttcctcatatggctagccagttttcacaacaccatttattaaatagggaatccttttcccattgcttgtttttctcaggtttttcaaagatcagttggttgtagatgtgtggcatgatttctaaggcctctgttctgttcccttggtctatatatctgttttggtatcagtaccatgctgttttggttactgcagccttatagtatagtttgaagtcaggtagtgcgatccctccagctttgttctttttgcttaggattgtcttggctatgcaggctcttttttggttccatgtgaaatttaaagtagttttttctaattctgtgaaaaaagtcagtggtagcttgatagggatagcattaaatctatacattactctgggcagtatggctattttcatgatactgattcttctatccatgaggatggaatgttcttccatttgtttgtgtcctctcttatttccttgagcagtggtttgtagttctccttgaagaggtccttcacatcccttgtaagttgtattcctaggtattttattctctttgtagcaattgtgaatgggagttcactcatgatttggctctctgtttgtccattattggtatataggaatgcttgtttttgcatgtggattttgtatcctgagactttgctgaagttgcttatcagcttaaggagattttgagctgagacgatgtgattttctaaatatacaatcatgtcatctgcaaacagagataatttgatttcctctcttcctatttgaatgccctttatttctttcttttgcctgattgccctggccggaacttccaatactgtgttgaataggagtggtgaggggggcatcattgtccttgtgctggttttcaaagggaatgcttccagtttttgcccattcagcatgatagtggctgtgggtttgtaatagctcttattattttgagatacattccatcaatatctagtttattgagtgtttttagcatgtaggggggttgaatttgttgaaggccttttctgcatctgttaagataatcatgtggattttgtcattggttctgtttatgtgatggattacgtttattgatttgtgtatgttgaaccagccttgcatcccagggatgaagctgacttgatcgtggtggataagctttttaatgtgctgctggatttggtttgccagtattttattgaggattttcgcatcgatgttcatcagcgatattggcctgaaatttcctttttttgttgtgtctctgccaggttttggtatcaggattatgctgatgtagcatctatgtatctatcaatactatactgtcttaatcgtggcatcatagtaattcttcaaatcagatagcattaatcttccagctgtgtttttcatttttaaaatagtcttagctattctagtttctttgcttttccacataaattttgctcttctagtttcttgacctttaatagctatagaaaatcccactgtgatttggtttgacattggattgaatgtataaaatgacttgggtaaagatgactgatgcctgtttttttttttttttttttttttttttttttgggagacagagttttgcaattgttgcccaggcaggagtgcaatggcacgatctcggctcactgtaacctctgcctcctgggttcaagcagttctcctgcctcagcctcctgagtagctgggattacaggcatgtgccamcacgcctggctaattttgtatttttagtagagacagggtttctccatgttggtcagactagtctctcactcctgacctcaggttgtctgcccgccttggcctcccaaagtgctgggattacaggtgtgagccactgcgcccagctgcaaagataacctttttacaatatttgggtctttcagtccatgaacatagtacatctctccatctacttagggattctttttttttttttgagacagagtctcactctgttgcccaggctggagtgcagtggtgcgatcttggctcactgcaagctccgccttctgggttcatgccattctcctgcctcagcctcccgagtaactgggactacaggagcctgccacaatgcctggctaatattttgtatttttagtagagatggggtttcactgtgttagccaggatggtctcgatctcctgacctcatgatctgcctgcctcagcctcccaaagtgctgggattacaggcatgagccaccacgcctggcctatttagggattctttgatttctttctttggtgttttgtggtttttggcatacagttcctacacctgtattgttagatttatacctaaatatttattcccttttttttttctttcccttattggtgctaatatgaatggtacagctaataattaaatactaagtttttattactttcattcttggctttctgaaggtgttttcctatcatttaaggtctttagcaagtaaaagattgtttcttgatgtttgtcctttgagtcatcatctgtttatgatttcacagcccttgcaccattttgtaattatgatgtcaaagcaagtagcttcaaaggatacatctggaggatcggaaaagtgctgttctctggataggtgggttagatttgagacagaatccatgtttctttccttgagtgtcataggtgttttagaatttcttttgttttgcctatgagaatatcatttaatttcttttacttcagaaaatctagtttgaagtatggatattaacttttagcttgatataaatgaggctctgtagtaggcattccaggaaaagtggatgttttctggctcttttctcttagatgactaaacaagaaaacattttctgggaaaagaagagcagctggtactctcattatatttccttcagtggttctgtaccatctcctgttcatgttttattgttgtataccttacacactagccaagtagagagaaggtattgtgttgaatactttaatgctgatcatcccgtttagatcttgtgacaactgggtaaattacacgtgacaacactgagcttcagagtcacctgaccaaggttctatgactgcctggaggacatgacttgaacataagccctctaccacagagtccctggcctttcccactcagccccatgacaataaaattggagaagactcttagaaggcaaactttttgggaggataggatacctttgcaagtctgctgaaagctccaggaactgtctccaaaaaaatgtttatgtgggtttccttaaaaagttctatagacattataggttttcacagaaccccttctgtggtctctggatcataggctaaaaatccatatttaagatcttttcttcacttgctgtttttttcaccattattaagaattacccaagtactgtatacctcttctatgataccagggagcaaatttcacactacctattgtgggtgcttgtgtgtgagcaactggtaaaagccagaggctcctccctctattctcttcattcattttttaatgctctgtgctgtgtactggggattcagctgtgaataaagcactatccctgtcctcaaggacttcatggtctggtgcatttcggaaatggtcatttttggaatggctaaagtatgttcgtgtgatagggagaggcagcatggagtgtggtggaagaatctggattcatagtcaggcttggattcaatgtgagacacgttattattgaattatctgaggggcttttgtgtcaagggaataatgatgctaatgcctaccttacatcctttacaaatgagagcttttcttcgtaaaaatgacttcttctgaaaatgaaatacatgtaaagtcctgagaagaacacttgttgcagactaggccattaataaaggttgcccattattaaaaattaacacattttattcaacaaatatttgagagggaaatcaatgctgtgagtcaggtcccattaatagagatggatgtataaagtcgtatcatagtgcaacacaaactttgatatttaaggtctgcattcactaatgcccagtaagattttactaaaaactggtttaagtcgtgagtagaaattatattaggttgtgcagtttttcttacttactaaaagctgaacgtgtttttcttttgttgtttgttgtttacctgttagaatttagtttataaggggccacgtaggtatttcctcaggaagatatcttcctcaagatttccatggcataatttgtgacagaattaagttatgccacctttgaagtcggtcacagcccgaaagcacaagaagttgtttacaaaggaacccatcgattctccttctttctctggaagcatccgagcagtgaggcccgtacagtctgtttggcacagtgactgctctcagctggccaggggccctcctgctgctgggcagaggatgcgccagagctttgcttgcagctaagcaaagcctgcctgcagttctgctcgtggttaactgcggccttgcaactgtgtaccacagcctactggtttagttgcaatctcttttccttaatattttccatctggccaacaatgacctataaagacagacacaaaacagggtttgaattatagggagtgtgatgctgaaatgtttccaaatcacactctagaacctgtagtcccgggcagctgcctttgcatgcgggacagaaggaaacttttctcaagttggtttgcaaagcactgagtcacatcaaagacctgagccattcagcttttaagtgttttaaaaggcttcataaattccttctctgtcactgaattttagcatttaactcacagttctgctactgatattgaacatttttgagaaaaatataatgagggtcacaagagtgtttcatatccaacttctaaatttttagctttatctaaagctttaacaattagtgaagcttgggcataattggtgtcattgtgctctgaatggcgttacaattgcagagatgttttactataaatttagaactcattgaaacagatttcaaaaatgagtaagagttgcttttgaatttctcttgctaagaattttcctgaagatgcatttgttaatggttttgagccagattgaaatggtatgcaataaagtcatctcatatttttgtatcattagaagccaatttagaatatttgtcaaaattagaatggaagttcagatttggaaaatttttttatcagctatcaaagcacttggggatgatttgtgttttttacagcttgaatcgtttgagaattgctattcttcttagtctttattttcagaatatctcttagtctaagaaaggcgagttgcttctccctttttggaagatgacctgtgctcagagaggttatggtttggcttctgtggcacagccttgaagagaaagctggggaggcctggccagacattttgatgctcagacctcaagtccatgctgccacctcctgtctgcatcctagctttcattttaaatcaaccaagcttttcttcagaagtctgctcaatgactttttttttttttttaattttatgcttctctgtcctgtcttttatttctctcttctcctcccctctccttcccctcactccaggtggttaactctttgtgccaaagttgaagtcagatttggcctggagccaacattgagaattcagtgtgtctatttttcagtacctctaaaggttgagattcatgctgaagtctcattaggaaatttaggtatgtgtggttttagaagctgattagatgctccacagatttgatctcctggatgctccctcccttcagcctccctcaacgagttgtgcttcttttctattgtggctctcaatttccaagtctggggttaggatgagaaatgcaggttaattagagcaacccagttgactctaagaatgggagtgagcaccaagcattatgactacaaaggttagactagttcagtgtctttgagaagggaagggaagaagggagggaaatttggatgttcttctttaacaagctgagcagcaaataaagatcacactagaatatggtgggtgttaggtatcacctattcattccttcaataaatattggtttagtcaacatctactgcattatactatgaaccaagcaatgtagttgacactggagtcagagagatgacatgtccttgcaggagagatggtcagactaaaaaccttgatgtgataagggtataaaagcatgaagccctgagggaggtgtattagtctgttttcatactgctgataaagatatacctgagactgggaagtaaaagaggtttaatggatttacagttctgcgtggctggggaggcctcacaatcatggcggaaggcaagggggagcaaatcacatcttacatggatggcagcaagcaaatagagctggtgcagggaaactcccatttttaaggccatcagatttcatgagacttattcattgtcacgagaacagcatgggaaagaccacccccatgaataagttacctcccacagggttgctcccatgacacatgggaactgtgggagttacagttaaagatgagatttgggtgggaatgcagccaaaccatatcattccaccccagcccctcccaaatctcatgtattcacatttcaaaactaatcatgccttcccaacagtcccccaaagtcttaactgatttcatcattaactcgaaagtccacagtccaaagtctcatgtgagacaaggcaagtcccttctgcctatgaacctgtaaaatcaaaagcaagttagttacttcctggatacactgggggtacagaaattgggtaaatacagccattctgaatgggagaaattggccaaaacagaggggctgtaggccccatgcaagtctacaatccagcagggcagtcaaatcctaaagttccaaaattatctccattgactccrtgtctcacatccaggtcatgctgatgcaagaggtgggttcccatggtcttgggcagctctgcccctgtggctttgcagggtacagccaccctcctggctgctttcatgggctggtattgagtatcttcagctttttctaggcacacagtgcaagctgtcagtggatctgccattctggggtctggaggatggtggcccttttctcacagctccactaggcagtgcctcagtagggactctgtgtgggagctccaacccacatttcccttctgcactgccctagcagaagttctccatgagggcccccactcctgcagcaaacttctgcctgggcatccaggtatttccatacatactctgaaatctaggcagaggtttccaaacctcaattcttgacttctctgcacctgcaggcttaataccatgtggaagctgccaaggcttggggcttccaccctatgaagcaacagcctgagctgtactttggacccttgtagtcacagctggagtgactgggacacaggtcaccaagtccctagactgcacccagtagagggacccagggctcagcccatgaaaccattttttcctcctaaacctccgggcctgtgatggaaggagctgtcgcaaaggtctctgacatgccttggagacattttccccattgtcttggtgattaacgttcagctcctcgtttatgcaaatttctgcagctggcttgaatttctcctcagcaaaatgggattttcttttctattgtattgtcaggctgcaaatttttcaaacttttatgttttatttcccttttaaaactgaatgcctttaacagcacccaagtcacctcttgaatgctttgctgcttagaaatttcttctgccggataccctaaatcatctttctcaagtacaaagttccacaaatctctaaagcaggagcaaaatgctgccagtctctttgctaaaacataacaagagtcacttttgctccagttcccagcaggttcctcatctccttttgagaccacctcatcctggaccttattgttcatatcatgatcagcatttttgtcaaagccattcaacaagtctctaggaagttccaaacttttccacattttcctgtcttcttctgagccctccaaactgttccagtctctgcctgttacccagttccaaagtcacttccacatttttgggtatcttttcagcaatgccccactctactggtaccaatttactgtattagtctgttttcacactgctgataaagacatacccaagaatgggaagaaaaagaggtttaatggacttacagttccatatggctggggaggcctcacaatcatggtggaaggcaagaaggagtaagtcatgtcttacatggatggaagcaggtaaagacagctggtacagggaaactcccatttttatagccattagatctcatgagactgattcattatcatcagaacagcatgggaaagacctgcccccatgatttgatcacctcccacagggttgctcccacgacatatgggaattgtgggagttaaaattaaaaatgagatttgggtggggacacagccaaaccatatcatgaggtagctcacttttgttggtggagatgggaaatgggatgaaacctgaagagcaactaagaatgttacccaggtggatggggaggtgggacaggaatgggagagaaggcagagcatgataggcaggttggacagcacgggcagaggcccaggaccaagggagcacagtgcttctgcagagtggtggagcattcagtatgcctggagcagaggagaatggcaggaaatgaggctggaaggaccagagagcaaggacctcacaggtcatgtggtggcttttggacttgatcctgaagtcagtgaagaatgacttggagaatcttaagtaaagggatgacataatcagatttgtgtgttagaaaatcattttggctctagcatagaggaaccacttacaggtgaagtgagaagttgtggggatctgcattggggcagagagggaggggaagagtgggtgtggagagtaagtgagcaagcaggtgagcttgcactctaaggctgaagacagttctgggtcagacacttggagtatcatttataatctgaaagttctgcttttcatacctaattccctagcattctgctttttaaatgatcatgggatgtttgataaatgaatgcatgaatgccatttcttttaggtaaagactggtttactcttctaattccattttgcctaaactagccttgagttgtttgtgttccccaagtgtttactcccagcaagatggaggcagcccaygcatgctggatggcmgcaggaagtcaatcttggatttcagaaattgccatagataagaatcagctgcaaataatcatggcccaacccataagagacagtgttggcaatgataaagttaactctgctaagattagtctgaaaagagtttgcatgtattttgaatagccctgatagaagggtgaacatgtgtctgtaccagttgctgggcctagtaaagagattgtattttggtgaatgaaaggatcagaggggcaaatctcctgatcctttgctaggctgagctgggtcctccactttgattacatttgaagtcgcaggcctattaatgagaacactttaactggtctcggaccaatctttcttcctcttctctttacctttgttcatttggggccccccttttgccccccagcatgcacagaccctcctccattaaagaataagagcattttccctcggagccctggctgaggcagctgcctcttctgtcatccctcactcccgctgccctgttgttatcttcaagacttagctggtggttgccaatctgttacacctgctctcaggggccctccctgtttgaatacgtggtgatgttgagctacattcagatgtagaaggttcactcttgaaagaaaagctcatgtatttaattgcttattgtggcatggagggaactgggtaattgagtatattttccattttcagtatggaaattaaatcaaagcaagcctttatgatttgtggtcggtacttaggcagcatggcatggtgaaaggagagcaggctttgaagccacagacttgagttcaagtattgctatcttcatttgctacaggttgagcatcccttatctgaaaattcaaaatccgaaatgttctagagttggaaactttttgagggacatgactccacaagtgggaaattccacacctgacattatgtgatgggttgccatcaaaatttagtcaaaactttgtttcttgcacaaaatgattaaaaaatattctatagaagtaccttcaggctatgtgttatgaggtgtatatgaaacataaatgaatttgatgtttagacttgggtcccatcctcaggattatcttgctctatatatgcaaatacttcaaaattaaaaaaaaaaaatctgaaaacctttaacacttctggtcccaggcatttcagataagacaactcagtctgcgatttaactgagcctggtattcactctctttaaaacgaggattaataatagcagcagagtctcagtcgttgcaaggatgatgattaaacaagataatagatgtctaagtgccagctctgtgtgtgatacctagagagcactcccaggcggacagttcagttctcttcgtgattgtcatccacggcagtggcagccataatgcaatggggagaggatagtctcaggtgtcagaacagggtttgaatcctggctcagctgcacattagcagtgtttgtgatactgagcaaggtacctctgagccttagcttatcaaatgggagtcgtaattcctaccttacagggctacgaaaacttgggataacgttaaccactgtgttagtctattttcacactgcctataaggacatacctgagactgggtaatttttaaagaaaaagaggtttaatggactcacagttcctcatgcctggggaggcctcacaatcatggtggaaggtcaaaggcacttcttacatggcggcaggcaagagagagaatgagaaccaagcaaaaggggtttccccttataaaactgtcagatctcgtgagacttattcactaccaygagaacagtatgggggaaactgcccctgtgattcagttatctcccaccgggtccatcccacaacatgtgggaattatgggagctacatttcaaaatgagatttgggtgaggacacagccaaaccatattaccacttgtacagagcttagcaagttgtggacactctgggtgtagtcctttgttactgttgtctgggcttgcctttgaaaagaacattgtcccaacagagtctgtagttccaatggcagttcagtttgagtcccaaattttgatgagtcttaatgttcctgcagccaagagagtccagaagagaatcgttccagtgttcttctggacctggatctcatatgagtaacaaaatgcaagcatacaatcctcactgtgaatctacaggaggctgttgtttcaactgacttaagaaatttcactgagtatggaaaggatgtcagaactttagccagagctgcaactataatcacattattttgctgctgctcagtggagctaagaaagcttaagagtattaccatctgggcaaagctaggcaatggtgaactgtgaactgcttaccaacttaacagaaactcttgctacctcattcattaattaggcctttatggcacaccttcttttggttgcttggcaaccataatagcagtcattaaattctgtcattttgtattaaccctttggccctgggtggattgggagcccccaccttaacactaatgcattttacattagtacgtctacctgggaaatcccattcccttgacacttcagctataaagagcaaatagccagagtccaaaatagaaaaagttctttttttcttcacattagtgtatgtgcttttaaggctttacaaaatgtatctgtcaggatggaggccatttcccaatttgctgacagacagacataacatacacccagcaagatgaaaagacagctagtttcccagaaaacaggagctgactgtgacttctgtgggcttatggaggaaggagstggtgtgaaaaccagatgggagagttgttaagagttgtatgtttccaaaattgcctttgtagctcctttgcaaaaatttggaccatgcatgctggagggatagggggctattccaactacacactgtttagcatttcagcaactgattagagtggtagggaacaaactgtgtactctggcaaagtctgtgaggaaatgcagtggacacagggcaacctctgggagactgtcaagggctcctatgatgctctgcccactaggttacataaatgtgaacaagatataaaagccttacattaaaatagggcttaggaatttaaactggaggtatatcctcttttctataatgagctaaaatgatttgagacttgtgtagtataattagaataattccatttctcagaaatattaatttttctcttagtggaagaaaacaggaagtacgttaggttttggcatcagacaaacctaggttggaatccttactctacccagtaactgtgtaatcttgtacagttgcctttcttttttatctctctttccttatctgtaaagtggggataatcattccccttcagagtattgttataaggattaaatgagtcacatacattatacgtatctcctagttaaggcatggcccatggtatagaccccattcattctttcaacaaacaggactgcagtggtgatcaagaacctctccactctcatgattttacagtcaagcttagtgtcagatcctctttgtccctcagtttactaatgacgcccagaraggctgtcacttgccaactatctgaccagatctgatagtagtatctgggttgcctggccaccgggtctctcaaataaattttatatgtaatactgctaagtttcctaggcgcggtgtgactatgtatttactatttctcagtatattttgggtggtaactttagaaggcaaaaggaaaagtaaaaagtaaccacaattaactagtccaagttattagtatcaaacttaaaaactagattagtcatttgcacttaacggttcatgtggttatagtaaggtgggccctgctaaaaatgttggcattgtttattgaggagtttaaataaaaatttactccccttgcctctgccccgtcaagcatgtacgtgatactcacagcatctgggatttaaagtggctactgtttgttaaaaaagcagtaacttccctgaaggagttttgtgagttaggagaagtcacaaaggcaattaattttgttcttcagagcagtacctccactgcattcgtttgtactttttgcaagcttaaattataacccaggagccagccgtaccatgatccgatttgatatttagttttattttattagtagttgtctttaatggatgtcttgtcatgtaggtttcctgattattagtaatttaaattgactctgagaatgaaaggaaaccacaggcatgaaactgatggactgtgactacagcggtcttccagctttcaaggcagctgtgatggctctgcaggctcccttggttcccccctccttcgtccttttaaagctttgaacactcttttagctaatgctgaaaatgagagcttaatactgttactatatgggaacttttaaaagcaaatgggcatcctaagtgttctttcctctttgaaggtaagtgttatgcatgggtctactctctacttgatcagatctaatttgacccaggagtagagatctgtgaagatgctaactgaaaaacaatgattgcagggaaaataatttcccttgttcttatgctgtgcctttctaccactccctagaattgcttacagtatctttgtgaaaggaacaggtgaaaatttacttttcttgccatcttttggtagtagccaagatcacatgtatcctaaaagaggctgctccctggagtgctccagagcagcacaagtcatgctgttaaagggcatttgttgtggctttaagatccagtgcctacccgggtgtggtggctcatacctgtaatcccagcactttgggaggctgaggtggggggatcgcttgaggccaggagtttgagaccaccctgggcaacatggcaaaaccccatctctattaaaaatacaaaaattagttgggcatggtggcgccgcctctcgtcccagctactcagtaggctgagttgagaggatcactggagtcaaggctgcagtgagcggaggttgtaccaccacactccatgctgggccatgggagtgatatcctgtctcaaaaacaaaaaaacaaaaagcaacaataaaaaacagatccagtgcctatagcattaatttctctgagctctagacatatagttgatgatcctggagtctgagtactttaggttagatttagtttagttgctgcttaacagctgcaaactagctctaggtagtttgctaaataactttactcactcattcattaatgaagcctgtgttaagtgtctcctttgttcagtcattgatgtgggtgaatgaatgaagaaaggaagttttatatgagtcagtgaatgaatgagagttgtactttctgtcttcaggcagctcacagtctctgataagatgatctgaccaaggctctttttatgtgagtgaattttagaacctcgtgccagtgggatatactgccaacccagagtctataaatcacagttattttttgcaagaattgagtattctcatttgtcttgctaatccagaaaagttaagttgtaaacaaaacatttattttttattattattattattttttttggagacagagtctctgtcacccaggctgaagtgcagtggcgcgatcttggctcactgcaacctccacctcccaggttcaagcaattctccctctctcagcctcctaagtagctgggattacaggtgcccgccaccatgcctggctaatttttttattttttagtagagatggggtttcgccatgttggccaggctggtctcgaactcctgacctcaggtgatttgcctgcctcagcctcccaaagtgctgggattacaggcatgagccactgtgcctggacgtaaacaaaacatattttagaagttactgaaaaataatttttaagaagccaatgaaacctgactgtggagaaatatattcctagcaaccaacctgtggactcagagaaagaacctaggatggaatcaattttcaatttgtctgttcccccacttcctccattgttttatagttatgatcatttaaaggcacgtgaatgtatgtgaaactgtgctgtttttctcatgctagagcacttctggttctcttacagtagggctgactctgagagtaggtttttgtttttgtttttgtattttgagatgaagtctcaccctgtcccctaggctggagtgcagtggcatgttcttggctcactgcaatctctgcctcctgggttcaagcaattctccttcttcagcctccctggtagctgggattacaggcatgcaccaccacacccggctaatttttgtatttttagtrgagatggggtttcaccatgttggccaggccggtctcgaactcctgaccttaagtgatccacccaactcagcctctcaaagtgctgggattacaggtgtgagccattgcacccggccaatgctgagagtttttgtccctgcaacatgatggtagacaaggtcgcctggcaggagctacctgcacagacagcattccccactgctggggctggtatctgtggctgaaacagggttagctgcaatgtgagaggacgctagtcccagcccaccagagtgatttctttggagtgttctgataaaactgccgatcctttctcgagcataaaatgccactgctttgtctttcctttactcaatcaattctaatatacttgctaggcaagcatgcttctaactgtacacactaatttttaagtactgttaaaagtaaattccaatttttagatggctcttataaggggcatcatggcataatttgtgatttttttttaactcttctctccatatgtaaaggtatagtggcaaagtcagacagatctagagtcaaatctcagccccgtctttcataaactatatgaccttgggaaagatatttcacctctgaatttcagtgtttctgttgatggaatagtgacaataatgttattagtaataatattcttattgtcaaaattaaatatgataatgtatctaagaattatcaacatagtgtgaatttcaggagagtctagttttttttttctaattgtctttattttaaaatgtattcattgttatttaccccaacttgtggaaaactgtgtaggtttcagtgccatcataaggagtatgtggaaaggtatgatgaaaagcccaaagtcccgtggtcccactcctatgagcagttgctgtggagacatggaaatgctattctgaattgacctaaccagtggtcctgtgctctaatctctgattcccagatgataacagatgtctcttaagtgattccaggtgttctgaacatagtgaaatctcttatctgccacatccacagttactccttaaagttcttttatattacctctttaatagtatttgaaggatcgagattccttgacagctgttggaactctaactccctacttgaagggactctgcttttagtcctcaggtgatctccagactttcatgctgtaccgtttgatttgggcccacatgccaaatagttttaatatgttctccttttttattaaacagtttttgtcatgtccaagagatttcctgctggtagcagctataactttttctcaccatcaaggcattctctgccccttgttaactctcggtcagggattttctgcatacttctcttcaaaatattctcgttggcatcgtataggcggtgaagttttccctgactaccttaggagttcagtactcccttttccatcatttagagtgttttatgcatacttgtagtttcagacctttaaaggcccatttgtactttgggggacattcgcctttgtccaacctgagctttgcttctgtagcaggagctgaggtatttaggtagaactttctgccagattaaatctgttggaaatatcgaaggcagaatgttgtagttacagagttgaacttgatttctaatgccagctctacattttaatatccttttcaccttgggctagttacttaagtcttttcacattagcctgttttgttaattaattaatttctctcctaaacccagttaaaagaagccaacatttccactgttataacagaagcagggaggaggaaccagtggctacagatttccatatgtacatctggtgcctggtctatgtcattgtcgtcatggtggtggtaacaactaatgcttatggcatgtttactctgtgccaggcactattctaaatgctccatatacttgtctttttaaatctccatcacaaccctgtgaagttggtactactgttatctccagtttagaaatgaatgaacaggagcacaaagaggttaaataatttacccaagggacagagctagagtaagaacactggtgatctggttccagagcccagacttccaaaagtgtttaatgaatatgtaaatatgtattgaatgaatgaatgtgttgttggaaagttgaggtaactcctgtctaaacttctgttttcttgatgaagtaggtggtaagatcagatactgagggtgaggaagagagagtatgaagattaaagatttgagtagatatggaatagtcatgtaggccaactagtggaaaaggctggacagtgttgaagacttagttgatgttgtagattttataaatgtagaattcctagaggtataatatgtttgtgtggaatttttccctagctatgcatattagcctaatggaggcacagagaaggtaaatagttgcattcattcaagaataaggcatttccatgcatcagggatgaaaggaaaagagacacatgcctttatggtctggatatgatggaccatagaactgagctggataagccagtggtgaagaaaggagagtctcatacttgaggaaaatgaagagaccattagtgataagggttaagaacaggtagaaaaggagccgtaagatgaatgaacaccaaggataagaaactagtttcagatttgggaagtcttaattagtgattttagaggcagggcgggtttggtaatgggaaggttaaggggagactaaagaatgtggctgggatacagtaaagaaggaggtcagaatgatgaggtcattgaagcccctgagagccagggtgttgaatgactgcccccatcaactgtgcacatggtagttatgctttaggtttgcagtaggtaggatgtcacagtagcagtggacttgaaagacattgctttgttgaatttatatatatatatatatatatatatacatatatacatatatatatatatatattttttaatttattattattttgagatggagcctccttctgtcctccaggctggagtgcagtggcgtgatcttggctcactgcaacatctgcctcctgggttcaagctattctcctgcctcagcctctctgagtagctgtgattataggcacccgccaccacgcctggctaatttttgtatttttagtacaaacaaggtttcaccatgttggccaggctggttttgaactcctgacctcaggtgatccactcgcctcagcctcccaaagtgctgggattacaggtgtgagccaccgcacctggcctctatatattttttaattgacaaaaactgtatatatttatactgtgtagcatgaggttttgatacatgtatatattgtagaatagctaaatcaagctatttaacttatcaatataatgcgtatttgtttactcctttttgtgtaaatattctcaaatatacattactcatccaagatagataggggaaatacattaaaaagatctcttccggctgggcatggtggctcacgcctgtaatcccagcacattgagaggccgaggcaggtggatcatgtgagatcaggggtttgagcccagcctggccaacatggtgaaaccctgtctctactaaaaatacaaaaattagcctggcatggtggcacacacctgtaatcccagctacttgggaggctgaggcagcagaattgcttgaagccgggagatggaggttgcagtgagtcaagatcatgctactgcactccagcctgggcaacaagagtgaacctctgtctcaaaaaaaaaaaaaaaacctccaagatttttcattaaattataatctttagggagtacagcttgtccctaacaacatttaaaaattatcagaatttcttaaaaagctcaaagcaaatttgtatgatgccagtgtgtgtgtgtgtgtgtgtgtgtgtttaatgaggctttatagatgactcagcagcgtagctgcactcaagttatcttttcttggttggtgagtgactagaaaggattctctagagtggtagccttgttgaacttagccttcagaattcagcattcaaactccagtggggatttcccagttgattgttgcctgtaactaaacaaaaggccttcaaaactcttattacatggtgtgtttttgcaaaattttgttggtgacataaaaagacaaaacaggacatgcaaaagcccttatatcacaataccctagtattaccttttcttagattttgtatctttagacgcacacactttttaaattagtgaaaaacatttgtatgtatgcaaggattatttagagctaggtaaagatttggaagtgctttcgtagttcttaggtatgttggaaatttggacgtcatcatgatgtgaggaaaagagtattaactttgaaagcagaaagacctggttcaaatactagttctaccacttgctaccacttggctattgtgagaaagttattaaactttcctgagtgttggattctttatctctagtgataattcttaattcattgagttgtgactagggtaggtaaatatatggcacacagtggttgccgaaccaatattaacttttcctttccaatacccctcttcccattattcaagtgaattttggatcctttgtcttgaagaaatcttggttttccaagttccttagaaattccaaatggaaactgtcatatattttgcagctttcatgagtgtggctagtttttaggagaaatttcagtagggaccatcagcagtgcagtttacaatgcaggcacatgatgtctgctgaaattggcccctgcagacgttagggtgtataggtgggccatcactgagcagcaggccatatagcaaggcagtagcaagctaggatgcaggaggaaggcaagatctacggaaaacttaaagggacatggggaagtaagagatcaggggtggagggtaagaggcctctgacattgttctctgaggtcaagttcagactgtgccaaagcagaatcagtgccaagccaagtatagagactcaaggggaattcagaatggggaaaatgaggcaagagaatgtgttagagcagagttgatcccagtataagaatcagtgcttgatcattacgagaattctatccaaaaggcacaagaacaaagaacataccttctcacctagaaactggggcactggtgctcagaggggggcctgggtcgggagtaggattgggaaagagaagtcctgggaacagaggaggccttagttacagagtctgctaaactggcaggggatctgtctgctccatttaggccttcttcctgatagggttgcagaaatgctagcatctccactttttagacatagaacagacttgaccactttcagtcctgctgggttgtagagtgacagcccttgatatgctgaccagctggctcaaagtcgattccaggggaatggtaggcagcctactgatagccaaaaagggctgaggcgggggagttatcccaatactgtaaatgaaattcaagtatgtttaacccatggtcatctatttagtgtatcatacataacagtaaagtcaaagccaatgacctcctgaagaaatcaagtggtgttttcttaagaggttagaattcagttaaaagcaaaattcaagtcttaggtactgagaatgctaaaacagaaggctccggtagtcttttctttttttgtttttaaaaattcccaattatgtaatcaatacatgctcattgctcatcctactccccctgccaaactgaaggtgctataagaaactagaagaagaaaaaaccccacataaccctaccatctgcatgcaacaatgatgacatattcttttattttttatatacttgtaatattttatatgttgttacttaaaatttatttttctggtcatgaatatacttagactctgaagtaaatgtgcaacatgctaaaaaactgaagaaaatggccccaaattccatctacccagagaatttaggcttccaaaaatattgtgcaagcaatgcatcaatatttttcttgtaaatagttaaaataacatataaatatgtaattaatataggtataatgcaggtttcctttgatcacctctcaattccagtcctctatccagaatagaactcttatacataattattacatatattctttcctatgcatctaattatatagaatatatgtaaggtaatgataaaataaacactggagagtctattgcccaactaaagaatatgaccattcgcattcaaaccactcctgttggtggaccacatgggttgttcccaattttttcttctctttttttttgtttttgctataacaaacactgctattatgaagcctcagagaagaaattctgcaatctgctatcaccacatctcacccacctacaacttcacccgtatacgctaccttctcccctgttatcatgggtgcattttccagattcctagcaagaacaaaaccatgcatccatgcactagattccatcccctttcgtctactcaagacacgattccatcagttttcttcttcccattctgaattatttccccctctctacttgatcttccccttattgtggaagcatgtagctatttctcctatcttagtggatgggagyaggaaaacatcctcttgaactaatactgttctcccattaggtctctatttcctcttccctttacagcaaaattcctttaaaaagttgctgaatttgttgtcgtcagttctccactgaagtcattccaatcaggcttccactcccaccacccctctgaatctgctcttgtcatggttatcagtgaccaaaaatgtgattaattctcagttctcctctttcttgatctgtttgacacaatcactgccttctctttgatatattttcctcatatgacttccagggaagggaaccctgttttcctgatttcctgctacttccttggcttttctttctgtctcctttgccagttattccatacctccccaaagtgttaaatggtgctcccttccagggctcagtccttgggcttcttttttttttttttcctttttgagatggagttaacgctcttgttccccaggctggagtgcaatggcgggatcttggctcactgcaacctccgcctcccaggttcaagtgattctcctgcctcagcctcgcgagtagctgggattacaggcatgcgccaccatgcctggctaattttgtatttttagtagagacgaggtttctcgatgttgatcaggctggtctcaaactcctgatatcaggtgatccgcctgccttggcctcccaaagtgctgggattacaggcgtgagccaccgcgcccggccctgagcttcttttctttaaatatatttactcccttcattgcacccagtgtcatgtcatgtctattaacaccttctgacaactcccagaattaaatagcaatctcagacatggacttttcccttgaactccagctgcttacaccttctcttggctatctgataggcatttttatataacacatccaaaattcagcttctaatttttctcctcaactctattcttagtcttccccatctcagttaagggcaggacaatactatttttttccatttgataatgccaaaaaccttggagttgtttttgacccttctctatttttttttttttttttttttttttttgagacggagtctcgctctgtcacccagactggagggcagtggcgtgatctcggctcactgcaagctccccctcctgggttcacgccattctcctgcctcagcctcccgagtagctgggacgacaggcgcccgccaccacgcctggctaattttttgtatttttagtagagaccgggtttcgctgtgttagccaggatggtctcgatttcctgacctcgtgatccgcccgtctcggcctcccaaagtgctgggattacaggcgtgagccaccgcgcccagccgacccttctcttttttgtccacatactctatatccaagccatccacaaattcagccatatcttatgttgaaaaatatcctgggaggccaaaatgggcagatcatgaggtcaggaatttgagaccagcctggccaacatagtgaaacctcgtctctactaaaaatacaaaaaattagctgggcatggtggcggacgcctgtaatcccagctatttggaaggctgaggcaggagactagcttgaaccagggaggtggaggttgcagtgagccgagattgcgccactgcagtccgcagtccggcctgggckacagagcaagactccgtctcaaaaaaaaaaaaaaaagaaaaaatatctagtatctgttgatgtagctccacctccaccactaccaccctggtccaagccaacaccatttcttgctgcattgttagaactggtttccctgtttctaatcttaacctcctagatgcagcttttctcatactgcatttctcatctgatcccagaacacaaaacagaatttgaatgacactgttttctcagttctcccaaggatggtacatattatttttgctgtgtcaattactatggtcttaatatctatctagttctctacgtcttcttttcttcttggatgttctgcttttcttggtattgtgcctttccatgtaaattttagattcagtaatattatcaagtctcataaaaaccaggttgaaattttcactgaatacagataagtctggaatgaattgacacctttatgttagtgagttttcctgcccaattcctgaacatggtgtcagtttatttagattttattttaatatcttttaaaaacacttcaaaatttcttccataatggtcctacatatctttgcttcatttttttcccctaaggacctatgtttttacgggttctataaatggcatatatttttaattacatttttctgttctcgtgttgtttagaaactcaattgatttctgaatattgatcttttgcccagctacctaattctagtagtttattatatatccttttggatttcagatataaaattatgtaatttataaataaccactttaccttttttcccctttcctattctttgtaccctttatttccttttcttgtccagctgtgctgcttaatatcttcagtacaacgttgagcagaagtaaagataatgaatatactcttattgttcttcattttaaagaaagtatattagcatttctccaataagtcgtaaatagatattctgtcttagattaaggagattcttttttgctcttgttttatttacgtgccacaaatgagtatgtctaattgttactcttaaactaattcacttatttgttcttgctgtcttcacagtgctttgtctctcatgtgtttgtttgttttttttttttaaattcatcttgcgtgggatttcagcaattctggaacaatctcaaccattatttctttgacttttgatgcttctttttcttattatatccttctggaaatttgattagaatacattaggctttttcactctctttcatgttgcttgttttcctttttcagttatttcttcttcttgtctatttagatccattatgaataacgtatctgggtttatcttccggctcactaatgccacttttactcgtgtctaatcttttcattttgtgatattccatttggttcttttatagatctgcttggctgttggtagtctttttttccccaccattgtcaatcattcctttaaaaaatgagaaactaagttttttacatgcattaaacactgttttattctgtttctgattattttagttgtccacaaagctttatttgtaggaattgggggagtggggcttggctcaatttgaatccctctagagtatatttatatttcaactatgcttctggctattacctaggaatactaataatttgggttctctataaatatgtttgccattttatgagaccacgatgggtgaatttggattgcaactccatgtgaaagcatacttttagttagacgtgtcactggagatatttgcttgtaccctgcaacagcatcaagaatgaagaattttctgctgatagaatttaatcagaatattttatccttacactaaagatgtagcccttgactacctaagtattaggctgttgtgtacttaagagatttctaggctttatctcctttcacctctgacctgtgtctccatcattttgggagctcaaagtgttcatggtttggcaaagagcttcaggggtaaaaactagctttattgcttgtttacttttctgagttccatttttttttttcattttatttttcgggcctctagagtgtttactttttaccagattagcaatatttttaaagatggtacatgaaaatatatagtctggcatttaattgtatcagttgggagggttttaaaaatatctaatcttccataggccaaaatggatgaactaaagaaatgaaaacatatataaatataaaatatatatttacatacactaaaattcaccaattttaagtgtacaatttaatgagtttgacaaatgtatacagatgtataaccactaccatggtcaagatacagaacgtttctgtcactcccaaaagttctctgtgcccctttttagtcaccccaacctcccctggccctaggcaagcacaaatctgttttctttcattgtcaattaactttatctttcctagaattttatttaaatggaaaggagtacaatatgtactcctttgtgtctagcttcttttgctcagcgtagcatttttgagattcattcaagttatttatatatgagtagcttgttctttttggtaaggacttattactgccattttcattgttttctaggtcctttctttcttcctctcttactgtttcctttgtggttgagtgatttttctatagtagtgtgttttgattctttgctttttatttttagtgtatctattatagttttttgctttgtagttaccatgaagcatataaaaaacataactataacaggttattttaagctgataataacaacttaactttgatcacatggagaccaaaaaactctgtagtttaactgtacatcctcccctgacattttgaaatttgatgtcataatttacatctttttataacgtatatcccttaacaaattatcgtagttattttttaggctgggtgcagtggctcacacctgtaatcctaggtggatggatcacttgagtccaggagttcgagaccaacctgggtaacatagtgaaaccccatctctactacaaatacaaaacaaagaaattagccatgtgtggtggtgtgtgcctgtggtcccagctacttgggtggctgagccaggagaatcacttgaacccaggaggcagaagttgcagtgagccgagatcgcgccactacactccagcctgggctacagggaaagactctgtatcaaaagaaaagaaaatcattgtagttatttttaaaatagttttgtcttttaacctatatacttgatataagggacttacataccaccattatggcattagagtattataaatttgactgtatacttacttttactttcagatgttttatgttatttattagcatccttttctttcagcttaaggaactccctttggcactgcttgtaagacaggtctggtgatagtgaactcccttatcttttgtttgtctggaaaaatctttctctctccttcatttctgtaggacagatttgctgggtacagtattcttggttgacagtatttttccttcagcactataaatatatcatcgcagtctttcctggcttataatgtttattctcagaagtttgctgctgggtgtcttggaactctcttatatattatttgcttcttttgtcttgctgctttcaggattttctctttgtctttgatctttgacagtttgattagattctatcttggggtagtcttatttgaattgaatctgattggaggcttttgacctttctgtacctggatatttgtatctttctgtaggtttggtatattttttgctattatttatttaaataagctttcctacctctttatctttctctaccccttcttgaataccagcaactcatacatttgctcttttgatgccattccgtaaatctcataagctttcttcgttccttttttttccttttttatcctctgattgtatattttcaaataacctgtctttgacttcacagatttttttccttctgcttaatcaggtctgctattgattttctctattgcgtttttatttatttatttatttttgtatttttcaactcctgaaaaatgtttttaaaaattattttaggctctgttaaatttctaattctggtcacttattatgtttctcatttcattgaattgtttattgagcacctttaaaatagctattttggattctctatcaggcagtacatacatctttgtctctttatggtcagtcactagtacctcattttgtctgtttagtgacaacgtgtttccctgatccttgtagtcatgcattgaccttctgtacattgaagaagtaggtacttattccagtctttgtaagcttttgtggctttgttttggaacctccttcaaaagtaagcctgttcagagtttctaggcaggttgtctggtctggtccctaatcctcagattgctgtagctgtggtagcttagcatgctaagcccatggctaccaaggctggtacagcactgggatatacctgaagctcttggctgctgagagcctgcctgttgctgtgggttattcatagcctaaggccactgtagtcagctggcagtgatgcaggccagaactcaaatctgtgttataggggctgcaggtctctggtgctggggtgggtctagaagctcagttcacaggtgtcggcctggagttagaggccctagaggtctgcctgatgctgggttttatggtggcaggctcagtattggggacctagacaaagtcttagacttatttctctttcccccaggcagatgatatctctttccactgcctgaggtaaggggagggatgacatgggtaatgcaaaattgtcctttctaccctctttgatgtgtctttcttattattgtgctataaccaggcactatgatctgttacatggtttctttagctcttgtgagggtattttgaactgtttaaattgatgtttctgtgtggggataatccctggagagttcatttctgccattttgctctaccttctatcaatttttacttctgagttcatgctttttgtgttctgtgaaatctctgcataacttaagagcacagagattttcccctatattgtcttatagacattttgtaggtttatctcttatacttaggtcttcagtccatttctataaatttttgtatgtagtgtgaggtaaggaaattggtattaaaattgtaagttcaaattaataaaacagaagcttttataatagcatcaaaatatgaaataccaagggatacattgaacaaaatatttgcctgacctgtgcactgaaaatacaaaacattgctgagatacatttttttaaaaagatctaaatagatataccaggctgatggattcaaggattccatgttgtcaagatgttatgatggttaatcttgtgtgtcagcttgtctaggctatggtacctaattatttggtcaaacactagtatagatggtactgtgaaggtattttaaatstaactaacatttataatcattgacttttagtaaaggagatcaccctccataatgttggtggtcctcatccaatcagtttaaagccttcagagcagaaactgaggttttccagagaagaaggaattctgcttcaagactgtaatttaaaaatccttcctgagttcccagcttgctggcctgccctacaaattttggactcaggactgcaacatcagttgttacctgagtttccagcccactggcctgtcctatagatttcaaacttgcctcaaccagttacttaacataaatctctttatacacacacacacgcatgcatacaatagtctattctgtttctctggaggactgttactgatacagatgtcagttctccccaaattgatctatagagtcaatgcaataataccaccaggcctttttttccttcagaattgggcaagctgattctaaaatctgtatgaagatttttgtggcaaagaacttaggcaaaataactttttaaaagaagaataaagttggaggacacatattacctgatctccagttttattgtagagctacagtaattgagacattgtggtattggcacaagggtagaccatacggattagtagaacagaatagagaatcaactgatatctagatatattttttagaaaggtgccaaggtaattcaaagggtagtctgttaaaaaatgaaagggtagggmaggcatagtggctcacacctgtaatcccagcactttgggaggctgaggtgggtggatcacctgaggttgggagtttgagaccagcctggccaacatggcgaaactccgtctcttctgaaaatacaaaaattagctgggtgtgttggcacatgcctgtaatcccagctacttgggaggctgaggcaggagaatcgcttgaacctgggaggcaaaggttgcagtaagctgagatcacgccactgcactccagcctgggtgacagagcgagactctgtctccaataaaaaaaaaaaaaaaaaaamaaagaaagaaagaatgaaagggtagtctattaaaaaatgtcgatggagcagttgggtatccgcagggaaaaaaaaggaactgagttttggatgaaatcactttttccaatacagaagaagaaaataattatcttattatttcagagatgggcacagggagccagggtgaggggggaacctggaagatggggacggggtgagcttgagggagaggtcgaaaataattacctttaatttcatcatccaaagatagatattgtggtgttttctgttagatgttgtcttataatatatgtaatatacagataacttaaatgtatatatttttaaatttacatgtttgaaaacctttttactggatttgctttttacatatttttataacatcacagctttccatctgaaggacatttgaatgaccatatgatactaagtcatgaaggtgttccatattttacctaatgattctcaactgttggaattaataatagtgatagtaatagcagctgccatttattgattactttctacctggaaactatgctaagcaggttttatgaattgtattatttaatccttatgacagctctttagttggctccattaaaaaaaaagtagggggaaccacgggttaagtcacatgcctgtctctaatgtgtgaagcttagatttataattaattgtcttttattccaatacctgagaaaaatatactgccattctttaggctttttatagttttttgccaccgtaaattctgaggcagatatctttgtgtagaaattactgtctacatttcagacatctgaacttcttctcttctgctagtcctttatatgtttgatccatcttcactgaatgaaatattttcaaagcctgtgtaggtgtgcaacgtagtacgcagggcaaagcagtgcacaaactgccaagctgttcttttggttgccagtggcttgagccaaacagcaccagaccatgatgggcatttctataggaatgcatatcttctggggaacgaatctaagggatccgtagagctgactatttggtggttagactcatgttgtaaaacgaaggagaaacaactttagtagtctgtaccctaggacatttttaaatgaaattatataatgttggtccagtgacttaaccctctgccttggcttttccatctgagagaagagcattaagttagagctttgtctccaagtaagatgccctaaagaggtagtattgcctaatgagcaaaatcatatctgttgatgatttggatgtcactaagggggcagtactactacacttgtggtatagccttgaagctagagagatttaggttcagatatagctctaaaccatttatagcttaccaaatgatttcagacaaatttcctgagcctttttgagctccggttttctaattacttggaatataaaacaagcacacactgatctttaagcaagggatctcttctcacgactccttggtttgttctttggacttttcctcaccttatttgggctgtgattttgtagaagaatcagggtcctctacccctccacaacccccatatgatctaaggcttcttttctctaatgagcaacttatttctgcttattctgtatgatatgataaggatagagttaaatcttctcggtccttaacttctattatctgcaggtctgcctatcttttgcattctcttaacctgttgttgacagcaaaagtggcctaagtaagacaggaggccatgtctaaatttgtgaagagttgtttttaaacagcctaaaggttgtgtttatatttagaatgtcttttcactttcatttccatgttaaaggcttatgtaccattagtgttagggtaaaaacaaaaaagcacagcagctctaatagtctctccagtacaccttgtgtcactccatgactactcctggggttcctggtttttcgcattgaggctccaagaaccctggaaactcactgcagaagtgggggaagggggaggaaggaaggaggagggagactgtgaagtaactcaggaatggaaaaccaaacaccgtatgttctcactgatatgtgggagctaagctatgaggatgcaaaggcataagaatgatacaatggacttcggggacttgaggggaagaatgggacggggcaagagataaaagactacaaatagggtgcagtgtatactgctcgagtgatgggtgcaccaaaatctcacaaataaccactaaagaacttactcatgtaaccaagtaccacctgtaccccaataacttatggaaaaataaaaatagaataaaattctataacaacaacaaaaaagttggagaaagatagctggtgggtagaataatatgggaagttgtacttttaaattaattttgtcttgtatgactaaagacacactgatttttgcctagagaaacctttgtttaaaatggttgttttttaatccaagaaaaaagtggaatatggaacctaggtggggattaaataaatgtgcatgtgtgcataattttttcccttttctcctgttaaaatggcaagcaaaatatctggggaacagatatattctgcaagcrgatcttcaccatgttagaatttggggattactcttaatgcaaaagaaatgccccttttatggtttgtatagctccaaattgccggttaaatttaaccggcacagtggcaggtattttgtaagatgtggctgatacgtagcaccttacaaagtttattttgagtgatcaacaaagaatactggtgaatagagacctttttagttgtgttcttatttctttattttcctatgccctgtccaactaagctggagaggacatgatcagatcactatagtaatttagaaaggaacacgctctatccctgccccttcgctgtctaatgagttcatgtaaaaaatatatcaaaagaaattctcatcgcagaatcctcacatttcaaaggggagtatatttattataagaactgctgattcattaggaatgcttcctaattcgcacagcagcagctgcttctggttagaataaactctgtctcctcctttgtgccctgtctctccaaagggatgttaaattttggtttaagattttctcttgctttagctttttctctcccactcttcctctttccccagttgtaatgctttattctaytcagtgttcataggatttgaacaacctactgtacccactctccacctttaaaaatgactttccttaagattacaaatgctaacaaaactcttccgataatgtgttttgtttgcattcacagtggcagtggagtatattgtacagcagtaaagaaaaaagttgagacaccttgtagtcatgaattctaagtgcaataatttaaagtacaggaactgccattgtctgttaaatgaaaccactgtattaacgtatcatagcatgctgttctaatcacttttctccaaataccagcttttgaaagaaacatggctgtatttttttatacaaaatctgaaatcgtgtaattgaatggcttggcagaataggtaaatgaatgtagcaacatgcattcaaatatgtctcttgggtttgtaatgagctgattttgaagttcacagttgtaagacttgccattttatttcctgattttatactccggacccagacaaaggtgccagttttttggtgtgggttttttttttttttttgtattaacagaaaaaggaagaagaaaattgttcataaaaatcagtttgccttttttgggcatcactattggattctgtgttccagtaacctttattcaactgtccttctataaaattatcttctaatgtgaccatttctacttaattttagaattattaactgcctctgttagagctgaaagaaattctgtcatgttggccggggttggtagtctgccacgggtgtgtgcccacactagtatgagagagagttgttgcctgtgcatacttctctcatagcattaatcttagtaattacacttgttgatttacaagtctgaatcccccactagacactgagctccttgaaactagagattgtatcagaatcgcctgttagccccaggacccagcaaaggacctcacagtcagtcaatggtttatgaccaatgagctatagaatgctgtattagtcagagttctctagagggacacactaataggatatatatatatataaaactcaatgacatcatattctttagaatctatagtgttcttatctctaatagtgttttgaaaattggtatccttgttagcttgaatcctccaagaagctgacatcaagacaggattaacagattctgtgttgaaatagaatgatttataatttcaataatatttagcgtatggacttttaacagtaatgtgctgacaacaatcttatttgaatttcttttgaagttaaggcttatattcttagagaacttttgtttctccatatatatatatatggagagttattaagtattaacttacacaatcacaaggtctcacaatagtctatctgcaagctgaggagcaaggagagccagtccgagtcccaaaactgaagaacttggagtctgacgtttgaggccaggaaacaatccagcatgagagtaagttgtaggctgggaggctaggccagtctctctctccttttcatgtttttctgcctgctttatattcactggcagcttattagatggtgcccaccasattaagggtggatctgccttccccagcccactgattcaaatgttaatctcttttggcaataccctcacagacacacccaggatcaatactttgtatccttcaattcaatcaagttgacactcagtattaaccatcacaactggtaagccaaatgggtgtccgagtagataccaaagtgtgcagtagacaaaaagatcatcagctttggagctaaagagacatcatttcgaatcctggttaattaagagattgggaattgcttatggaatccaattgagattttgatgttttaggacaattctagatattgaaaacagcgactgcactactatacattcagacaagagaaaccatgtacttttggtgggagatagggcaaaagaggaaaggacagagtaatattgggagattgccattcaatgggcacagaaagatctacttttgggtttgtcaggatgtcctttaggctatgcagatgtgtgactctaggtaagtcccttatattctctcagctcatctttcttttgctacaaaatgagagagttaaacagtttagagcaactggctgatctcccactttctttgcctcacctggttgggcttgatgacacagagcttgggttttaccttttcttttcaaggagcaaacccttggcaccactcatggtattacggccagacctctgggatgggcatgatttcttagctaggagagagcttggtataataaggaggttctcaaccccagcatacatagacagacttggtttatttcactcacttgtgagatgtttcacaaataatttgttagtgttaaataatatagctaggccaggtgcagtggctcacgcctgtaattgcagcactttgggaggccaaggcaggcatatcacaaggtcaagagatcgagaccatcctggccaacatgatgaaaccctgtctctactaaaaaaaaaaaaatacaaaatttagccgggtgcggtggcacacgcctgaagtcccagctactcgggaggctaaggcaggaggattgctggaacctgggaggcagatgttgcagtgagctgagattgtgccactgcactcccgcctggtgaaagagagagattctgtctcaaaataataataataataataataataataataataataatatagctaatgaaacttgtggatgatatactgttttaatacattaggtggactgaagacattcctatactacccttcacttgaggtggagtggcagctagcaccatggggttgtgatacatgggcatgtccatggaactctattgccatgaaaacttgtccttcattggtcagcagtcagggaaaaaagctaaaatatacagtgtagcttaaaagatcatgatagaagccagacttaaaaggctatgtactgtattattccatttctatgatgttctgaaaaaaaaagcgaaattataggaataggaaagagatcagtggttgccagggctgagatttggggaggcaaggttggccacaaaggagcaacacaagcaggctggatggggtgtgatggaagtgttctatatcttgattgtctgtggttgttacaccgatgtgggcatttgtcaaaagagtgacttttactgcatgtttaaaagaagtgaatttttaaaagagagatggtgggaaggacaggtggaaaacagatgatctcagtgctgtgtgctaagagctatgacacataaatagacagtgagggagattctgttggatggtgcacaagcaaacatttaggggtcctggaaatgttgtatggattcattgcgggtggtggttacatagctgtatccagttgccaaaattcatctatatatacacatagaatgggtggagtttatttgatataaattaaaattcaaagttgatttttaaaaaagaaaaaggatcatgagctttggaaccagagaccatacttcaaatcttgaccatttctttacttgcttggtgatcttgagcaagtcacttcatgtctctgagcctcagtttcttcatctctacattatagctaaaaatacccatctcacatagttgaggtgaggaatagaaataatgcctgatggagctaaggtaccagatattttcattttcatccccaaaatggcccagagcacagaactggtctttaaattaactgaagctgccctattttagagtcataataaaagttaagttcaaacatttgtgaaaggtaaaaatgttaccatccatatgtttgtttaatagtagctcttagaatcttattagctttgctatcttttatatcactatagcatgctaaatcttctagggttaagtcatatttaattagttaactaagaataatatacgctgttccttcagtcaggaaagcacagggaattacttatagtgttagctcggaaagagtcattcattgaggaatgattgaaaaagtactagtgacccatttataatccccatctttttttaatttgctttcattctgtctttgaaatgaaatctttatcttgggttaggggaataaatattaattttagaaatccctattggcccagcccactcttttgtgattgacgcaatcttaaaagtaattggaaagaacatctgtgtgcttgtggcactcaacattttaaaatcattcaaaatgtggttgagaaccattctttctcctaagagagtagacatctacctaacagtcataacagaagctacctatttttgagtctctggtttgttttgtgaactgtgataggtactttgtgttattttgcttaatttgttccataccaccactttgttaggtaaacaggaagtgttgcccttttgcagaggaaagtagccttggagagacgaaggaacagctcttgggggagcctgcttgtcaatgggaggaccgcacctgctgctctggatggtccagctcccctcctctcctgccatgtctcacaatggacactgcttctgaaggaagcaggcaaccctctgcctaacaaattcaggtcaatcttctacatgacaggagctcctttgttagctctcttctcccagagtcaaatctgtttttaaaattttattcagtaagtaaaagagcactgacggaggccctcatttttggaacctccttcttccttgaggactttcaccagccacattggtcttaaaattgttgagtttatctgattccagactatcctccttctaaagcagtctttttacaaagacaaaacccatcagatctgtccactgcttgaaacccttctttgatttcaggaaaagagttaaactccatggtccagcatgtaaatttcttacaagctgggctctttggactgctctagtttcatctctactattgccaaagatcctctctccacccatccccaccctccaaaaaaaaaaaaaaatcacacaaagagacaccccgctctacccttactctgggatccagtaaccccgagccatttgtaattctttgtttctttgcctctgtaatttttggtttcctccagacagaatgtgcttctgtttcatccagttcgccttcctcacttagctgatactacagtctagtggagatgcccttccttggtgctgccacagccctttgcccacctgtgttgcagcatcatcacgtagcattgtgatccatcctttgcaggtctcttccccaagagacttaatagttccttgaggacagacagcactgtgtcttgttcattgatttatcctagctgtctaggacagggctggcacacatttatgcttactaaatgtttgtatgaatgatccagccttgcagatttggcctgaaaatctaacagggaaaaaatagcttctgacccccccatttattccctctcaactaagagtgaccttagataagggagggttgctgtcttcctgagcctgccagggtttattgaggctgactgtacccacattaaggaaaggtcactgaaaaccttattagcacaccatccttgccctgaactgagatccatgataagcatggcacaggaggaagagcatgaggctctcgtgtgaccagtttgttagagagtacaaacttccgcttcatccagaaagcccattttggaactgggtcatcacagttactaagctcactcacagaagcaggagggctgttgcatcttcattctattctctctgaccaatccacctccctagcccttcggcaagaccacttggaagttggtagccagcggggaatcatacctgtggctgtttgtttgttttttaaagaaagaaaaggaggggggatattttgttaacagttaataaaataatacatgtagactgtagaaagtttggagaatataggaaaacacaaaaactaaaatgaaaaaatccttcgtatatattatagagcctgcttttatatctaaatatattgtaaatgtttttccatgttaagtattcttctatagtctgattttaatgaatatataatattccatcattttgatagttcataatatattgtaatcattctattattatacatttaggttgctttcaagtattttcaattatgaataacagtacttaacaggcaacttttttttcttaaattttaaggcactgcatgctcaatacataagctgtagaagacacagaaaagaatgcagaagaaaaagattttctacaatcccataatctagaaaaaccactattagtttgtcttttcttctggtctttctaggagcatatatgatggcatgtgacacatagtggtgtataccccttgttttccctcctccttcctccctccctccctccctcctttccttcttcccccctccctcctttttcttcctccctccctccctccctccctcctttccttcttccctccctccctccctccctcctttccttcttccctccttttcttccctccctccttccctcctttccctttcccttttcttttttggtacagactcttgctgtgtcactcaggctggagtacagtggcgcgatcttggctcactggaacctccaactcttggactcaagccatcttcccacctcagcctcctgagtagctgaggcatacaggattacagtgactacaggcaggcgccaccacacccagctaacttttgtatttttttgtagagacagggtttccccatgttgcccaggctggtcttgaattcctgggctcaagtgacccacccgccttggcttctgaaagtgctgggtttataggcgtgagccaccacacctggccattcttttcaaccactattattttatggacattttcccatatgattaaaaataatctaaaatataattttctgttgcctggatttgctgtaatctctctagccattctcttagcacatgtttagagaagtgtgtgtgtgcatgtgtgtgttgtgctgttataagtaataaaagaactatcatttaaaatatattaccaaaaaaattgtcacaatatttaaggccggtaaaaacatagtaaaaatgattcatgcgtacatttttctgcccttcgttttaattttctactttttgtagtaactcattaaaaggcaactttcctgcattcattcaatcctatatgagtttatgaatttacatcagaggccaggtgcagtggctcacacctttaatctcagtactttgggaggccaaggcaggtggatcacttgaggtcaaaagttcgagaccagcctggccaatatgatgaaaccccgtctttactaaaaatacacaatttagccgggcatggtggcatgcacctgtaatcccagctacttgggaggctgaggtgggaggatcgcttgaagctggaaggtggaggttgcagtgagccgagatcacgccactgcactccagcctaggcaacagagcaagactctgtctcggaaaaaacaaaaaagaatttacatcagagaaacatatttctgccaggaggtttgctgactgagcatcttttctctaaaatttagtttttagggtttctgttttgaaaattataaatacagccttaatttgagggagtttttttaacaacaaattagggttttgtaacattatggactgcttttcatggcttataataaagcagtgccatctgtacaaaggttattttaaaaatcgggagtggctgagggtaagaattccatcagggtctcaacagagagtgaccagtggcattttatgttgtagctttgggtgccttgtcgtggattcccagctcttcagcctcctcgtgtttggggccctctgttctgttgaaaggttcatttgagaaacctgcctatttcatgctgtggctgctgtgtgatttgggtacagaaggaatgcgcatcatacctcttttcagggcggcccaaccattacttaccacattttccaagctctgcgcctgttgcctctatcagatcattcctaatgccatgatgacttctcgcacaaatctaaaccagggaccaactttagtggaagttatgccatattccactctctactcagtgcctgacttatatatattaggcaatgaatgagtgaatgaatgctgtctataacacaaatgagcttaattattatctcattttgacaacagctaatcaaatgtaaagtataatcactgtgtaacatacactttactgaaaccattcccagggatttttttccagaaaagtacttactagtataggaagtcacacagaactggattcgaccctcatctactttgtggctgtgtgactgtgagcaagttagcttttctgggtgtcagttttgccattcggtatctggggatatgatggtaccctatctagaattacaatgagtaaataagcaaaggcatgtaatgctcctggcatttggtaaattcctgaataaatggtctccactactattaaaatatttaccactctacttctaatactttgatcggtttggtgcacagcagtcaatgtgcttgcacctaggtggatcttgtagttgtagttgaatagattcagtcctcttcaggattgctgggcttccatgtaattaattgtgtacaaataattttgcttccctcagcctgacccaggtctgctgcaaaattagatagccgtgaagcttttccacagaataggagaatctggtgggccagacagaatcccatggcagagtgaagcaagaagaagggctgcttgccttgcacaaattcttgctttactctctctaaaaacccctcggtttcattttcagaaacattttgggaaaaacttctcagtgaaagagttgcttcgtcactaaaggtaacttgagagcagaccagtttcccgtctgtctttgttgccagctctctagttgaaaggttctgctttgtacccgaaggaggctttgaacatcagctgtctggaacaatctctggccttatcgcttattttaatgttccttgcacagggtcattcttggatgtggtgctctgggcaatctcaccccagaatgcttcccttcctttatttaacctctgacctgtggaaacaagagttaatcaagagttctaaggtagctaagaggaaggggaagtgtttggttacaaattaaatatgaacaagtcataagtcataaatccccagtagtgccaccagttgtgtgtctcaagttgcatatggtacagagtgtttgggttataaattcaagttcagagctctctgatcgctgggggggtaggtgcgaggttcattttattttgggctaaaactctgcctcctaaaacattacttttattggactagcttcattcatatcctactttctctgtgtgcccgtctctccttcttcctttctttacctgcctgcctgcttgtgttgattggtgtgctgttctgtgaattgagacagaactgcttccctgaaagaagttaagcatatggaaaaagttgccaaggaaaggcattgaagcatagagcgtaaatgggtttaagagacagccagacacttttatagagagatttgcgattgaatgatataacattcaagcagagatctggggtggaaatgaacttaaatgagtactatttgtggaaagctgatgccctgtctaatctagcatttccttaattgtcaccataagcatacatttaaagctttatactttaaattaaaaaaggcaacacagtctgtttaagaatctaagacataggccatagtttttctagaaaaagttcttaaaaatatgcatttagggtatagcagaggcactgggtcttgacacgaaacactggaaacttaaaatactcttctgctgtgtttgattaaaacattttaaattgagctatttatatttgtgtttctgaatataacatgtacactaattcctgaagcaataaagagctgacacatgactagtgtccctggagctggcaaagtaagaaaacacgctgaattgttgggaggcagccagagttagattgctcagaacacttggagccgaggggcttttggaggcaagctttcctttatcttatcaagcactacagtgagaaccacaaggtaaggattttatatcctaatctcaggatttaycattgtacgtgatcatactactattgtactgtttagagcaggtcagactgagaaatcatgctggactggttttgtgtctgatctgtggttttagtagctgtgtcatcttagggaaattacttcatttctctacgactcaattttctcatctgtaaaatgggataattcatctcacagagttatgaagagtaatatttcaaagcacctaacacttgatacctagtttccccccttactgcattagcttctactctctagccctaaaatgaggttaatatcaaatggcatctgactgggatcattgatttttttgtttattactgcaagtaggacacggatcctcatgtagccatttcttccttttgttgtgttttttttttttctagtagagacagtgtatttcctaggctatgaaagctccagtagggtgggccttagttagaacctcactaacccattacattatattacagtagtaatttaaaccataaaataagatactctgaatggggaaagtcttgcaggtgtgtgaatacaggagtaggcagcatcataaactctcctaggaaaatgatgaaaggcctatgtgctcaccctgcctgggctcaatggaaaatattgagaattacactgaattgtcagtgcaggtgccattattccaaagatctcatgttaccracacttcaccggtgataacagaaaagtgcctctgtgctttcctcctgagcaatctccttcaatcaaagtaatactctcatrgaaataagatgacaaagccactctctaaaagcaacaattattgaatgcccatcaagaaagaaaagagccttgtttccaaaatcaaatccaagtgtatgtttgggtagatttatataagcacagatgttttatgggagtttttggtgtttcttcataatgcaaattaatatttctactcattcagtacatatattttcctgcatagatataataggtatcacaatgggacattaattatggacataaatcagagattcttgagcttaactaaatatcgtaatcaatttacagtttgagattagcagctgtgagcaaagcagaatgcccagactgggtgagactggcttagagctcccaaagaggattgtgtttttctcttattgaggttgctttgacttttgatgttatcaaagagtacggtattatcagggtgaaacaaattgtactcagtttcaggcactgtgataggtgcatttacatatgtttcagcctcaaaagaaccatgtgagggtagatattcccatttcacatgtagggaaggaagagcatggctcaggccacagccagtaagtaacagagctggtactcaaacccaggtgggtctcctgactttgcaatcagtgtcaagctgatcagtgaggtgtcacttcctcttggaagactttctagaatctcttctgtgttccctttgtgaacctctatcaaagcactgacccagtgctgctgacattatctgccagtgtgtctgctttcctctttagactgtgagctccccagatactgagacatgggccttattcccccatgtacctagcagagggccaggcatatactggtgggtcttaataagcatgggaaaatatgtgggtagatgccattgatggaacatttgaaaaatgaatcatctagaaatgtgtgatgtttggactggaaacgtctcagttttaaattctgtaaaaatgttcattgaagctaaatgtggttatctcaggaagatgaggtgtgcttttcccttagggaggaaccacatataaccttggtgctaaggttgtggtttgagaatcatagaccagcacacatgagtgatttctgttgtgcttaaaggtgggaatgcttgctggctgagtataataggggagaagatgtgtcttacagaaggcagtgcagttgggctctggggtctttcctccttctcacctcgagttaggagggagagggaaaggaatgagaagtataggagtggaagagctcatgtgaaagcttttctctttggtgcgtttggagagaagagtatcttctgaagagagggacagaagaggaaaaatgtttggagcagactggagggggtgggcaacaggaggcctgtggcactgcagattagaggattcttgaacaattttaagggttcacgtgtgcttgaaaaattaggttttcagatgattgtcatcagcctggttttgtgaactttttacatagcaattgaaatgggaacaaaaagagtagatggtggggtttacttgtgttgaggagatgggcaaagggcaagaaatcttgtttgtaagtattccttgatctactttgaataatcacttgctctatactcattatttatcccagactccagcaggacatttgcaggaattgttttttaaaaaccaggtcattttccaaacccaaatgctgcctgctaaatttggatccccacgtcccgactagagttggttgactgttactctgtagctctagtggtaattaatggccttaatagaacctatagagatgagttacgtctgtcaaggtaagctatgatttattgaatgtctcacatgtgccaggaataattaggggttaaatagtcaatacacagtcaccgtccttgatctcatggagttgacaccaatggagaagacaggcaaacaagcacgtattataaacgatggggagttttaatgtctagtaagcccaggaggtcttcatattctgggaataaaatgcatcaatttaaatggggaccaaaagctcatagtaaaaatgaggaaaaggttaggattttatctagaaaaagtataaaaaagtataaatttacctcaacaaactctgtctcttaattccaacaatgcagtaattcttagaaagaataatgcatcaagtattgtggggagaggaggttataatttttctgacttaataacagttcatagttgactttcacagcataatcataaaaggagtcatttttttccaaaagtatttgaggacttcagtttcccgaaggtctcttttatcctttcatattgaaatcattttcttttgatgtgactgttgtgttactatccttgtttttcttgatttttctcttcatgtcttgttaagtggtctaatacagccaggtcttcatttgtcagtgactttgcctcaactctgtgcaggtatccagcatgtccaacatgggcttcataaaatccagtctcctttgcaagagttgtagttttagttcatggcaaatttgcattttattatagatgtttggctgagatacagacagaggagcagggatagatgctaggtgaaacttgaaagggtggataggggacgtattgtctggaaactggaagggtggagaagggtcatgttgtttgaagcagtcacattgttggtgagtattttcctcttataagagcttctgttttcctgcccattctggttgaccacatggtatgaggaatttctgtagaattctggaggagcctctgacccagacaccaggaatcaaagagagattcccaaagctgagattgccaagggggacaggaagcgtgttctggattggtggctgtcatgtccatcaggtacattagcaggtggtgtatatcttttcatagaggaggaaactgagttttgggaagaccgctttctcgaggtgtcacatctagaaaggagcagaactaagattcaaactcggggttaccagactcaagccagtgttctccccagcatgtgccatgctgctctgctttttaacattggggaggaggtttttttgttttgttctgttttgttttaataggaaggctttaaatattgagtgctgaatggtcttaaccaagggatgctttgccattggaaacacgttggcaaaatctgctgacagaaagaaagggatacctctcctcaggtattcaacatggaatgtcaggagctcctcagacagtagcaagtcaccaaaagcaactgaaagaccctgtgtcatgttacttttaaactcatcagtcccgacatgaacacaagcagctctgccgcaagtcttcccccgggaggcactgcttcattgtatcatctattctaatggtgcctgagtgttacatcctaaaattttattgcaaattacttttatttttatttctcttttataggagagccagagcattattttggttttgtgaatgactagattacattaagattttgtttttaggatagcaaagtagatgctggttctgataaggctgaaatccactgggctctgctgaggtcaagatgaggggaaagaattacttcccacctggttctaaagccatcgctcatgcgctttcttctgcctgtcatgcagattttgtcagtggaagcccctcctcactggctttcgtgtcctgttgatatgtcctgatcatgtgttgagcactgctatttttttttttttttcctaacccaacacagcatttcccagccccagccctggaatcagacattttttttcaaggagcccaggttcctattactggagaatagtatttagaaaccaatatctgggcactaagtgtgctcattataattgggatatctctgcttccaggccttctcagtgactaaaactagggaaggtatgtatgtacatagatttgtatttctatttattttatctgtctctactttcctacctgtctactgaacatcatgatgccccacagttacattcagttccagtttgacaccgtggggttcattctcattctttccctaactggatttgtaactctcttctgatagtaagatacctggttcccattatatatttaccagcttggtcagtcttgatctgttccttgtttgtaaccagtggccctctgctgcagcccccttcctacacagcgccaccctcctcaccctgtttttacagtagcatgtgctactgtttgaactgtggcaccttaggcagagctgctgctgccccttcctatcacggacagcattctcaaccacatggactctgcctcgcctccctcccctcccccgacccccactttggtggaagccctcccacccctcaggctctgacatcccacattgaactgccttccagatgttctttgtactcttctgggttctaataccattgctggtcaggccctccactccacatagatgctgtctttatcccatgccaggtctaacccctccttgcccccttgagtcatgaaactccaagtcaggcctcccccatgagactccctcctcatcctgctcagacgctgactttcccttactaggcccctcactctgcttgggccccagcacactatgcccaatgacccctcagtgggacacccttctcctcccacttggactctaacaccaggttgccccttcgggaggacagcttcctcccctcacctgagtctgatgtcctgctgtggaccagcattctcccaggtggttgctgccttcctcgacttggtcagcctctcccaccatccctgtcccctgctctcttccatacctaccttgcctggtcccatctcatagctttgaactgaactagtagaaagaggtgtcggagagctcttaaaattttttaatggttttctgttttaatacttaaagaagtggaatccctttatattcacgctgaacttacacaaggccagtcatccacgtgtacacaaactcaccagttggagtgattatcatcccaagtggagtgagattagaaaaggcagtcctctgctctcagttcagctcaagagccagcagctcacccggtcgacagatttagatgcaggatgctgtcattcagcctgaccccacaactcaggttaactactttgtgtttacacagaccatgtccgccatatttggaggtaatttaagggctttttcagggtgattttgactatgggctgttgctgccataagtgctgtctttagaacctgcccttgccctccttacaagggccggtgggaccccggatcgggaaggcagtgggtggaggaaacttctcaagtttaaaacttattacctcatatgaaacacaagcctctccatttgactctcaggcctgggagtgagggtagagcctgggacagagttacctgagccacagtgggtgagaagggagagaagcctggatccaggcaggtgcctggggagcaggctgttccttttcgcttttctctgtcttctgattgggtcatgatgatgctccatgatcatcttctacatcagtccgaaagcctaaactaaataaagcacttgggaaggacttccagctccttccacccaaactgttactctgttgtgggtgtgtctctttctgatgaggaccatagctttcttgagtgcaggaggaccctttgtgccacagccttggacagagcccaccatagtcccaactgtggtactccgcagtggggactcaagccgtcacacaaaggcagcaggcagaggcggaccacggatggtcgcaccccgttagatgtccaaggtggtgcagtgtactagagtgtttgtttctgtctttggactgggaaggattgtttattcaatgatgacagacacacgcagactggagtgcagggtccctgcagcctcacctgcagcctagcaggccgcgcaagctgttgtggcggctctaatgaagcaggacaggaaacgccgctggatagagctccgctgtgaaccctggcctcccaacaggggaaaacaggggccctttgaagaagaagacagctgggtttcggtttcaaaaccttaacactgccatcactagatattcatctgtgagtgtacaggggacaacatgtggggaacagttgtgtccggtcaggccaaagggagaaagaaatggctgatttccagggtaactgcaaaacttcttgtggccagtggttctgcttagcatagccaaaaagaattgacttggtgaggctgaggctgaggctgaggctgagtgtgagaaccagggtgccatctatagtaggctaggagctccttcccacgtcacctccttcatcctcacagcaggtgacaacttggaggctggagcttctgtgcccaagccacattggtcagttgaacctactcatccaaaactacttcgatggattctgtagtcctaaactgtcagagcacccagcctgccccatatcacttcaccaaatatttctaaaatgattcagtttttctcttgtttacttgaagtcacagttttcttgcaagattctayttccccttcttgccttttcccccctgcctcctgactttcagtggctggatttaactagtggtattttgctttcaggaaaaaaaaaatttgtaatccttggtcaaatttgtttactgagtcgtctaatctgtgcaagagttttcttctgaggggatttctcgttcatactataatggcttttaactcggccgaggtttatttaacagaataggaaaggagaaacttatctgctccctaatccctcttgaatgtttacattactctgccaaagtaaatgctgtgcaaagtggcagcagtcatttgctatgtaatagtcaatatgcagctgccagggctgattgaaacatattaacataagtgataatactgtcatagaagtgaaaagttaagttgcttatcagtatattttgataagctacttaaattttacagtagcatgtgctggctttagacagacgttaatgacagaggactgtgcactttatctgttctctttgttgcctctcacttcatttattaccctcagtggcgcagccggtaatctgtacagggtgctgattcccctctccctggcaggatatcacatctgtgcgctacctcgtgtccatatctgtcggtattggactctgttagcacagcagggcagacatgaccaggccggcaagcgcttggtacaaccttcttctcgcttgctgttagatgtagctttggaaaatttccttctagagaacaaagccgttgaaagtaagtggcaaaactgcttgggggtgtggatacttttcaacaattccataggatgcgtgcacccttgccgtcagtctttgtctggctttatttgctcagtaaacgctgagcactgacggtgtgccaggtgccattcttggcaccggaaagacaaagtgaagaaagataggccccttcctctctgtttgcatgtggtctgttgagaaaacagacatgccattgaggactgcatcatgtggggaatgttctgagagcagcattctcatgaccagggcagcacagaaaagagagaattagggcacatgaagtggggatggggagggggtgagggacagttaggaggatgagtagaaatcagctagactagacccacagaggtctgggagaaaagggcccagtgtatgtaagcccaggcaggctcaaagataccaggacgttccggagtgagaggagtgaggggagcatatctatgaggaagtagacagaggacaaccagaaaagtgggcaagggcctggcagtgaagagccccagaagtccatcctaacaaatgtggactggatcctggagtgacggacatcattgcagcaattaagtacaatgtgcgatggagatttgcattttagaaaaaccattctaagagccgtggccaggtggctcacgcctataatcccagcagtttgggaggccgaggcaggcagataacctgagttcaggagttcgagaccagcctggccagtatggtgaaaccccgtctctattaaaaatacaaaaattagccaggcatggtggcgcacacctgtagtcccagctactcagaaggctgaggcaggagaatcacttgaaccagggaggcaggggttgcagtgagccgagatcatgccactgcactccggcctgggtgacagagtgagactccatctcaaaacaaacaaacaaacaaacaaaaaacaagccacacagagtggaccacaggactgaggtcagcagccagtctgctctgagtgaaggggagcaatggccaggacctggtggagggcagtggggatggggaagtggaactcatcttgaagtagatagagagatggtgtgtgatgggtagaatgtctgttgcagcaacatggatggctttgggctcatgggggcattgggaccctttgcagatgcctgcagtgggaatgctgtgtgtgtgtcagtgtgtgtgtctgtgtctgtgtctgtcccatcatgagaaactgaatagaagctttcctggaaagggtgggtgtgctgggagaggccaggggacttctcagagatggtgcctgattgtggagtcggctttgaatttcttctctgtgaactgttctagctctgaggcatgggaataatttataatggacatttaatcctctgccttgcacaggcaattttttaaactctcagaaataattagcatttcgccagtttgtgtttccaccagtctgtgacaggaagactcttcaggatgtagagcaaaactgaaatgtatcagtcttgaattagatcctggttaaagtttttgacctgcatactmatatttcatgtgtttcctcttcttcctccagctatctcccctggttcgaggtattttataagctgcttaacatcctggcagattacacgacaaaaagacaggtatttacctttttaaaataattcttttaaacaaataagctttaatttttatgatgaaaaagtaaaacatgccttatattttaccaaaaaagtgatgcatgcccattataggaattttgggaaattcagaaaataataggaaggaaaagaaaatcacttttaatttgccccactcccttccctaaaataaatattcctagcattttgggttgttttcttttttaagtttttctttgcattaaagaaatgataaatagacccttaacgttcacagagttaatgttcaatttctaatattcccaagcagcccggaaagtttgtgacatgtattaaattataattttgctgaggcacatatctgaattgctcatgtcatgctgcagatctggggtttgcaagtaaaacacttaaccagcaagtgacctacccagctgtmctgagttcccatttcaataaagctttgtggtgcttttacagtaacttttgtaggggtctgaaaatgacgttaaaaattcatctgtaccttgctgtacttttggaagaagtggtaaggtaaggtatcttccatggatgtcaaaggccagttggacctttatgtagatttttgtagcccacattttcagataccattataatgagcatgcctcccacactattaaaaatgttataaatatttttcatggctgcatagcattttgtcatgtaccttgatttaccaaagcattttcctattattggaaattgttaattgtttgggatttttctactgttatgagaagtgtaaccattcgcatctatgagggtaaagcattttcttcattttggattgtttccttaaaaggagaatcccagatgggccactgtaagatcagtggacataaacatttttaaaacatttgtcaaactgctttccaaaataattctgctgttttcttaaaggataccctttaccagcaatgtaagagagtgcctgggtcacgatactctcatcaggatcatttgttgaatttgttgtttgacaagtaaaaaagtctcattgttttaattgcatttctttgattattaatgagttggatatttgtctatatatctaatgtcttatatttttctttttgtaaatggcctaagatttttaattaaagtgatccattattattaaacgttaaggaaaaatttcccttaatttttttctgttgaacgttctgagcaatttgagtgttagttctgagaaatggtccatgaaaagggtgccagttcagccacactggggtccagggaagggaaagctgtgtttcattttcatctccttaagattcatttaatgtaagctctacgaagtcttgcattggagaaacctgggtcgcctgtgcttcccatcttgttttgccccaaacccctttaattctgtgataaatcttagcattctgagatagcagtgtttcctggaacacactttgggaaatgctgttttggaggaaagggggaaattgtgtgtataatgactaaatcatttttttagagatagatttactcactggcaaatgtattccagaggtcacagtaaatggaaggaataactaatagaaacggcttccttgatcactacactcactgtgaaaagaagcttagatgtcaggggattctgtcgtaaaagaagtggattactctttgatgaatgagttaggaggtcaccttgggtctgttcatctatttctgattcacagttacctttagtcaaacattcaggttttcactcaaatttgaaaggtgtctttaataaacagaattgtataatatgtaggctcttaacaggtttgaattggagattgactcacattttttccctccatatgttccagtccaaaaaaaaaaaaaaaagagaaaaaaactcagcaaaacaaagaacttagtacactttttaaaacatgtgatttgggaaagattataaaagggtaggtacaacctacacatatgggagattggattattaccgtgtaaaactggtgaacctttcctctgggcgattgcttcagcaggactctgcctcttgggatgtcggactgagatcagtaacatgttttagttggagtctgtttctcttgaacccaggactcttttcttccccctttggttaaaagaattatgacacagatgataggaaatctgcctgtaattggcttaattgtttgcaaggttttagtcaccagattagaacaggaagagattttttatttaaagaaatagaatctacctcctgccccagggctgaaaccttctctcatccaaaagtcattgggaaggttgggaagcaagataggcttctattgtgtgtgtgtgtgtgtgtgtgtgtrtgtgtgtgtgtgtgtgtgtgtgtgagagagagacagagacagagacagagagattgtgatggctaagcatggggtgtgggagaccaaggtgtgagtaactgggatatctgtttgggccatggacccatcatgctcatcagaccttgaatgggcacccttgtggaagggatggcagggcaaggcaggcatctgagccagggagcagcctgcctcagggtgtcggagcctgagggagagaaggatgtttatgtgggagcatggtggtagaggctcagcatgggatgtcagaactcaaataggatctagaagaatccatgtgagaagggaggcagcagctgtggcccagtgctggtgtgttggatcctgaggtaaggaaggcatttgtgtgaggggttgggcagtagaggcccagccctggatgtcagtgttggggagggaagggagggcatctggacagggaaggaggcagggatggcaatagaagagtggttccatacaaataaccaaatataaaaagaaaatacaggcaaggtttttcactttcgtaggatgaagtcacagatatgtagagggagaaaactagaataatttctatattggattggaataggagccattggtgtgaacccatggttttcaatatgggaagatgaatatagaaataaatagagatgtgaagtgcctattgtgattccatgtgtgtgttatatattccctggctcaattgactgaaagggcctggcatgagcaatactaaggagcagtgagcacacatggtgcccagatcttggtttctaaataccattgcccactaaaaggaacccagtctcattgaagaaataacctgattctggggctgaggcagggaaagtataagatgaacctgaaatatcttttctgccaaaaagtaaggaattgctaaaaacatgatcatgatgggaacatgtcagaaggacacaaaagcagtaagagtgctccctctagtcatatctggaacaatttgagcatcaaaacaaattaggatagtaaaggattatgtcacactgaataaaacaggaaactatggacccatggtaaaataaataagtaaatgaatacattgaaagtttgaggaatgggatatttacacaaagtgtgaatccacaaaatggttatttactgcaaagagaaagaataatgttactgtagagatatcaagtgaattaatcaattgatgaaagcaaacatcatgagtgaagggacattgacatcagacattagacaaaacattagacaattgaaagttattctacaaaatgggtggtctcatcgtcaaggccatacaaatctagaaaagactgaggagctgttccagactgaggatgagtagagggttataactactaactgcaacatgtgattctgaagtggattgtttgctgccaaggatattattggcacagttggcaaaacttgaggataaggtggtaattctgcatcagtgttaatttccagattattatgattctcttagtttgttttctgctgctataacagaataccacagactgggtaatttataaagaaaaaagatgtatttggctcacagttctggaggctgggaagtccaagagcctggtgctggcatctggtgaggaccttcttgctgggtcataccatgcggtactcaagacaagagacacaagttaggggccaaatttatcctttatcagaagcccactctcacaataatggcattaattcatgatgtactcactcttaaaggtcctgcctcttaatactgttacaatgatatttaaattgtcaacacatgaacttttgggggaaccatttaaaccacagcaataattaattgtggtgatttaggagaatgtccttgtttgtatctgtggatgatggggcgtaatcttggcagctcattctcaaataggtcaggaaataataaaaacttttttttttcaacaatttctacaactgttcagtaagtttgagattgtttcagagcaaaaccaaacacatgcacacacacccacaagttcatctctctcctctctgagaagcttgtttgatttgtcagagctcagattgaaacaagcttgtagtctgggtgcatcttctttttcctttcgttaaattcactacttaaagacagctgtagtgaagccaggagggctctggagcttgcatttcaccctttagctgtgcaacttactaaagggctgatttgagacaagttgcttcaccttttggagcctcagttttcacattgttgaagtgggtagttgggaggatcaaatagagggtgaatagatacaaatatacacttatcagtattagcacaaagaattccacatggtgggagaaatagcatttggataattctgtgagcagtgttcttttgagcattttagaggtgaatccattttcaatcaaataatttgcattgctttgtatgtcatcatgttgctcaatttcacaaattagaatgcatagccaccatcctatattgcatgctgttgtacttagttcatttctaactttcyataattggaggctgccatgtgtatccggtgaacactcaataaaattaattgagggtaatgatgatgaagacaagatctatagtgtcatcgttatttctcctaaccacccccgccctgtaagctaggattgtttgcatttaaaagttgttgctatggagtttaggggatagatttgctgagagcttatggtatatgatccataaaaggcggtcatggtaggtgtctcactgagtagaaaatgtcaaacttggtgtaggaggatctatttggctctttatgtttgaggcatacgtggtgtcttttgtcaaaccctacatgaatatcaaacctatttctgtactggggccagcatctccccagccccctcagtcrtgtgtgcccagacctccctgcaggtatcttactaagggctcagccttgcttttgttacttaggccttttatttctttcaggaaaatcagtggaatgagcttcttgaaactctgcacaaacttcccatccctgacccaggagtgtctgtccatctcagcgtggtaagtggggcggagtattagccatcactgaaaacgcatttcattattgacagtaagagggagctagctgaacagkattgtattttgtcagccatacctcccctaaccctacccccaaatactctgagacctctgagttcaagataggccagagagtagaatttcttcctttctctgagattctataagaaacagacatgtcctgaatgtccccaccctcctctgtggccatcatcccatcaccagcatctcttggatcacagatgctgggctgaaataggacagctggctccgcctgcttcttcagtccctgtcccagcctgcctgtatcaccctcgtcccccagcactgctgtrcatgtccctttgctgaagcccatcctgtaccctcagctttcaacattgcctctcccctgtttgccagggtaacacatattcatccttcagaactcaactctgattttatttccagagaaatcctcccttgatacctcgtaggttttgctaagattacctcctttgctcgaagcatcttgcacactttgtggtacttagttacaccctattggaatgattccttttcctgtccccctcactggactgtgtgtcccttgaggacagagcaggagagtgcttaatgttgttcctggcctatagtaatagtttctttgaatgcctataaatatatactgctattacatgttctgcactgtgctctgaaataccaattgggagatttccatcctagtcattgtcttgccaatgacctgagtgatcttaatcaggacctttaacctcgtgggcttcaatttcctcatctgtcagataaggcatcagaagaggtgtgggagatcttttccatattttggttccaggaattctctaattccctaggtcaaaccctcaagcccttgtcaccaccttcatcagaattctcagatggacatactttgaccaagtattgattattatccaggagctatttcccttatgtcatggggcctgaaaattttaagagttttgtctttcatcttcattagaaccaggtacagtgttggtattcagtggtagaaaggtatctcccctcctaaagaaaattgatattccttgtaggttttttcaraatgatgataaaattgaaagcagtgttactaccagtaattaataatagatctactattttaataaattcctaatttatactaaatatgtatctctaatattcaaaacaagtttacaaaatagatattaacattcccatttcatggatgaggtttcaagaggaaaagatacctgcccttccaaggtcgtgtagttaataagagataagacttgagttttcaaagccagggctaacttcaagcctatggtctttccactgtgccattcgtgtggaaggagagggagagaaggaaggaaggaagaaaaaatgaatttacagagacttttgcccattttaatagagcataggaaagaaagaaagaaaccttgttacaaaaattctcatacggcaggggagaccatctggaaaagatgaaaaaatgagctttaaacctgccccagtccttgctgtatagctaagcaaccctgcctttgtctctgtcctttttcctaagcagcttgatctcaccacttcagtccgtaatgacatccgacaggtagctgtggagtagcctggctgggtcaccagctgctagggaggaaggtccactccttccttcaaatggctgctcaggcagcatgcatgccaggcctcaaggacaagccatctcaggggcagcaggaactgctggggtggcgcagctgtttcatgccagtggtttctaggaatgtttctgacctcccctggtccccagcatttcatgggcaatggagcaagacagaatctcaaaggacagcctggggactacttggttttggaattgtgttggctcactatttactatcaattgcatctgtaaaggcagatttttttttctttccttttcactgggaattcctctctccatattgcatttctgattgtgaagggctactctcatctaggttatacatcctgaaatgttgataaaatggtaatcctggactttttgtctctagtcactctctgcaagagtatatttctgtgtgtctgatatgagtgatggtaaaaatagtaatatgaactagcagttcacagcaataataattttgtattaaaataccatttattgaatggtaagcatttcatatatataacatttattcttcataacagttttgaagtagataatatgattcccatttatagattcaaaaacaggttctgtgctattaagtgaatttgctgagctacataatcaccacatggccatttgttactcaactaaacttctagccctttggtatagaagttggtatctcatggagtcatactggaaccttgcatattacttttcctgttttaatcctcactgttgaattaatcactagttcccacgctacaccgtctctactgtaatacttcataggtagtattttgatatacacacagattttggaataatgcatcgaagaaggcttttttaagttatcttttttatactttttattttttacttttttatttgttcaagcccctttagctgtcatttgccataaaaagcacaggtataacagtctgtcatggtggaaagagcacagctctagttacacagatttagttttggtccatattctgccacgtactagctgtgtgacctttgactgactacttgacctctgtgagcattaatttacccatttgtaatatggagataatatctatctcaaaatttgttgtgggaattagagataacatttacagagtactagacataatgcctttcatgtagcaggtattcaacaaatatctgttgattattagacaagtaccttatactattattgttgtcaccatcatcattacgattgtccccagggcctttcatttcagaaagcctatacaactcattcttctacacacctacctattttgcaatcacccaagagtgggggttggggtggataacttcctgaaatgtcacttgggggtccagatttgaacttaggccatggctacgctgaccttctctgcatgtgacctttcctggcctttgcacaatcccatctttaattggccggcaccaagctctttccgttcctgcttgccattgtcttctgagtctttaatagcagcaaaggaggtgccatcagttcagcctgttgtcatttaattcagggatgcatgcttgttgcatatggagatgcctcattggacgttctttgaagaggtcaatttttcaactccgctgagtctccagtcaggaggcttatggtggagtgggcttcgggggcagaatttctccactcttagtcatcggcaatggtctcagctccagtgctccagcaactggaactcttcctaacatcacttaggcctttggggcagattttggccacattttatagatgaatataatctcagatgctgaaatgagatgacaggtttggttggtaaaaataatcactgagtgaatctggtgatattttgttcctagaatacacttgcctcactgaacaataaattatgaaaccaacgcctttttcatgtgtttagccatttaacttctttgaactatttatgtatttatttagagacagagtttcattcttgtcgcccaggctggagtgcagtggcacaatctcagctcactgcaacctccacctcccgggttcaaacgattctcctgctttagcttcccgagtgtctgggattacaggtgcccgccaccacacctggctaatttttttgtattttcagtataaacggggtttcaccatgttggccaggctggtctcgaactcctgacctcatgtgatctacctgccttggcctcccgaaatgctgagattacaggtgtgagccaacactcctggcctgaactcttcatttatatctcctaaagaagttctcctctcatagaaaagaactccatctaccaaagtgatgatttaatgcatctggttcaatctgacattatccaaagaaaatattccatgggtgtttcttctgagtgaaaccgtttccttttctgagtaaggaaatattttccaatcatttacctgaattctgagtaatgcaattgttacacattttagcagaaataaatcacttttgcttttcttttctagcattcttattttactgtgcctgataccagagaacttcccagcatacctgagaatgtaagtacttgggaagaagaaaaaattaaatttttattcttctctgttttctgcctatttgtttgaataaataaaggatgtgatttaaaagtatcattataaaaattatggtttttaaaaaacacattataaaaacaaaagtataagaactgaagtgtattataaaaacaaaaacaaatagagaatatttgcaaagtatagaaagtataaagacaaggaaggatttttattcctttttctcaaaggtaattatgtattaatatgatatttgattccctctttttagaatgtatttttacatagttaaatcacctattataaaaacatcttttccattttcattcatatgacttatttttgtcaactatctaatattccatttactctgtagtttagccattctctcactgtagaacatttagattgtttctcatttctgcttttataagtgaaatgtttccatataaagaattttccaaatagaggtttattagggtagatctactcaagcagaattacacttctactttttacctttgtatatttacctttcagagaataaaataaagtatttgtgggtgaagcatgagggcctccatccctacctccaaaggatgtaggagcagtgaactagagtgtgagagagcagaaggttgatgtttgccttctgaacaagctgaatgacatatctagtctagctgcatgacatgttttcaaaatgttttactatgattataaatagtactatgtagaatcagataaagaatgtctaccacttagacacttgattacttttttaaaattgtggtaacaaatacataacataaaatttaccatgttaatcatttttaagtgtacagctcagtggttttgaatgcattcatattttgtacagtcaatgtccagaactttttgtatcttacaaaactgaaactctgtactcattaagcaattccccattaccctgtctccccaacccctggcaaccatcaatctgctttctgtctctgtgaatttgactgctctccatatagtacttcacataagtgaaatcatacaatatttgtccttttgttctgagttatttcacttagcataataccttcaaagttcatctgcattgaagcatgtgtcacaattgcctgcctttttgaggctgaatgatattccattgtaggtgtagaccacattttgcgtatctgttcatccagtgatagatgctgagatcaatagatattgtttttaccctttggctattatcaatattactgctttgaacattggcgtacaaatgcctgtttgagtctctgctttcaattcttttggggatatacttgaatacttgataagaaaagtactggaatatgtggtataccttttcataactattgtagattcacagaaaggaaatttttccaagtgtcrtctatagaacaggttacaaatgtcaggtgatcaaatgtaatgaatgaagttaggctgtagtattgtgattagataacagtcttgataagttgggattatcaagcatatccatgtagtatattatctgtatgatcagactgtggtagaaaatgttgcatccttttttttgacattaactaataaaaaattcagaccagagttcccatttcaacaacaatagctaatgttgattgagtactactactcgaaatattatatatttggtgcttttctccattttctcatttagctctctcaacaagcttacatggtaactaccataattatttaatataaggaaacagaagccctgaaaatttaagtcacatattcaatatcctacaggaaataaatggtaaaatcagaattcaaatattggtctttctggattcttgagactgagctcttacataacatgctatactttgagcctgtgattttttacctttcatctctcagaaaattccattgaaatgatgaacgaaaggagaaaaatatttccctaatgacagaggaagctaccatgagccagaaagtttgggaatttacataatataaaggagatgattactgatagttgcagtcaattcagtatagacagtggagaaatccaaaaagaagtgggaaagtaatgcaggaagagcagaagcagaggcatactctggctatgaaggaggctactgaaggattattttaaaatgccatgggacatttataagaactgatcatgtactaaatcacaccaaaaatttcaaaatagagcatactaaactcttacaggtcactgtcttttatggtggtgaacgaaaactataataataaattaattaaaggtttaaaaatattcatctatttgaaatagcagttggatcaaagatgatacaaattgaaattagttattatttagaaattaatgacaatgaggacactaaacaagtgccttagggatgtggccaaaaccacactctggggaaaattcatagctttgaatgcttttatataaataaaaaatttagaaaacaatgaacttgactttcaagaagctaaaaaaaaagaatagtaataaataaccaaaactagaaaaagaaattataatttaatttattagggaatattgttaaagtaaaattgaaaaatagtagtttttaaaaactgaatttgtgaaaagaataaaattttaaacttattcaataaatttaaagattgtgaaaagagaaaattttctagaaaaagacaaatgatagttggcctgagaaataggcaatatgaatatagaattataacttgaaaagattaataaagctctatttcaatctccatccttcaaaaaaatctatcaggtttaggtggttaaggtgtttcaggaacagataattattacttaaacagtaccaaatcataggaaaggtatgtatgtatgtgtatcacacaacagcaaaagaaaaatcaggcataatctcccatctcagagatctgtttctgagttttttcatccttcctttttatgacatgtagttttcaaagtgtgcaaccgggaaccccagtgttgctttggcagccctggaaggcctcacagaggtagatggctaactgatcagagcactagatccctgctcctattttattcagagcaggttagtttccactgcttacactgggggttgagtaatactttgtttgagacagaagtattcttttggttttttttttttgttgttaagtttcaaaacttacatttttaaaagcacacaaaatgtacacactttatatctgtttttcttgtaacaatgtacgctgaacatttacctgtgtcattaaaaattctttacaaatattttgttgtaaaagattaatactgatacatagagaaaaaaatgaaaggcccccattaccaccaccccctccaaccccaatcccactctccctccaaccccaatcccactctccctccagtgtttgatgaaacctttctctaggaatttagtgttatgtgtagctatgaaggaggctactgaaggattattttaaaatgccatgggacatttataagaattgatcatgtactaaatcacaccaaaaatttcaaaatagagcatactaaactctcacaggtcactcttttatggcggtgaacgaaaactataataataaattaattaaaggtttaaaaatattcatctatttgaaatagcagttggatcaaagatgatacaaattgaaattagttattatttagaaattaatgacaatgaggacactaaacaagtaccttagggatgtggcctgtgtgtgttgtagatggtttttaaacataaatatgattctattcatacttgtttagcaactcattttttagtttaatgtattctaaaaagtgttcatatctacctacttcttcctttttaatgacatacttatttagtggtatttttactcttatgaaagtaatgcatattaatggcttaaaaacatgtagtactacatagttgttgatgaaaaccagcaattttcaagttgcccagctactttcaagtttttagcagctgtgtttccctctgtatttttgagtaacttattcatattgctaaatcttattttttttctgttacagatatcacttattgattttcctatagaagatgagagttttggtcttttaccacctataacactccccaccccgaaacacacagaataacgttctctcagtcacatatttcccctctcccattctttctatacctttagaaaatttttacattaaatcagaagttaatgtttacattttaatgagcatactgaagtagttagtagattacctttcctttcttatacaactttttgtcacgtaagcattcttgggtttcacatcttcctcattcttgatttcactccctcattttggtgagacatgcgccagtagttttcttgagaaagtgcttgttagaggcaacatttttagacctagcatgactaaaaataactctcttcttctttttttgagacagtctcgctctgtcattcaggctggagtgcagtggcacaatctcggctcactgcaaactccacctcctgggctcaagcgattgtcctgtctcagcctcccaaatagttgtggctacaggtacacaccaccacacctggctaatttttgtacattttagtacagatggggtttcaccatgttggccaggctggtcttgaactcctgacctcaattgatccacctgccttggcctcccaaagtgctggaattacaagtgtgagtccagcctctttattcttcttttgatagtttgactgggtatagaactctaggttggaaattactctatcttcccaactttgaagatgtttctccactgacttctagctttgctgttgcaactaagaagtctcagccattccgattcctgtgatttacttattgtaaccatcctttggtggtccctcctggtatcctgaaattgcagtgatgcgccttgctacgggcctgttttcatctattgtgctgggcacttggtggttccatttaatatggaaactcatgtcctttagagctgagaacttttcttacattatttctttgaaaaaatattcttcatttttctttctttctctggggcctctatgatagaatgttaaaatatcctgtgctgatcctctaattttcttgttttttctctcctattttccatctctctcttttcgttttctctctactttcttcagcaaatctttccatctttggaaatttacttctgccattatattaatattttcactcatctgtgagactgttatttatagattttaaaaagtgttcttctcctcgtattattttcctgctcaacattcctatcttctgtttgttttattccttaactttcactgtagagcctttcctcaaatggctgccccgtcacatttaagagtgaggcactaaaaagctggctgaatgctctgtcagtcatttctggagcttggaactagtgtggctattttgggggcagtggcctctcaaatatcagtatcagaatctttttctttggagttggtctgttttctttgcctaggtagtgtatgctttattatcagtgttctggaagctgagtaggaatggtaggttatgacatgtcagcatctaatatgtataccttcgtttagtactcattttcagtgtaagcctttattgcctgtcaaaggctttattgcccgtcctcaactgtacctggtgtcaccaggcctttctggttcagttcttctagaaagtaaacacatattcctctggagaggtgtgggaaagtctgttaactagctcattgagctgggagaggagatccttgggattgaattactcctatttttatttgcaccccgtctcctagccttcagagattctgggtgtctccagttcctttttggaattctttttgtgctatgagttgggctgaatgctcggtgctgtgcctgcccaccttatccgtagctttaagctttccttctcaacctcagtcgcatgcttgtcagcttgggccagatcattctttgttgaatggggctgttttatacatcgtaggatatttagcaagcatctctgggctctactcactatatgatggtagcacattcccctccagctgtgacaaccaaaaatgtccccaggcattgccaaatatcccctgggggactaatggccccagcttgaaaaccacttcgttagtcacatctgctttttggctttcaaaaatttgatctctttgttccattactaattcttctcctgttttttggcgtttgtgccttttaaaattcttttactttgactttttctgggaggctggtatcaggagagagaaaagataaatgtatgtttaattcactgtatttaactgttttaactgtgcttttcctactaatagacatttacattttctataaataatgttatgataaaaatgattgcctaggttaggttcattaaaaaattttttttttcttttaagaataaataatttcttaagaacttcattttaaggtacttggaaattctgatcatttctaatttttcaaaaccacaattgagattaggaagtttttttttttaagtcttctcatagccttacctccaaagcctgtctgcactgtatgctacctctcctgcccccactattttaaaaatttacattccttctgctggttttgctactaatgaaccaattccctgtgcatgacccattgtccctaaatcctcctttgcaaaccagtaaaaggctagcgttgtttgtttctaagcagaatggtgataccaatctgccagactcctaccgtacatgcttccactttaatccttagagctactccgaaaggggtagacctgagccccgttttagacagggagcccagagctcacagagctgaggtggcaaggtctgctcgtaagcacagtgtagcgacccaggtttgtaagcttttgttcctgttgtaccccactgcctccctggaattgatgtgttctattcatgaggaaaaaaagaaaagaaatgtttttttaaatatatagcaaattacaaaatgaagcaggaaagcctttcctctaaggagaatctgaacttttgtaggaccaatttatgtggtttttgacacagaatcactgttgagctctagcagtgttgaaatttgcatattaatctcttgatgatttttcaaggattaatttaaaattactaaattgctgcattgcaaattgaaacaagcagtaactgtggggttgttaatcctttatgatctggtgtagtggaaagaacatgaattttagagacaaccagactctgggctttgctaccctgggactttggggcaatgtacttatactcttggagcctctaggtccttatctacaaaaggaaaatgtgagaaactcatgaagtattaaatgtagcgttccaaggacaatgtctggtttgatggagatgctgctttcaatggtctgtttctttttctccttttcttggctctcccagaattctagtcttaacctcccttgagatctgagttgtggctgagggctgaagaacattattcttggagcacatcttttctagatttttttcatattcatggttatggagattaattctcttccttttatggggcatatatttcatggggccttgaaagtgtcttagcaggcccttttcacaccagaatgtctgaagcttggaactggtgtggcagatggagcccagggctccgctgcctgtaatatagatggtttgtaaatatttattgattatctcctctaaggaacataagcaacaaaaaggataaataggctttgggatgtggaacttaataatgttctatcaccagataatcctgttctcctggacagcttcagagaagtgttagtgtgcaaaaagagaggaaggagctggtatttattgagcatccactgtggatcagatcgggcactgtttgttatgttatgaaatcttcacaacagccttatagtatggttgttatctctgttctggagaggaaatgaagcccagagaagtgaggtaacttgccaaaccaggaagtgctaaaaccaggattcacccttcagtgggtatgatctgagcattgagatgctgcctggtctgggccctggctccgtggctctctctgcccatctaagaaattgctcatcatatgtgtaagttatataattaattgaatgaacgtttggtaaaatgtcctctctccttctctaaggacagggatcagtattttttttcacagtagcactgtacccagaacagaatagatgcccaatatgtatttattgactgaacgaatgactgaatgaatgaatgaacatgtagccacccccaggagaagaaaaaagaacaattcctttcagttggcttttgggccaatttgtctgcaagacattaatgaaaagcaaacttaaaaaattaattcttttccctttcagatccccattgaagttaattctcattatttctacaatttctttgtaaaaatattttctttcttttcactgaaaaactatcactctgtaattgctcatcagggttttctctgtctatcaagataacacatgtaggagtgaattttatgcaggcaataattaaatgagcataaatctttataaattttaaacagttgacctgcatttaaaaaaaagtcacagatcatgaacagttatgtagtaataattacattgtaaaccagctatataaaggatttttttttagtgtccaggttttgaagtttacttttgattaatggataatcatatagaccttcatttggaatattaaacaaacctgtcttaattatctcgttggtgtcataccaagtggttaatgatgcgaggaaagcagttagaatggacagttacatataacattgcccagactccactttgtcaaaagatgcgccatgatatagaaaagatttatgaactcatcatgactttcaaacataaacaaagttgaagtggtagtagaagacctattatcaagaactgcgattatagagaattccattgttgctcttaagagttgtcaggtaattgtttattctaatggtttttctattcacatggagggatgaaagttgacctctgagtaaactctgctttcctttctagaatactcttctctgatttgattgcttatgtgaatttctgggattctttcttaagcagattgttttataatccaaatttataattccctttaaagaatccctcccaactaaggttacctaaattcttaaaaaaaaaaaatcagttgagggttttaaaaatttttattatggtaaaataatttgaataggagttatttcagtaaacaagacccactgacaaaaccaagcctcttgccttggaagctgccttcagacacaagacagtaggtctttatcatgtgtaccatgtatgaagtggaaagtcacaaagactaataaaatgacagacagtggggcggactagcatctgtttcgaaggctccaaggagtacccagcttagagtcagttctttggtttgaggattatctcatttccctaaggtattgaacctaagacgctttctctctaagccccactatatcccctcccatccccaccccactccaactccccccatcgccaccacccccacctgcttcgtaacctcaggcatggatcacagtgagcctcaagtccccagccacctggattggtgcaggagccagcagggacagctagaagggagcagccattataaggcttctcctgggaggatgggggttttgccaggtgccattccctttctctttgtctggatttagagccacagggggttcgcacttgacctgacgcttaccaacgtttctttgcagagatgagaagtgggagccaagagtctaaggagcttgtgcgttgcaggcttcttctgaagtgcaccttgcaggctgctctgtccagagaccttcctcagatttgagccctttccagcctgggtgggggatagctttgtagctgtgctacccagccctagagagtgtggccagaagagatgctaggtggagaggcacatgctcatggggacataaatgtatgtgtaactgaaataatgtttaaactccatgagtaggaaaggaatatcctcaagcctaaaaacttactggcactaagaaaaccgagaccttttgagcacagaaactgggaactagtccttgaagcaaggttttcctttccaagtaggtgagtcacacagagaagtaattggcagagaatgaagaaagtggttacttaggctcagccatggtggcattacagcccaggacactaagcctaggaagaggtggccagggacaccatgtttgacagaaattatggtgctttagaaggaggatttatcctttattaaaagaatggactctccctttaaaaacctatttgggcaagtagactagtatggtgcatagtaatctagaagtccaggggtcacttgagatttttttctccttccctccccaagtctaattcatcgtcaagtcctgtgattctactttatggatatccctgacatctacacccaaagcttttgtctgaattggttttctaatgtatattttaatcatttctttcccagaatatggcagcagcctgttagttgactgtcctgcctcctgtttgccctcttatctgtcctccacagagtctctaggaagatttttctgaaacacaaatagggtcatgtcaggatccttcagcactgccctgtccctagctcccctgccccctgctctccctccccgccctgcctctcactctcttccctgcgtgtgcgctcctctccccaccctgtctttgcctctgcctggaatatgcttcttccctggtccactgagtgaacccctgtttggaggcccagaccaaatgtcttctctgtcacactttctccagccttcccctgcatatccgtcaaggggagtgaggcttctcagccatgcctggagtgtagcctcaaccacggtatgttgcatactggatttctgagtctaatgtccctcccaccccagagtaagcaggaagatggagatcacagttagtttatctctgcaggcctagctcccaggagggtgctaggcacatagtaggagttaaataagtgtgtgttgattgcctgattataggagatagaaatgagaggatgaggatttagtctgcaggagaagcaaagtgctgggagagtggcttatcttgtgtcttttatcagcagaagctcataacgtgttctggctgtagtcttgactgaggacagcctgccgcggaagtcctcccttctatcctctgatcttacccatcggagaaatatgcttggcctggctgtgaaatgaacacatgcttctgtgtacagccctcaccccagttacctgataaaccactaatttatttacatttttaatacatgtagccacagctaccatgaaaagtcacccctccctccctccgccattcccagttacttaccggtctttgtgtagcttccagtggcagttctttttctgcgggttcttcaccattactgagtaatcaattgcttcatctggctcagagccaggttttctggagtcacatgctacgttcttcctaatgtcccacctggtccatcttctgggctggtgcattcctcactgcactgttctcgcctgagtgagggaccagcaccctcagccattgcttcctccgtgcaccgagcttgctgtcatcaaactgctggatgatgggagaagcagcttcacctaacaggaccccgtctcgtggcaaaaacatacttaaaactgagttactgtaagatggggacaatggaagcatacaggagaacttgacaaatgaattgaggaagtctcccgggaggaggtgacattggagctgggccttgaaaagtaagcgggtgtcctcaaggaagagtggggcattcgaggcagaggacacagcaggagtaattacaatttccaggtatttcactcaattgtctctcaggacatggcaggcctgagagagtaaggattggtgtggctgggggagggagattcctgactccatggggcgtgcttctgaactgaggcttgatgggaactgcgagtgctccctgcagctgctcctggggccccgctctgccccacaggtgctcccacggctgagcgaggttcccagggctgttggcactcccacccactcccacccgctcaggcgggtggcatcccagaaggaaagaggcaggggaggaagcagataagaaagacagcttctgtttagacacaaatatcttggtaatcagcacagatgggatgagaaataccaaaaaaagtacatgacagtttagagagaatttggctaaatgttacgtatttttaacatacctgtgtagagtttttggaacaagcacctgagtccctcagaatctgattggagatgggggacatgcctcaatcaaatggtgtttttatttcagaaatgtttccttcccatccacaaaagtatccttgtgatttttttttctcccaccaaaataaggcgcaggatttgtctctgacgctgtgtctccctatttggacggcaagctgtgtaacatatttctccccagcgtgaagcttcttggcagactcttgaggccacgttttggtggcttcagagttatctttggatctgtcaaaagtgctaatgggctttctggccttctttaagctcctcatttctattttctttttacttccatcctctcctaaaagaaaaattcatgtaattcatcagcagttaagctttttactgaaatgctcagtgaagggcctcatatttttgtttgtgaggagagctgtgccatgtcaccgtcttcagagcaaaccccacccttacatcattagctctgtgttcctccgtccagtggaggaaccaagatacactggttgactccttccgactgcctttggtgtttgctgttttgtttttcactgagtttgttaagaggcaagttggtgtggtggttagggtatgagttttggattgaggagatctagttttgaaacatggctctcccctttctagctgggtgacctttagaagtctactgagacttcctgagcctccagtttttttttttttatttctcatctatataatggagatgataatgcctgtctcaagcttgttgggaagattggaaagaacacaggaaaagcacctgttgcctgccacatacagatcactccgtgaatggggtaacggtaatttttaacagaagcattttcctttctttaggcatacttgatcttgttgcgtttctttttccaaatatgagttttacctacaattttgtgtggaataaaaagagcatggatttagagacagacccactcaggactgaatcatgtcacatccacttactgcgtgacctttgtcaaattacacaacttctctgtgccactgttttctcatcttcgtagagggataataatacttagttcaaggaacagtttgaagattaagtgacatgtttaataatagatgtgaatctttcaaacaatagatgtgcataagagggacagtgttgtgtacgggaaagcgtataggccatggagtcagatctgactttgccagttgctgacctctcccagactttatattggaaagaataacgcctcactggatttttgtgaagactgcamaattacacatccacagtgtctggtacagtggctggcacttgataggtagttagtatatagagctgttaattcacttgctctgtatttataaaggttgatggttaacttggtacttcagtcaaacaataataaattataagataagtgcccatttttactcccagcccataatattgttgaaaagcactttgtgctattttgcatgtaaaatccacctggtttacttcaatttatgggttatagatctttaatcattataaactgcaacgcctggcaatagcattccttccctcccaaacccctttcattttcagaggattatattgtatggcattgaaaacctgtaacattgaagaaattagcatattcatgtgtattattaaagtcaggtgggtatagaaagcgttgtataaatgaaacacattccattttttttctgaaatctgaagagtaccaatctatagtactaattaaaagactgaagcccaggctacaggggtggaaaaaagctagttaaaacactgctttgtcacaacttgctgctgtttgtcttcaattttttttccccttttgagtgaaatacctggaaattgtaaatgttcgaaattgccttaattccagctgagccgttttagcaaatgtaaactgtgaaggaggggataccagcagtgatgacgggagaggagctcgcctggccttcgtgggtggcatctcctgcacagaaacaggctcagtgccagaagcattttggtccctgggtactttcttttgcttaggcgtatggcacagcacatcgggaaggttctaggatctggggcccaaagatttgagcagcagtcctgtcttcattgcttattagactgttccatcttggagaatctctytgagtcttggtttcctcatttgtaagatatgtagaattcctgttctgctcacctttaggaactgacctaagtgctggatgcgacctcatgttgtaatcaccacacaaagatgtaattgctcaggctccttcctctgtaaggtgtcttccaactttacccttcatgattttacacatgtggggatttggcctcccaggtagaaagaaaaggacagggaaagaacagagtatactttctgattattttatgtttcttatgctcttattagatacagttataataagaacaaagaaaatcagccacaaaccgtgccttcttctttctcctagagaaatctgacagaatattttgtggctgtggatgttaacaacatgttgcatctgtacgccagtatgctgtacgaacgccggatactcatcatttgcagcaaactcagcactgtgagtagacagtcttaagactggctttttaatgatctaattttaattgaaagatacaccagcaagatgaaagaaaattttagaaaaaggagtcagctacagtccccttatatggcagcatgtcattttcattaattgttcattttttttttttacagtgccaatgcacatttcatttattcctgtagtcgcacagtcaattataaatagctttccatttgattgtgtgttatgaacattttgcaggtttctacatgagcttcaattgtcattttttaatgtctacaccatatttcatgatacgggtgtgtcattatttactaaatccttctcttgatggccatttaggttgttcattatgatttaatccttttagtagataatactgcaatgaacatcttttggcttcttttgactgttacagttatattctaaggagtgggacactaggtcaaagggcttgataagcgctatgacttagggactgccaaattgctttgcaaacaggcggtgcttgtttacagtgaaggctgccagctgtagatgagtgcaccattttcaccgcagctttgccaggaaagagagagagtgtgtgtgtgcgcgcatgtgcgcacgtgtgtacgtgcatgtgctcaggtgttttaattctgctaagaaagtagatgtgctatggtatttcaggcttgctttaattttagaattacctctttggttagaggtaactgaatattttccatgggtttatttttttatttgtattttgttaatatcctttcacatttattttataggtgtcttgatttttttattaattataatgaactttctatataacttttgctgtgtgtataatataaatatttttatattccttttattttagtttttcacttgctaagtatgagttcacattttccccaatattttttatgaaaattcttaagccattatagaaagctgaaataattttacagtgaatgctgatatacttccatctaaattctactagtgacattgtatcagttgctttatcatgtatttattcaactatttatcatccatagcatccattaatccatctttttttttttttttttttttttttgagacagastcttactctgtcacccaggctggagttcagtggcactatctcggctcactgcaacctccacctcccaggtacaagtaattctcttgcttcagtcacccaagtagttggggttacaggcacataccacctcacccagctaatttttgtatttttagtagagatggggttttgccatgttgaccaggctggtctcgaactcttgacctcaagtgatccacccacctcagcctcccaaagtgctgggattacaggtgatccatcttattttttatgcatttcaaagtaaatcacaggcgtcactttactttcccctaaataattcaatatctgtttgctgagtttgttgttgtttttgtttgtagacaaaacttatatacagaaattgactgggagtagaatgcctaataggcatccctctgttagagagagtagaaaaatatttttataagtggagagttccctaatgaagggcctatggataaaatcaagttatgtgtttacttatgaataaaaggcacctaataatgaaaactctctgagactactagagttttccttacagtttttattataccttcattattttattatttctttggttattgattgctcatcaagaactcagttttttttaattgcctagtatgtgttaagaatagcctatagtagacctcttgctttgttttacattttattttacaccatacgtgcagttcataatttcagggcacaaacacccagactgagtttcagaatgagaatattgtcaaccacatctatcatcacctctttgaaagagtctagtccataaccagttactgttkctttagattattaaatttcagtcaacaaaaacatgacatcgtctcagtggaaatgaattccttatcatttaatcatgatgtttttgatcccttactgtgtgccatgcactgtcctaagcacttttcatgtatgaactcatttaatccttactacgacagccttagtgggttctgtaattacttccatcttatagataaggaagaatgaaccttctgtgtgattttgctctcataaatgtggtggattaaacacacaaaattatttctgcttcctcccaaaactaaaatgaaataaaggaataaatctacaaacacaaaaaacagatgcagcaggaatttttaaaatagtaagaaaatactgttagcaactttatgccagcatttgaaaactaaggcaaaatagaagaaaatagcttagcaaagttgactcccgaagaaatataaaaattaaataggttatttaacttacagaaattgaatcaatatctttacatatttttccagataaaacactcatcccagggggttttacaagtgtgttttatcaaacatctcaaggaaaagattatttcagtcttagacaaactccttaagagtctagaacaagaggaaatgaaacccaacttttcctgcgacacttgtataaccttgacattcaacacaaagactgcacaagaaagaaaaattagcagccagtgtcactcattaatgtaggggtaaaaatcctcaattaggaagcaaatgattgatgatactagaaaatctattaatataacttacatattgacatattaaatgggaaaacttttatggtcctcaatagagggatggaaagcactaccatgtttatgaataagaagacctgatatcttgaagatgttatttcatttcaaaatgatgtatagattgtatacaattatattcaaaacccccatagggttttacatagtacctgacgagctaattctaaaattaatatggaaaagccagagaaagagccacaacatacttgacaaaaaagaatgggttgcggaagcttgctttaccagatatcaaaactttctataaagctgtagtaattacgatgctagtaatgggatgaggatacacatatgggctgatggaacagaatagagagcccaaaaacagatcacatgtatatgggctctttattttataaaaggtggcattgtagcatctctggggaatcaataattggctgtccacataggaaaaaaaaggaagaccgtttctattgtacacacacaaaaataaattccaaatggatcaagaacttaaatgtgaaaggcaaaatttaaaaacatttagaagacaaaatagaataatacttgatgatctttggagtagagaaaggcttatttaaaggtggtccaaaatatacattgtataaaagaaaatattaaaatcgtgaacttttattcattaaaagatacttttctctgactgaaaagtcacaagctgagatttgccatataaaaaaactgacagaaaattagtatcggaaataagtacagaactatgacaattaaaaagaagacaagcctgtcaatggaaaaattggcaaaaggcatgaattagcatttcacagaagaaatacaaatggccaacatctgtatggaaagatactcaaccacattagtaataatcaaaaagcacattaaaactacagtgattatggctgggcacaatgacttacacctataatcccaacattttgggaggccaaagtgggaggattgcttaaggccaggagttcaagaacagcctgggcaacacagtgagagccctgtctctacaaagaaaattaaaaatgagcgtggtagaacgcgcctgtactcctagctactagggatgctgaggcgggaagatcacttgagcccaggatcatggctttgcagtaaggtatgatcataccacttcactccagcgtggacaacagagtgagaccttgtctctgaaaaaacaaacaaaaccagcagtgaaacactaggtttacaaaaaatttcgtggctgacaaagccaggtgttatattggaaatgtattagagaatgtcatttactactatttgaagggtatgtgctacaaaactatttacgtatgcccatcactcagcaattctactcctaggtggaattttgtgggtatacacacaccccttggtcatgtatggtaggatatatgtataaaaatgttcacagtggctttttttaggttttatttaaatcctggaaatagttctcatgactaccaacagagaactgataggccgtggtgtagtcacacagtagaatatcgatcggatcaatgaaaatgaactgcactatcaatatgattatgtctctaatgtagaagctgagtgaggaactgggttgcacaaggatatactgttcagtatgatttcattaatataaagttcaagctagaaaaactaaatggtatcttgtttagggattcacacaaactacaaaggtaaaaagaaataattaacacaaaatttaggtaatggtttcctcacagggagagaaaagactggtttgggaagagtcatacaagggacatcaaaagttttgctttctgtcttaagccaggtgaggaactaacacattttgctataaagggtcaaataataaatacgcctttgcaggtcatatggtccttgttgccactgctgggctccaaccttgtaatcgaacagaggtaaactaagtgtatgattgtgtgccaacaaagctttattgccaaatacaggcagcaggccaggcttagccttttcactgtggtttgctggcccctgagccaaggtggtaggtttggggttcttacattttttttttctttgaaagttgtttatatgacatacatacttaatataattcaaaattttttagaggcctaaaaagaaggtacaaagctcctttatcatgagattttagagtatcagggatagagacaaagcagttcttgtacaaagattaagaatcaacattgcctgagatttggcagtggcagttctggaaaccagaagacagtgaagcagtgtcttgaccttctaagggaaaatgatttctaacctagaattctatacccatctaatggaagccctcaggagagagtgccaagatcccacaccactttgctcagcttcctgggcctgtactcctggactctgcattccctttgtggatgaaccgtctgtcctctctgaggccagtcactctgcttgtccaacttacttcattctgcaatatttatcgtgacattgccataggcactggggattacggcagtgaacaaaacaggcaacaatccctgtcctcatgaagcttgcattctagtatcataggtcctcgataagtcagaggagttaaatatctcgtacggtaggaaatggaaagtactaaggagtaaaataaagccgaagagagcggatggggagtggagagtggcagggattgcagttttaggtagatggcctcagaatgccaacaggaaaggcgacactgtggtttccttcaaggaaattactccagcagtaagcaagctcttctctcctgcatctattattattttctcttctctcctggcacattcttatgagcatgccaacatgctatagaagctcccagacttcaaaacaaaactttcttgacccgtatcccctttatcccatttctagtctccctttcagaacagaattcctcaagagagttacctatttactaattcctctggtctcattctctcctcagtcttccattaggattcagtccccacctgtccactaaaacaggtggacttgttttagtgtctttttccagtcaccagtgacctcctttgaagtaaaattaaaatgagttaatacttgcatagctctcagaacacagcctggtacgtagcttttgcagacgtttataataaattaataaattctataatgggaaatcaaattttattgtccagtttattaagggcctaccctactggaatgtaaacgtcatgaagacagggattgttgcccgtttccttcactgctgtgcccccagtgcctgtggtaacaccacgataaatatttgtggaatgaagacaaccggataagcggggtgactggcctctgagaggataacagttcatttgcaaagggaaggcagaatccaagtcttaatgtggaaaatgtgaaaccaagaattcgtgatttagaaataaggagataaatcctgtgttgaatgtgattacttcgagtgaagggtgtaagaagaatggtgaagtggactgttccttttcatgataagccttgactactttttgttttgttttgaaatctatgaatatgtattactatgacttttaaaaggcttttcttaacaaagagttgattcttaactgggttcgaagtttcatggattgctggtagaagcttctctggaggaggtggggttctccttgtatgtcacgtgcagttggcagcatcctgagaggttctgcggagtttggggatgacgtagctgagcagacttctgttgtattcacacctttggacctcttcaaattcagaatttgaaagtttcccaattgttgccttttatttccttaagagtggctttttattatcttttagatgggggctggtgcggagggggatatgcaaaggccatctcagcctgagattttttgaggaacctctcttgacagatcctgatgtggcctgcaatacttgacaaaccacattcttctcaattgtgtttgataagatggaggcttaatgctcctcagagccaccaagcacatgaaagataaaagctgtctagcactcgagtgctgtcttctataaaaatggctgtgtcaatagagacaaactcaacaatatttagttcagaggcaggtaatatgcatttcggggtttctcggtcaataacattgtgatattctgtataagaaaaatgtaagtttttgttctctttgctcagttaatgtatattgattgttttcctttataaatgataaatagggaaggcttaactaaatcttgttctctaatgtaaatacttcagtgtgattccctgtagcacaaaggccccatttttcttccatattttcatatctgagcttaattcatactgctttttggaactctatggagagcaagtaggtcaaagatcttaatagagataatacaattccatcagcattcctagaagatagatattattcccattttacagaacagccagtccatttggaaaggcggaataacttgcccaaggtcatgtcctagtcaataggagaggtggccatgaatataggtcgttatgatgcagtgtcaggggaaggaggctttggcttctggaaagggagaaacatcaagggattacacacaaactaatcgtagccccttcgaagtgcatgcctgggaaccaggttatgtctattgggtgccattacttaacaccattttccagtcccttgtgcgggaactgtcacaggagccagaggcatgttgttaggaatagccaccccactaaaggaatttgaaaattcttgtaaagagccaaaaagataccctgagccaaatctggtggataaggtaactagtggagctaggtgctgttggtttgggtgaaaaataagacctgattgtatagtacttagaggtttttttttttttttttttttttttgtagcttgtaaagctccaagaccactaaagagcattcacagaataaatgtgtaagaatatccttaagtagattcgtcctcagtactttatatgggagccccgccgttctcccccacccttttaaagttcttttaagttaaccttttgagccatccatttcctatatgacaggcactatgctaatcatgtatgtgatcatttttttcattcgttcttgcagcaaccctaggagcttgtgggttttcttctccctttgcagatgggaatgttagcacccccgaaagttgatgtgccttgtctaagatgagcagcagagatggaattaaaaccaggccagcatccttgctgcctcatacttccttcttggtaactcttcattgtcatgaattccctgtgacacttgtacttagagaaatattcttagcatgaccctgttggccatggatctaaaataatataaagaacctctgcctggtcgtcgtcacctttgaacgcacacctaagctttttacttcagattcggcaagccctgtctgtgcgcctgacactactctaggcaccaggaaacaggaggcagatctgtgaattcccattgacacacccagtctgttagccacagctccatttccttaaacacttcagattccattccgtctgcccatgccttcttagacttggctgtctcccagcagctcctgcaccctattcctaccatgagtgcggccttggtggagccctggggcgtatcttctgtaactcactgtggtttcagggttcatatattgcagctatgtatctttgtcctatataataaagaataaagaaccttccagggttcatatgttgcagttccttcgagcagtgtatcttggtcctaatcaccccctttataatttagggatactgaaagaaatttggacaactaagaatatccagttaaataatgacaaaggcatatttactttcctgagaaacatctatttgttttacccagcggatgcttttcagaaggaaatattgtatggtggcaagaccacgacctaattagcctctacacccataaccgaaaaccattattacttttctgatggtatctcattgaaggaagacaaaaaaaataaactggcaccctctctctgtcagtttcttcctaactgcgtcaacaaaaattagtccccaggcatgtgggagctgggcaggaccgggtaccctgtggcctgaggagtggtgggtgatacttccatctccccaccagcacacagtctggtccttaggagatgtttcagtattcgagtggaacatggagacttttccagccttgccccagtcctgttccaccactcccaccgacagcatccattgtctgagtaccatctggtcttgagccctaagaaagggccagtttgtggactgggcagcttttcagatttggcttcgtttttgctactttcctgacgaacgccaccttgtcatgttgacgccagcctgtgtgatgagctgagcacctgaatgatgtgtgcaaagctttcctagctcttctggactagaaaacactaatcctgtttgcttatctgccgcccttgaagcagagatgagagtggcagttgaaggagctttgaaatcctggagcagagccaaggcctctttgcctgcacactccactctgcatgttccagccgtaggaacaaactgcattattttgtttcaaactgtgctcaagggaagccaagaccttgtaactggaaacttaccaaacagagaattctaagactaaatttagtgttctatttaaaaaataaaataaatcgaacattgtgtttatcttttatatgttaaaaaggagagagagtaacctagttcacactaacaacctgagaagagtattcaaagaagtgagaagaaaactaatccttttggtgaagagggaaatccttaagaaattataatgaagtggcatggaatagaggctttgcagccaaacttccaagcagcacagcctctctaatctccgttatatacaattttattgtggtccagagaatatttaaaactgttaaaaaataaaggaacttccatggacagaaagtaggagagaagattggtgggttttacttatacgggcattctctggctttaaaatgtatagataattaattgcttgttgaactatattcttcatttaattatgtgtgaattggttttctcttattcatgttaaactctaattggaatgaagaaccttgagataccatagagactctgtaatacagagtatcaacaggttcatttgtgacactttgatgtgacttcaaccagccatggtctctctgctagctcttaccttcctctcctgcctcttctcccattgcttcaacaaacatcaagcactttggatgaggcacaggattcagattgtcagtgattccccagttctgatccatggattagcattatgttagaaccacccagaaaacttgttaaaatgcaggttcttgggcaccatctccagacattctggttcacaaagtctagtatggaaccatggaatgtgtattttttgaggttccccggatgattgatacacagcctgatttggaaccagtgaatagacagttctctaagacaaaaacaatatttattctttggtggctgttattttgcatcgttagactcattttcatgttgagacgacataatagagactgatcaagttcatttagaagatgtttatgcgtaccgactggcacttaaaaagctctttgtttccatattctctttgggagagctttgaytggggccttggctagtctagaaaaggaccatagctgagtataatctgttcaggctctcagtaattttacggaataccagtgcagtccaccggtgtaatttggggtgcatgtgtgtaaacaggtgatgtttctttttttttttttttttttgccatttcattaaattcatccgatttctgccatggcagaaaattttattattttagtaatgcggtcaagtcatgaaataaattgtgtcttccttagattgcaggactgatagcttctcatatgactcttatgaatcagaattttaaagaatcagaattttaaaggataatatttaagtcattgacatcttaatctacttaaaaagccctgcacccactttggcagacatggctgtcataaaagaaattttgagcgcctactaggtgcttatgacactgggagcaaggactcataatttcctgtgttgtttctgcagactgaaagtgtggtcactttggtgaaccaaggtagtgtgatatgaggttagaccatgaaatcatcggtaagtgcagacacggagcacattcacatttgttcttttctgctaccttgatagcttcagagtctaccagctagatgtgtcagacagccctgctggaggtatcttttcccaagaaaaaagacagcaggagtggaggagagagtatcagactgcaagtcaggatggctttgttccacttctgcctccgccttgtacttaatccaccatgtgccactttctagccatatggccttgggcaagttacttgacctcttggagtccctctgtcctcttctgtgaaaatggggatagtattcacacctacctcaaggtggttaaaaagatccggtgaccatccagatatgaaagcacagagcccagcactgggcgcactattcactctgtaaatgttacctgaggctgaatctcatccttgcaggccataaaccccgatttgactctcagaaacaaggagagcgataaagatcctaggagacttctgaatattaggatcgtcgtaatagcagatagggagtgaatccaagcaaaacagaatagtcacggcaactcccaagaggttttgcgtacggaccacttctccctagtcatttagtcattgaataaatggtcatttctcattcaagtcctcacagagcttgagtggcctaagaagctgctgtgttctcttgacccacccttaccccctgactggcctgtagctgggaggaggactagcagcttctctgtcttcaaccttcagggctctgatgtctctgtctctgtgaagcaggcctgattcttgccccaggcagaattaatgattctttctttatatgctaacacacttgaacctctattatagcatctctttcataatgcttttgtgtggaagttgattgtttgcattttgatctttctctctctattttaaattgcttgagggcatggtgtgtgcacatagtggatactcagtaattgtgggattaatatagatcagagcacagaagcagtttcatgggggctaagagcacagaatccagagctcaacttccctaggttcatatcctagttctgccaatagctgtgaccttatacaggttcctcaacacccaggagcctcagtttcctcatctataaaatggggacaataatgctacctaccttatagggctgttgtgaaaattaagtgagttaaatatatgtgaagcactgttctcagtgattggcagatagtaatgtgaattcagtggtcatggtggtggctgttttttgtttttgtttttkttttttttttttttgagatggagtttcgttcttgttgcccaggctagagtgcagtggcgagatcttggctcaccacaacctctacctcccgggttcaagtgattcttctgcctcagcctcccgagtagccgagattacaggcatgtggcaccatgcctggctaattttgtatttttagtagagacggggtttttccatgttggtcaggctagtcttgaactcccaacctcaggtgatctgcccacctcagcctcccaaagtgctggggattacaggcgtgagtgtggctgttttatagcttgaatctttcttctgaggtttttttttttttttttttggtagggggttggggggatacggaggctcattctgttgcccaggctggagtatagtggggttatctttgctcactgcaacatctgcctctcgggttcaactgatactcgtgcctcagcctcccaagtagctgggactacaggcgcctgtcaccacacccagctaatttttgtattttttggtagagaaaaggtttcactctgttggccaggctggtctcgaactcctgacctgaagtgatccgcctgccttggcctccgtaagtgctggtattacaggcatgagctaccacctgcggcctacagtcactttctaaggttaaatttgccaaagaaaactacagggaacagtcctttttctttttctttttctttttttttctttctttctttttttttttttttttttttttttttactactcatgcaaatttagtaactcaccacctgaaggttccttagtttcttcatgtgtgggtacctgacagataggtactcacgattccatgttcagttatgctttctttttaaaagtatgattctttattaaagcaatagtatagatccattagctaaacataaattatgatttatattgtcaaagaaatagaaatatccacttagactagatttgaggtggcaaatcgatttcttcttgagtgcccactttgatccattgatcaaaggtgcatgtgaggctgggcatggtagctcacacctgtaatctcagcactgtgggaggctgaggtgacctcaagtgtgaggtcaggagatcgagaccagcctggccaacatggtgaaactccgtctctactaaaaacacaaaaattagctgggcgtggtggcattcacccagctactcgggaggctgaggcaggagaatcacttgaacccaggaggcagaggttgcagtgagccaagattgcaccactgcaacgccagcctgggtggcagaacgagattctgtataacaacaacaacaaaagtgcatgtgaggaaggattgtgggccacatcccgactctgtgatcagttagtaatgtctgtcacagatatggcttggaggagtggtggcacattggctgtccctgtattgaatacattgttatcagtcccccatgtaaccctgcctttttctttttcatcttaaagaggaaagaaagctctttcctcactcatggtgctgtgggcttatttacagtgtggtttaccacaccatggttttctgcttctgctttggtagctaaagcttttctctggcagttttagttgctttgatgttttaaagtgtcaaatcttggcatgaaagcttgttgccccggttaataacttactctaattactctagtagatagctttaaaaaaaaatggagagaagtgattaagcaggcggttgattgcctgtgtaagcttcctcctgactaggtgatattgctgttgggggaagacgctttccttcactccttgttgggtggtttttttggtgtgtgtgtgtgtgtgtgcrcgtgtgtgtgtgtgtgtgcgtgtgtgtgtgtgygtgtgtgtttattccttccctttcccaaaagataatggagaaggaaaaaagtaagatgagttccacccagctgaaaatgaaactactggaagaacgattgttgccrttaccccctgaaaagcagccctgcatttcagctgctaagaaaagcaagacactgtttgctctttccttctactcacatgtccggcatctgtctagagtagctgaaggttctttgatttctgagatgttctaagttgcctttctgctagagtatctttgatagtttcttgaaagcctattcatcccccactaaatacagtaactacaatttgaacatagctgaaccctttataattaaaggtttttctcacagccatggaagggttgaaataggttgacttcacagagtccctgcagattttgcttaaaacgttttgatgattttagagaggatttgtcatttaagaataaattataatcaaaacaaaaaccacagcagtgtttgaatcatggcaccatgatactacgaagatggtttataattaaataaaagaatcaagttctcaaactgagaaagggaacaacttcccaagacacacagcattttctacagctgctctaaataagatgatccctggtcaaaatgaacaaacttaagaatgacctccctttaaagtcagtaatctggtatcctttctgtatttatcattttattcatttctttgcgtttatgttcagaggggaaatccaaatgcctctaaccctgtgaagcaggtgttggtttgattatttaacattctgaattctaggatggaaagaatgactgtgaccatctgattgtcttcctctgccagcttttagagcttggaatcttaatactttttcaaaactgtacagcctctagttgtgatctattaggcaattgcaatttgttaaatgtctggggccgggcgcggtggctcacgcctataatccaggcacttttggaggcgggyggatcacatgaggtcaggagttcgagaccagcctgaccaacatggagaaaccccatctctattaaaaatacaaaattagctgggcatggtggcgcatgcctgtaatcccagcgactcgggaggctgaggcaggagagttgaacctggcaggcagaggttgtggtgagctgagattgcgccattgcactccagcctgggcaacaakagtgaaactctgtctcaaaaaaaaaaaaaaaaaaaagtctggtaatcttgcctattcttcctcatggtgtgaatctggaggcattctccattccccaaacatttactcagcaccgactctgtgtcaaacatagtaggaggtaagaagaggaatatttgggaggccgaggagggcggatcacctgagctcgggagttcgagaccagcctggccaatttggcgaaaccctgtctttgctaaaaatacaaacattaattgggcgtggtagcaggtgcctgtaatcccagctactcaggaggctgaggcaggagaatcacttgaacgtgggaggcagaggttgcagtgagccgaggtcccaccactgcactccagtctgggtgacagagcgagactccatctcaaaaaaaaaaaaagaggaatcagatgtggtcttggtccttgaacagctcaaatccatagccgtcgtgttcctggtcacctggggtcatctacatctgagttcttcagagtatcaggggccaagtaaggaagacagctgtgccctggtcaggtgatggagatggggtgacctaaaagtggtggttcctacatagctcatgaattccagctgggccctggagctgcagagctgagaaagcaagaccagcttaaagacagaccctgatttgcttcggcttagtacaggtgaagaaggtaaactggggtagaggaggagccttcttcacttcaaaggatagcaattcctctagaattgtgagttgtcaaagctggaaaggaacacagaaatcttgtagcctagtctcttattttacatacaggacaaattgagacctaggaaaggaagtggcttgcccaggtcaaaaagttagcagaagactcggagcaagtatgtgaaagggaacacgacaaaaagcaagactttccaacactttcaagccagcctgtcagatgtatgtactcaaaaaggaatgtaaacctttctctttgactaataataattacttcattgtctagaatttcctgtgggttaaagacactacaacaccttagttaaatgtaactaatccccaggaaatgatcagatctgtgtttgttttaaaaatgattattttctgtcattggtattttgtccgagacatttggacatctagcagcaaggcaaatgcatatctgtgtcatttaacaatgtcagcaggtattgttacctcatctatttcagagtcctccacactgtggaaggcacagggtatacactcgaatactttttgagtttattatgcattgtggaaacacagtggccattatattctgacagacctggatgtgagtcccagttctgtcacttactgtcgatgtggccttgggcaagttatttcacctctgaaactgtttcctwatctgtgaaatgtggtgatgagtgtatatgtgtatcaacacacacgcactctttcctttaaaacaatactttgcaagggtctaaaccccaacatggtacctacacatattgtggttttgtctttggagggggcattcttatttttatttcacgtcaagttgcagagctgctattaggattcagcrgaggcattggtatctaagattgtgacaatctgggctttatctctgagaaatgactgaaaaaaaaaatgtgtccttgtgatttttcccactccgtcattgatcactctccrttcatgtcctactcccactgccttctcctcgtctccctttgcctcagagaaaactaatggagccatagagaaagctctgagatataaatgaccttgtgcacctttaattgaggacagaatttgctaaagtgcatccaaaaatccaccagtggtttactgtacagtctgtgtcctggctagactggctgttggctgtataatttgtctagttttgtctggagtcttaggctattcagctgcttcagggcaaaatcttttggggtgtcattaaatgagattgataattggcttctgatgaatattcattgtgactaatgactttgggcaaattttacacatactatctttccattctctcactgagtgagattttgatagaatcatttccttcaacttgcacttcaattatatatttacaatatccctttgttgactacactccaaattacatactttcattacttttaaagtttgtattctgtaaggaatgaacataggcctttaggacttttatttttagaaacagagtttagagttattttaaaaataagtggcaagtgatactttatagaacagagtgcattatttctgattgagtatagatatatagtaagtcttgtaatcaactgactgtccttaagtaatgatgcacatagtttatgtyatttagtattttggaaaagagccaaataattccgttttgtttgtttgttttcktaatcaaatgagtaatgcattttaccccgattgcagaaatttggcccttagaaaacccactaatgaaatgagcaaacaccttaaaagcttgattttttgtttttttgtgaaggataagtaattttaaaatcttggcattgaggttggtgggtttgcttttgaggttaaaaagacatgaaaagaacattatctgaagatgagatctctgctactttatgtttaaataggcttttgacccaaaccagtttaacctaaaaagagtcacataatcaagttctgtcttaaccaggttcattctattaaatgactttttcaaagagaatcacaaattaattcatgtgatgatgttaccttcatttgtatgggaccttgtagattttgaagtgcttttatttatttatttatatgttgtggagttagagagtaggcatatgattgaatgaatgggcgaatggatgaatgaatgacttggttttccaaaagtgccatgcttgtgtgtctaagcttgctgtttttgttttagacattttttcctttctttcttttttggggggacagagtcttgctctgttgcctaggctggagtgtagtggtgtgatctcagcccactgcaacctctgcctcctgggttcaagcaattctcctgcctcagcctcccgagtagctgggactacaggcatgtgccaccatgcctggctatttttctgtatttttagtagagatggggttttgccatgttggccaggctggtcttgaactcctgatctcaagtgatccgcccacctcagcctcccaaagagctgggatcacaggcgtgagccaccgcacccaaactgttttagactttgagtcatgtaccttactctgtgagactcatgggaatgttgatacacttctgttaaaagccaagttactaaactgtctttgtactgtgagtatattctaagtaaaaatcatattttatttattcaggacacatcccattaactagtgcacgtgtgtgtgttgtgtgttctgggccactgagaacatggaggtgaggacaggatcttcctgtactttacagtcaggaaacaaacatgcagccagttatggtccagttaataatgggtgcctatgggctgggtgcagtggctcacgcctgtaatcccaagactttgggaggccgaggtgggtgggtcacttgaggtcaggagtttgagaccagcctggccaacatggcgaaaccccgtctctacaaaatatacaaaaattagccgggcatggtggcacacacctgtagtcacagctactcagaaggctgaggcaggagaattgcttgaacctgggaggcagacgttgtagtgagccgagatcgtgccactgcactccagcctgggtgacagagtgagaccctgtctcaataataataataatattattattattataataggtgcctatgcacagggaaccagggaagactttgaagaggaagtacttacacagagacctgagggaggagtttgctagaggcacaaatccaggccagtttgggggacgggtggaaagggatgggaggaaaaggagtacatgactctatctaagtgatgtattccaaggacagacttggagaagatggtacagagtgtggctacagatggctgctgtaaagctagaccgtgggctggtggagccatccgggccaggcttgtccccaaagacttctgagtaggaagtgatgggccggaacctgcacttgaggaggagcgctctggcagctagttaaagatgagcagaaagagctgagacccagggccagtggaaccctccagcctgacttcagggtggaatcaggtcagagttggttcattctccactcactcaacaccagcaaggacttttcatctctaagaagccctgaagggattagttttatatatgtgtatttttgtatgtgagatatatatatctatatcaccctcctttatatgggtacctatggaaatagaatgtgaagggatgggttaaacctgcgagccttgacggggtcactgggaactgttcttgggtgcctgctgaatcagttccagttcatggcatggacctggctcaagaacagggtctggaggaaagagtcagggcaggtgggggtggggagtagcagccctggctttaacacacagctctcacaactgtgaaacatcagcagaatatccaatttaaagctgttcatgttacactaacctctgggattcttttaactgggccttggcacgtcactctttcgccacgtaaatgttcttctgtcagcaaaggccagttaacagcttccaaaagaagcaaagtcctcatgggaacaggcttccctgaaaccaaagaaacattaaagaaaaaaagacagaaagaaatatgtgttgttggcttttgtcacttcatacctatatctccaaaagttgttttttttccctttcttttcactatattgaattttgtagcaattgtatccctttgtagtatctttgtttcctaaatttttaattgcatcaaatactgattgtatgatgtctctagctctcaagaaaaaaaaggaatacaaaataggggcaagtcaaaagactgtggagaggaaggattagtcagtaaacagtgccagagcaattgattacctatgtggaaaaaataaattctcacctcagtccttaaacctaaagtaattccagatggactgaagagttaaatgctaggggaaaatttggaggactttcttgggataaaagcagtagaaaccatcatggaagaaaatatttgtctacgtaattatttagaccttctctttgcccagaaattcaaagaaaattaaggataaattattttcaaaacattacaaaggctgggtattctttgcatttcatcagtgattgcttataaaccagtaaaaattactaatactcatttttaaagtgggctaagaatatgaatagaccatttgtctattatrtaaatatagtgaagaaacatatgacaaaatgttcaaccttagtcctgatcagaataaaaataaaagtaaaataggtacaattttaaagctactaacttgactacaaggagtagtgctggtgaggggcagggaggccagaatcgtggtgtatggctgggggtcgggggtgtaaagagcctccatccttcatctattcattatactaacatacttatgagatatgtatttattaagtgccttcaaatgtttataacctttgtctctgaattctacatttaggaactatagatacaaattattgacctgtatgatgatattacttaatggtagtagagtagctaaatatattaatagcatgggaaattcatcgagtatcattaaaagatattttttctaagaatatttaaagaatattctggatttgtgcctttaaagcatcattaagagatatctttttctaagaatatttaaaggaaaatggcatcaaataatgttcacttttaagaaacacagaagaatactgtatagtcatcctaattgtatttaaaaggggaatatatgtgcttgtgtgtgtaataacctacaatgttaaatcttctgatggtgtggcatttattttaatccctttcaccattttaaaaattttctatttcgtatattagctttatcatcagaaaaaaagattttttgaaaagaaagctcttactaaatttgaattagggtgattgagttaacttagaatgatttctccaggtttttcagcttatcatgtaaacatattgaagaattatagaattgtattgctgaaatcaaatggcggtgtctcctcccttggatttgttcattgatctctgctttgctctgttccagctgactgcctgcatccacgggtctgcggcgatgctctaccccatgtactggcagcacgtgtacatccccgtgctgccgccgcatctgctggactactgctggtaaggtggctggccctgtcctctgcttctcctttgccctgatctgactgggcgtgttaggtgtgtcacttgttaatgcagttggtgactctacattaaaaatattaacttcatccagcctggacaaaatagtgagaatccatctgtacaaaaaaaaaaaaaaaaaaaaaagccagtcatggtggcacatatctgtagtcccagctactcaggaggctgagttggtaggatcatttgagccagagaggwtgaggctatagtgagctataattgtgccactgcactccatcccgggcaacaragtgagactctgtctcaataataataataatagaaatactaacttctaagtggcatggatttaagaccacctgattgcacggccctttcatttccagttttcttatatgtcatgacactctgaagagtacaagagaataggtagtaacttttcacatttctcagtttgggggaagcaatgcaccaaaaggttgcgtgtttgtttgtttgttttttcctaagacaaattgtaaactggggacaaaaacaattgagatctccaaggtcttcaagtttcagccatgccctggcacattccttaagacttgtgctcactgtggtttgggagcacaagccaggcagcgctaaactgtctgaagttctttgaggagaatttcactgttcagtgaaacagactttagtagaaggaagaaacaaaggttttggcgacagccctaccatcttgggcaagtcacttggctttaagactttgtttactcatctgtaaaaggaagttgttcaatacataatcatacaaagatgaaacaagataacatatgaaaggaccccatgtagaaaagctggctcatggtagctcagaaaatgtttccgcagacacatcatcgtcctcactatctgtcttcaatagattaccaaaacagactgtctttgtgaccgatttggatcccttttcctcatgaataatttctttctctagtgtaatgcagttaaagacattgtctccaaacagttcaagtcaacagaagtccgtaagggagcatggtacacagacagggaaaggcactaactgcgtgccggatattgagagcttcaggagaagggaagccatttgagggtcatagccctgttgcttaaggacagatgacacgggacactgaccactggttcggagtgattgagtccaggtcagtcatacttttgctgggatctccattccattttgcaatcatctcactggaaaggtccacccaagtagccagattgtccaaggagcttgaaggcattccacagtcactcctaattggaacgtgctgggctcaccctcttcccaagaggccatggagataacaaggacataactcagggacatcatgtgaaaatcagtggccctctctcatgcatagcagtaagtgaatgggcctgattctctctttattatatgtctttcttatcaaggtgagttatcttatttgtgcctttctcccacctcttatgagattaaggggcaatatgttttctaccatgtggagtatagaatcctggctaattttgaatttcttcttgattcatcaatggctgaaccccacatttttttcactgtgtctcttcatactttggtttattttggaaactattttcagttaatggtgacgtccaggtactgctggtctagattttggtgttcatcccttcttgagtgggtaggagataaagtaatgtttgcagataggaaaggataaggatgtaaaccccttataacagattcaccatgtgacattaaatgtttgcgtttgctctgttcctcagggagtgttttcaaacccctgggcccattccagacccctcccctgtacccaggtctccagcctctctccttccattggagactctagggagtgctggactctgccctagtgaggctgctccttctgctcccagattgttagactcctgtccccgctgccatggtctggtgtgagctctaccctgtcatctggcttctagcacagcccctaggaaccttcctccctcccatgtcactgtcatctgcttgtctctgggatcttcatcacctgtttgttgagatgtccacatctccttcccatcttattccctgctgtcttcagtggcttcagaatccacactactggcctccccttattcccactgagctcacatttgcactgttttgccatctatagtgagattaatttactccctcagagaggccatggagtagcacacacaaggataggacggggctaagaggaggacgcctgagtccctgtctctgctccattactgcctggctgtgtagcttagagcaagtgcctttgcctctctgaatctcttctctgttgagggctgaaaatactgcaacctgttctttaaactgtttctaggatgaaataaaataacgtatgtgctaatgcactttatagaccgaaaagcactatcagccacccagcagggtgacacctgtgtcattaaccgtctgaagctcactcagccccctctggtttcctgctggcctccttgcttcaagtctttgtgagcttgctctctctctctctctcactcgctcgctctctctctctttttttttttttttttttgagacagagttttgctctgttgcccagcctggagtgcagtggcacaatctgggctcactgcaacctctgcctcccaggttcaagcgattctcctgcctcagcctcctgagtagctgggattacaggcgcgtaccatcacactcggctaattatttgtaattttagtagagacggagtttcccttgttagccaggatggtctcgatctcctgacctcatgatccacccacctcggcctcccgaagggctgcgattacagacgtgagccaccgtgcctgttgttgtgagctttttcagtagagcagatgtttcccgatgctggccatgtcttaggcactgcactaagtgctgggaagacagggatgagagtcaatttccagcagaaggaactcaaacaattgggtgtcgaagacacaggcccatagacaggccagaactgctcctgggtttttcaccagttccctgcaggctgttgcttccctggccttgccactgaccctgggcacccctaccattttcttatctgctccttgtctggaagatactgctggtgaaagtctgagagcctttgcagagaggacctgctagagagtggtgctgcctaaccttggcttgccctccttctctgcagtcacccctgagccctcactctccccaccatgcacaggctcagggatggggatgcattgtcacatctggcaagaagagggggacatagggtctgtgttcccacaactgccctccttctcacccaaggctggtgctggttaattgctgcctgtctgcctcttcctctcctgccattcctgagggaggaagagcagtctgtccaaagccattgacttcacctgggcctgggtgctgtctcctgagggttctctgggacccatctagaactctgttttcttgggtatcattaaacacccctttctgctgcctcccgcctctcctgcacatgtgcttaggtgccccattcctcagattcaacctttccttaaactccctgtgcttgagcttctgagccaactctcttggtttcttctcactgccatatatctccaaggaaaggaccaaaaggaccctgtttactatccagtagtgtttgttgttgttcaaatgaaagcttgagggctgggcagaggcagacactgacactcagagaggaggaaggagatgaggggaactagaggggaggacaaggaacaaaacacacacccaaggaagatggaagggagagagagagtgagaaaaagcaggagaagggagagagagagtgagaaaaagcaggagaaggtagaaaggagacacacatcacccgagacagagtcctggagtgacatccagcccccttagcatgtagaacctgctgccatcccctctccccccagacacacagtacgctcacaggaatagaccccacacagacgcgcccaccttcatagacataggtcctttccccatagacatgtctcagggtcttccacagggagagacaccccccgcccatacacaccacacgccagatgtgtgctctaaaaggtagcctcaggtcaaatgcggtagcttatgcctgtaatctcagcactttgggaggccaaggcaggaggatcacttgagcctaggagtttgagaccagcctgggcaaattgtgagatcgccatctccacagaaaaaaaaaaacaaaacccagccatagtggcacacaattgtagtcccagctacgcaggaggttgaggtgggaggattgcttgagcccaggaggtcaaggctacagtgagccgcaattgagccactgccctccagtctgggtgacagaatgagaccctgtcgcacggttccccctggaagagattcaccagtgggttttcatgccgtgcttcagggaggaatacccggggcttctgcagggattggtagagctggaaaaatcaatatagttcctctgccaagtggtagtataattttattttttaaatatttgtcttattttattttatgagacaaggtcttgctttgtcacccaggctggaatgcagtggcacgatcttggctcactgcaacctcagcctcctgggttcaagcgattctcctgcctctgcctgcctagtagctggaatcacaggtgcataccaccatgcctggctaatttttgtatttttagtagagacagggtttcgccatgttggccaggctggtctctaactcctgacttcaggtgatccacctgcctcagcctcccaaagtactgggattacaggcatgagctaccatgtgtggcccaacttcagctttctattatttgaaaagttttggttgctaaattgttagctagtttaaaacaggcagcttacattcctggaactgtggaggggaaaatgctctgtcagtaacataagtgatgaagatagctgccactgttgaacactggtccatctcctttacatctgtgatggcgttgaattcttccaacaaccctgcaaggcagatactattaaccccatttcgcagatgattggtagaccaaggccccaagagctttagtaacttttcctgatacagacgttatgtattatactctatgatcaaatttttattaagagaattatatggacacataatacacaaaaaatcggatgtatatatgtatacatatagagaggcagaaatctggaaagaaatacaccaaaatgtttaacagagacccgtgatggggaggcgggagaggatttctgcatgctttttattttccatattttccaatatttctacactgaaaaagtatggtttttataattaaaagctttattttcacaaatcagtgttttttctagccaattgttcttcccagctgccattcatttctcctttcatgttttcttggagatacattagatgttttattttcctgtgaaagctgatccaagatcattttttcaaccttctctaactctagcactctgaaaaactgttaccagcctgaccaagggcattgatgttggaaggtctaacttagaagagaagacttggcaaggaaggctgctaagtccttgtcatcctaaatttccactccagaaaattaaggttgagttttgtatttactggtgcctgagtgagttttgagaggaggcaccatcttggaagtttctgtttctgtaatagcagtctttctcctggtctcttgtttccgtgaaagaactttctgacatatgaccaaaggatgattacaggccggtggggattggtgtctgtttgttaactgtaagatgtaagaatgatgaaatgaaagactccaagagaaaaaacacagcttccataatgaagggttgatttgaccaccttcagccactaccactgctttggtcagatactacaaatgtcatgaaatttgagtcaatgctaataacttcattctattatgcccagtaactttcaccaccattgagtttaatccttggtggtaagagccagcagggataactagcattttaagtaaagtgctaggagcctgaaacatgtaaatttgaaggaggtttgctactctgcagatgatttaaatgttaagtatgtccccatgcaggggatacacaaaaaggaatctgaaaactattatctcctgtagaaatgaactctcaatttactcactgcacaggaagggcggtttctagtcattttcactgccagcaggtgccctttctatgcataatagacttcacaagtgtaattaacacatgaggaccactgctgccagtttttcttcaggtacatgctgctaggagttttcaggacaacagtgtaggccataagagctttttacatggcgcctgaagatgaagtcttcgttgacttctggacaaagacatgttaaatggagctgagcccagaccctgctgttggtatcacaggtcacagtcattgagtccagaaaccccagaagctgtattgcagctttctgtggaccagaggccatgacagcaaagctctagtttgcatgcagttaataaatgaaaagtaggatactgaaaaccctaccattatgtggaggaccaattgcgcattcacaaatacgacatacaatcatctgagttaactttaattagagctataatcacagattttaattatctggaaaaaatcagtttagtacaaatgggctgccctaaatatttctcaaattatttttttttgtgtcccttcctatttttggagtggacaatagtgtggaaagtgcctaggttttggattcaggcagacctggattcaaaycttagtcttatctcttattaactatgtaaccattaaaaatctgttttaactctgtgatctgcaatatctttctgtaaaatgggtataacttacctactttgaaaagtggctatagcaattagagttattagtcaagtggcacctaggggccattagtaaatgatgattgcttttttcaccattattataaacatgggacatggattttggtttccagaaggtttaactcacattaagcattattcttacttctgttgccttgagagctcaggggaaaactttataattcatcttctctttttatccctcagattgtttttattttgattttttttttatttaacttgagttattgtatggttgttttcatttgcagctgtggcataagaatgaaaagaaaagaaacaaaagcagatggcagagaaaacgaaaggagtaagacatttccaggccttatgaatatttaaaaacatgtgctgctggttcctttctactttagatctgtgccattcctttgactttgaaagtgaaaacgagaatgttccctaccttagctgatggtggccttgaccttggccagtgttgggaaagccttcctgtttctgggagaaaagcattaacttgctaatgagaatcagcattccctttcataataatcaccatctattgagtactgtgtgtgtgacaagctctttataaacattattgcaaatcttcaaaatcaagctgcaaggtaaatatagctccattgtatatattaggaaattgaagctcagagaggtttaataacttacctactgtcacacagccaagaaatagtggagcctgcacttgaaatccaaggccatctgatattaaagctttccttactaatatcctctgaagtgttagagaataaattgtgcccatcaccgagattttatgaaaaaattcttcatgtcagcttcttgatgacttgctaattgtagacgtatgttgtcattcattaattatgcatttattcagcaaatatttatagagcacttattatgtaccaggcactatgctaattaaattttgctaataaaaggtcccagtagaaaccatatggtatttcccatgtaaatttctttttcccccttcctccttcagaagtagtcctaaatagggaccacaaatcaattctcaacttgaattgtatatttggtttattctaggcacttattaacacacatttgtgataaaatattttcaaagcagatcaagacaagctcatgcttttcccccaaaggacagtcaggtcaaaagccaagttagtagctagctcctgatgctttttgagggcattgttgaactgagaagtcaaataggatatgtacagtgaaggtttcgattttacatttgactttgtaaaatgcctcatatttcttggcatttccagatgactctggaagccgttcttcctctcagagtggggatgctcagatctctctgagagatgctagtttcaggccctttgtgtgctgtatgtagggttctgaatcagcccccacatggtgcatcacatattccatgtaggattttcaacaaaagatgcacagtccacataggcgatggggcatcaatctggacacaattctgaagtaacatccagttaatcagatctgcgtcgattccaatcactgtcttcatcggtgccatgaaattttgcataggaaatagatcaatgctagattaagtggaattgttgatattcttgatggcagggacagaactcaaatgaaagtgtggtgcggcggaagcagaaatgtctggccctcacctggcttccccatttactagattggaggtcactgagccaatgttttcaggtggaggtgaatagtgattactactgacacaaagcaggtgctctgtaaatagtaaatactatctttgtgttattcatagctatatagctgtatatatagtcaatatatattaatgtatctctggtgctaagaatttcaactgaggccaggtatggtggctcacacctatatcccagcactttgggaggccaagggggtggatcacttggggccaagagttcaagaccagcctgggcaacatagtgaaaccccatctctactaaaaatagaaaaaattagctgggtgtggtggtacatgcctgtaatcccagctactcaggaggctgaagcacgagaattgcttgaacctggggggtgatggttacagtgagccaagatcgtgccactgcactccagcctgggcagtagagcaagaccctgtcttggaaaaaaaaaaaaaaaaagaatttcaactgaattttttttttgcatcaactaaatatatagacttaacacacagaatggaagtggattagatggatagttgtggccaaaattctcttatgtatgccaaactctgggctttctagcttttgttaaagattgggttccagtaagtaagcaaaagttgtatgtcattgccattttgcagcaagtgcttatgaatacttactatattcctggcagtgggcataggaagataggtggacatagatggttctggatctgaggaaacactacttcaccaacgaactcaagcatccagtcaagatatggagaatagagatatttttttttaagctaagaagcagcaagacgccaagagtggaatggtgccactgtgacagagctcatctgggaggggtgggaggggataaggaccaggaatttagtttcagacagaagaggaagggaagctgggctgtggtgggactgatgattaggaaatgcacacacacatacacaaatgtgtgttgatttaatgatcagaaatcatagattactagttaggtaattcctcaactgagatttggctaaacttgaccctgaggcttgaacagagaggccaagtgagagaaaacagttcagatttggaagtcaaagtcttgggtccaaatcctagactctggtcctactaaagatgtgactttgagtgagtcacatctcctgcctgagcctcagtgtcttttgctaagtcattgccagggagatagctaaaaacattgctgtacatgaggagcctggcaccaagtaggcagctggaaaaatgttttgaggtgataacagtcactgagccctacactgagatgcaccttcatttccttgagcagcacccaagactgaatgtgccaagagccttgtagggaagctttggatgatttcttttttcctttttttctttttcttttctttttttttttttttttttttttttgagatggagtcttactctctcacccaggctggagtgcagtggtgcgatctcagctcactgcaaccttcgcctcctgggttcaagcaattcttctgcctcagcctcccargtagctgagattacagatatgcgccaccacacccagctaattttttgtatttttagtagagaaggggtttcactatgttggtcaggctggtctcaaactcctgacctcaaatgatccgcccaccttggcctcccaaagtgctgtgattacaggtgtaagccaccatgcccagactggacaatttcaatgtgaactgttttccaggtggaaaaattaggtaaagaagagactgggccctttgtattatctatgttacagattctgtgctgatctctatactgaagactctataggaaaactgtcttttcaatttctctgctacattttttaagttgaaatttaatccacataccacaaaattcacccttttaaaagtatacagttctggcccgaactgcagtggctcacacctgtaatgccagcactttgggaggtgggcagattgcttgagcctaggagttcgagaccaatcctgggcaacatggcaaaatcatgtccctgtaaaacaaatacaaaaattagccaggtgtgatggtgtgtacccgtagtcccagctctctgtgaggctgaagtagaagaatcacctgaacgtggagagttgaggctgcaacgagctgtgatcacgccattgcactccaacctggtcaaggagagtgagactctgtctcaatcaatcaatcaatcaatcagtcaatcratgtatgtatacagatcagtggtttgtagtctattccaactatctaatccactatccatctaatagatatatcaccaccactaattccagacacattagatttttaatacagtctatattgttagtaaagtaatacattcttattataaaaaacttttttaggctgggtgcggtggctcatgcctgtaatcccagcgctttgggaggcccaggtgggtggatcacctgagatcaggagttcaagaccagcttggctaacatggtgagaccccgtctctactaaaaatgcaaaaattagctgggcgtggtggcgtgtgcctgtaatcccagctactctgaggctgaggcaggagaatcacttgaacctgagaggtggaggttgcagtgagctgagatcgcgtcactgcactccagcctgggtgacagaacgagactctgtctcaaaaataataataagaagaaataaaaaacttttttagccttttaaagtacatatagcaaaaagcgaaaggtctataaaaatgggttagtctgtgtagatggttgccattcagcctttagccctgtccctctagaggcaccccggaaggcaccgatgtcaggagtatagcgggacagctctcactggcctcagcagtgtcactcccagcgttactgagactttcagggttaaagaagacaaggtgtccctttaacacaggagtgaccttcccasataggggaatggtgcttgttggctcagccacccaccctttggggagctgtctggaccacagcctaaccacctcctggctactgtatctgcctctgagcctctggacctgccctgccgctcccaccttccccagccccctccttctgcctaatgtcgggaggggcaacagcccgcctcccctgccctagtttctgctggcctccatgcaacgttgctggccccgactcctgcctacctgcctgagcattggcctggttttccatttctcatgacacattctgtacgtgagtgacacattcctcattcctccctgatttggagcctggcttgaacccaacacttagaaaactctggacattctggggcacagtatagggggctctatagcaacgacactctagatatgttcctgggagccatagttcacccataaggcagaggccacagaccaagtaacatcagggtcacaggaagtttcagcagtgcagcaagtgacctcatggcagggcttctggagatagtgtgcctgcctttttcaggtgctggcaccagggacagtatgtgcagcaccagcatagtgataggctctgagtgacctctcagcaagtgcgggttcgtcttccctttaaaacgtgatgaatggaaaggcgaggctgcaaaggtaattggatgctatgcatcttggcacatgggatgagtcctggaaaaacagcaagagaaaatctccttttattatcagttgcgctatttttttatcctttttttctgttactttctcttcatttatttctccataagcctctttctctttttctcttatttattttgtggctcattcattcatgtgtttccacaggctctcatgggctgcttgtggctcacaacttgagacttcctttccgtgtctggctttagctattacggttctcattgaattctctgtggcagcagagagccctgtctcctgacctttgctctgtgattaacttctcctgccgcagtggtcttagccacggagcccttcctgatgttttccgagtctgtcgccttccggtaggccaaggaggctcaaaagggcgggctaccccaggctttgatgttgacctctccagaattttgtccaggtgttatctttgtaactcatgtgttcatttctgttgggtccagtggcttggggctctagaaggcatctccaccacccccacctgcataggttaccccaggaagccacaaagccacactcagaagggcattgtcctccctttcccagtcactgatcagctccagtgatacacgtgtcttgcattagcaaaccatctccagtgcccactggacatcagtgcacgctgagctcacctctgctgtggcagggccccgtgctcttgctgtcgaaaccacaaatggaaactaggccatctctgccttctcccctaatcyagaattattcctggtctcctcatggatcgtcatcctctgttgttgctcataaatcggagagggctgggttggaaaccaggaaagacattaaatactttttcccctaaaaagaaaaaagcttgcctacctcatggcagttaccccatactttctacttctcaccagctgtgacctttgtcgagtcacttaacctctttgagccatgggttcctctgtgaattatggggacccacctttcaagattgctgcagagatgaaatgaggtcatctcaggcccttccgttgtgtacccgacaacaccctgtgcgtctccttgtagcggtttgcgcatatgcaataatgcgcttatttgatctgccattaactgtgagcttcacatggggaccagatctattctatcctcttgccccaggccagcatggtgcctgatattagtgatacctgttgactgactgactaaccggcctgtggaaaacacttttccctccccaggagccttttgaaaattcaagctcctgggtggctggtttatttttctcctgtggacaccacaaaacacctcacagtcttgtttcccttttgggttggtggccagagtgctcagagccaaacctgtgaccatcccagcaggtgtcccagcatgaaatagaaacactaaccttgccacagcttcctttttttttccccttagctcctatttcttttcatacttttgttgctatgttgcaaatattcatataaattgccttaaatcccgcttagaacagaaaagagtatcagtcaattccagctagtaaggcaaatatagttttattctgactatgaacccactagctattttacttttttagctataattatccagtaaccattttttgtcgacagtagcataatggttaagagaagtcactagcaagtaagagtagcgtaagagacttggaagtagaaggatttgggctgggatcaccattaactgggtgatcccataggcacgtttttgagaatacctttttaagtctataaaatggccaggcacagtggctcacgcccataatcccagtactttggaaggccgaggcaggtggatcacctgaggtcaggagttcgagaccaagctgggcaacatggtgaaaccctgtctccactaaaaatacaaaaaccagccaggcgtggtagtacgcacctgtaatcctagcaactcgagggactgaggcaggagaatcacttgaacccaggagacagaggttgcagtgggccaagatcgcaccactgcactctagcctgggcaacagagcaagactctgtctcaaaaaaaagctataaaatggatggtgtaaattggattatttgaggattaaatgagataaggtggctggagcctcccatgcagcccttgaaatgtggtgtgtgctcagtaaatagctcgactgttttacccttcctgctctgcacatggcaccatgggaggctctgggaaacaggattctgtgcttttgtgactgacaatctagagtcacccttcaaatcagcacatgctttatgccaaatgggtaacccggacaaaagcccctaccaagagaggtgttagccaccactgggcaatctgagaggcaggcagcatggcttcagtaggacttgaagaaatagtgaagctgaggcctgtggggccaccatgtgactgagatgagctcagaggcacttcagggaccagaagcttcctgtgatggaaaaggtagcaggggaggaggagctcagacagaatgtagaagctcctaggtcttgtcacagctgcaggccagcccttagggagcaggttagagaaaaccacctaacctccttcctctgcaggctgtgggaatgctggtctccaggaaataagaagcttgcttgatccccgtatcatgggcttgggttctagtcccagttctgccacttactagctgtgtgacgtcagatgaatgatttagcttttccaatcttagtttttccatctgtgaaatggtagttctgatagcaccctccttatgctgctatggtgagaatctaatgaggaaaatgccttagcctatgctggctcttggcaaatttgcagtcagtggtggctgctcttactggcttcctctcctacactggcagttacattagcctgaagagcagctgtctcatcgctctcactaagcccaaaaccatgatcattcgcattctccagcaagatatgttctctggtgtctgttctttttctttttcccgttctcttgtcctttaacctctctaataaagccaggctcattatttcgagcagaatttaaaaccacaagacaatctgtgtttacacgtttgtgtcttttacaaaaaaagaaagaaaagctcacataagacctccttcagagtttttctttctgactgtgggatcccctttgcctgatcagggtatttaattaagaaggtggtggccctctgagaggtaaggtgacactgtgatgtgtatattgtaacgtggatacctatgtgtaaacagtgatctttccaaatccctgggctgccctaagctgtgttccttcatgatagcagaggtgttgcccacctggaggtggagggaccgcctctcccttgtttcctctcccctcccactttgtcttgggaagctgtattttttttttttttaagcagccagtgttcctttatttcactggactcatttccaattagtagctgctcacctcaggggaacatgattaacagagccctggttatctgggggaaaggaattaaacaaattgtgaaagtgcggtaataatgaacaaggactacaggatcgttagtaagtctgcagtttccatattcttgcttcttccttgctgggaataagctcatgccataggacttacctgtcagagaagcgctcagcatcacaggcctggaaccaagaggactggcgaatagcccttttggtaccccagcgctcttttcctttcagcttaagtactgagtatgtgctgtgtgacctcatgtgcagagcttgggctgtctgttcagcagccttgcgtctgaagtacggcttcaccactgaccagctgtgcgatcttggcaaattttatctttctgagcgtgtttcctaacctgaaaatatggatgatcgcaccaccttgcagagttcccttgagcattatgtgtgtaatgcataaaggtgactgaattatagtagctcaataaaagttccttttcctcttaagaggattcaaactaaagatatcttccaggtaaaggttattctgttgtgtctgcctcaacaccagcaacagagcccttttccttttcaggggagaaggaaaaaagagtcacttttactctcacgtttgtaactgatgaaatcagatagtgcagtaattcccagagaacaaaagcttcatacagatataccccattctgctattccaggatgtacaatagcatcctacaatcactgtcagtcatacagcagttgtgacatggttgtcatgacctgcctatgcataagtttggttataactgttaatattatcaccactttaatttaattatgtgcattgttggttctgcacatgttgtttaattgccgtttaaaatgtcttcaaaattgcactatgattcaatattgaaaggtaaagtcactgtgaatgctaaaaggctctggagaagagaagcagagtatatacatttgctattactgaagcagatatttccattcatgttttctagaacagcaacaaataagttctttcttgaacctaaacaggaagatcacttctagtagatggattttggtttggttttgtaactgagatacccttggaaaaacatggacgtttatgcctctgaattagaaaaggattcagatgtgttggattctgaatatgaagaagttttttttttttaaatagcttacccaatttattttgctgttttatttttaatgtatgctcaagagtgataagaggtttttaaaaatgtgtccaagtgatcagaaagtcatgaaccattgtttcattgatagtttttccgttattggtggtacattagaaaggaaaggcaccctcctgacgagagtgatgagcaaccctcctgaactcagtggagtatccgggagacaagagtgtgcttgggagtcagaaatccatgtgtagagatggtgtgtgcctgtcaagcacctcccattcctcatggcatcttgaccattcttaccagcagtttaccaggtatcctagagcgggtatgctacagaaccagggctggaacaagaaaccattctgtgggtaataggagagtgggtccaatggtgccagccatgccaggggctcagagaaaaccctaccatgtgctgctgctgtgccaggtacgtcagaggttgtctctaatctctacaacaatcctgaaagatttctactaggccaggtactgccttattggagaatgctttgctaggatataacaaaagataagaaacagccctgtcctttaatttttagtaattcggtgtctaggaattcatgcaacatgaaggtgttcatttttatcacagtgatacttatagaaaattggaagcaacttaatgtctactctagggatagcattcgataaattatgatacatccatatttggtggaatattatgcagtctttaataatcacaaaaattatagaacaatctgggaaatgttcatgtagccaatgagaaaataaaacaatgtatgcactttataatttcaaagatataaagctgttaatgtgagccagtattagaaaggaatgcaaaagaaaaagtaattgtgttaggataatataatcatgggtaggtgtttttctccccaaacatttcttttaaaaataaaaagacaaagaagaggttccaagaaactgagtcagtagctacaataattattgagatacagtgagaatagaaattgttttcagactgtacctagaattacccaattggataagtaccacattgagatgttcaggaaattctgggtttctttttcttccctctccctctcaccacttggaattcgtaattatatatttgcagagcaaacatgcagtagattcagggaagtatctgaggcttgatacgtaaatgatgacaatgtaaaaggtatttgtccaaatttgcattcatacaaaacatggagctgctatgatttcagaataaatgtgttttaaatattttctaaatacagagctgttgcagttctaacaatacttggctaagaaaactacatttctgcgataggccataattactctttggataattattgggctttaaaaaatgcctatctaaagatacttgaagaatgagttccattttgccctttcttgcctcttcagtctcttccatgaggtccctttttcctttcagggtatcattgatttttattgtaggacaaaagggtgtagcattaaagtctacatacataagatcctatggttaagttatacagaggggttttgctatacatatttattttcaaccgtttgaatgtctttttctgtatattaactcatttgttggaatttcagttctacaattctggttaaaacccatggtcactggtcaattgcatgattaaatgtaggagatgggaagggtgataagatttagttaaatattatggatttgtgctttctcccttctatgtgttaggctgtgcttctggtcacattaataagtggccatttttctggaatttgtactcttcctgcttcctttcattacattaggcaaggttccactagatgagacatttgcagtcttaagacttcctgccagggttcagactttgtatttttgacattgaagctgtcgtgttcctgaagctacttaattagaaacacattcatttcagtgtacactggaaaaagcttggacagcagagccaggcacactgggaagtttgagcatttgtgtagctggcagctaaactaatggtttacagtttaaggggaaaaaaaatatcacagggcatttccttgcccctagaagcaaagagaagctgaatacacacagcagatacctaaaaaaaagaagaagaagaagaagaaaagacaactccactttcactgcaattgtgtgtatagttctttctttagctattatcaaatacaaaagtcttctagaatagttagcaaactgagctgctaatattcaagtctgttttacatgtkcccaagacatattatattactgctgagatctgtagtaaggaggacattttatattctggggaaagaaaggatttttgcttgaattttatttgttgaatggtaatgagggaattgtgtcctttcttatttttaaatgtttgagcaatttaaaaatatacatgtgatgtttagaaacctcccttgcctatccattgctttcaggataaagcctaaactccttagtattcagttggaagcaaacctctcctgtctcattacttaccactccttgtttctccaactttgtccccaaagagccattcttgtccatccacctctactctaccagctgccccagaagaaaagtacctgttcaccccagtctgagtcaggtgtcttttctctaggttcacaaaataccatctgcacatttcatagactatatcccatactacagagacagatggaaaagttgccaatcacacccttcctcgctatcccttgacctccttcccctaacccaaaggaaagcattgcatggggagtgagcttggggatttcaggttctatattacaaagtcagtgtggcacaaaggaagaaatgcatacttgggaatcaaatccsaggtctaccactgactttgttttgtggtattaggtaagtgatttaactaacctctttaggcctagtcccttctctgtaaaatgggtattgtatctatgggtattgcaaagttgttatgtggattagaatagatgaatttaaagttcctcatataatgtctagcacatttgttattggtaggtaacataaatgataatgtatacacacacacacatacacaccgacccctgaaatcaacggcaggaccggtgtatccaaaatgcccaggttttaaacccattggagtttagttctcatgcctttgctcagtcactgacttaggcaacccgtggctccgtgaatgaagcagttggcagaggctttctgaattatagtgtcatgggatggcatgtgtgcaactggggaggagatgcttgctggcagctctccaagtactttgtccaatcagaatggacagttagatcacatctcttgatgacagaggaagcagcaaatacaaaatattcttctttgaaacacattatgcccttcatccaaccttaactgctttttctgttgtaatcatggcaataatcgttcccatctgtattagaactctgctgatcatttaacgtatattttctttgattctagtaacaacgtgctggctggaatccaggattccattttaaagataaggcaactgaggctgtgcagttgcagagccgctctttaggggctaatatcaaggttgatgctcttcctgctacccatgctgttyccaatgctgcccacgttttgaaattcttctgaagtttctaggcttgggaacaaaatgtcatattaggatttttgttgtgaaaggaaatgtaactatgcatacgtttattaaaacagtttttctccaaatagtgaaccatctgtaattttctgtcagaagcaacagacattaaagcagctgtgtgtctctgtttctcttcacagtgctcccatgccctacctcataggaatccatttaagtttaatggaggtaagttggcttctttcctccccagatggctctacctggggctttgtttcattgtgtggcggtggagagacccagtctcagcagtcacagctctgcacgtgggagcatgctgaagcagcacctcccagcgtacagagctgagcgttcggtttggacgccgtgcactgggctctgttttcagggttttcccactttgccgagagactgtggattttcatgggttgagggaatgagagtcaaggaggcaggaggaaagggttctttaagggtttgaacgagggaagggaaatgatttgcttttcaaaatgtttgttctaatcgctatagcaatattgcattcttcattgtagtaaatgtgatataaaatgtatatagaatcatgaagaaggaaattaaaattatgcacaatgccattattccagattgaaccattgttagcattttactaatctccctcttggtctttagtctctaaatatatgttttgtataaatatgtataattgatatactttataattttgtgtctttattttaattaacatggcttgggaatctctacatgtttttatctactctcagtaataatttttaatttgccacctatcattcccactatttggatataccacaacgtaactgttttcctactgttggacactgaggttgtttataatttttcactattataaatagcatttcagtgaacatctttatgcataaggctttatctgcattttgcctcatttccctagcatagaacccctaaagtagaaatgcttggtcaaagctatgcatcggatgccagattgctttctgtatggctgtaccaattagatagcaattcttttaaaggacttttctgtgcttttgtaagtgtcattagtttgtagacatgtaccctaagccctttcctcctcaggagagagttttaatttgtactagagcaaaatgaggcgtggggagggtgcttgcctgtgttgcacaggagataagctctcagagggaaaatctacagccatgtccgtctgcggtggtgctttgcatgtcttgaaggaagtgctacttctcttcttctgttcccttcatttcacgtcgacgaggaccacctgcttcactaactgttgcacactgtgctattgtgcttacgaaaatgaaagaagttggttatcgaaaaacctgtttgtttgacattgagaatcttgatcaaaatagaccacagaaatctgctcaaatttctaatttgacaggccggccatgtggctcctacattctgttaacagttcctccttgtcatcacccagccctaagcacatacagtacacagtttatggactatctgggatgatgtatttagatcagattgaagagatttcttctgtgttttacctttgtttgtcaagtttgggggtctattcaaagctcccgtatgaaaaattgaaattcaaagtaaatacttaccaatggaccgttagtgccaattgctgtagagtttgaaacactaatataacgactatttggtctatcggagtccacagttccctcccgcttgcctctcctcctgccttccagactgctccagcacaggctttttcagattcctttttatgtcccagcgcctcagcattctccaagtttctagttttgtctttctcttcttttctatgtgccctctagtcaccttgtttaaggcctcttgcttcagctaccaggtcaatgtcaatgactcagctggggttctaatgctggtctgcctctctctgagcttcaggtccaaagtttaaagtgccagttggatttcacctggatgtactacggatgtctcccccagtcttccccaaacaatttattgtctgcacacacacacacacacacacacacacacacactctctctctctctctctctctctctctgtgtgtrtgtgtgtgtgtgtgtgtgtgtgtgtctctctctctgtgtctctctctctctctctaagccactccactccccttccactgttcctggtccctgtgaatggcactactgccttcaatggcacctaagtggaacacactgatcatggctgaatgctcttcttcctcatcctctctaaatactcacaaagctccaaaacgtctctcgccctgttctttcctcactgccttcattgacactttgctttcttggattcttgcaaaagccttattcatttgataaacaacatgagggtctcttatgttccaagcattttgctaggtcctggaggtatggagatgaatataaagttcagtgcatagtcacaacattgcatgggttgccctccagctggtcacttgataaccatgggctacataatacttgaggaggagccttccagcctcccctacacagtccctgggttctgcacagtctctccactactgtcaagccttctggctggtcactgacccatgttagcttgtgctcctgctgatccctaaacatatccacattcccaaccctctgcatgcatcagccctgcccttctccacctcttccaagaagtcctcctgctctgttttcttctttcacttatggtgcctcttgctctgaataatagctgtttgcttccttgttcctctccatcatcccctggagcatgacttctttgggaacaaggactgttcccattcactgtggtgtcctcagcacctaacaggatgccacacaggtgatattctctgagcaaatgctttgtgaaaagaagcgttgagtgaatgcttggaaagctgtaattgggagcacatttagaagccctctaataggcatcactgttttcaggcaacccaatgccataattttacttacaggtgcgggaagtgaattttttactttttatataattgtaagtaatttaaaataaggccttttgtagtaaaacatgcagtgtaaaatatgcgtacattttgcagctgaaacttgagacagagttttgcacttacatgaatgggtgcaggtctcttctgctcagcctttgaagggcgttaagggagaaggcttaggaagcactggcccagatagatcttagccctgctgattgacggaggctggggaggagtttgctgtgctgaactcctgtgtagtcagcacaaaaataaaaacaaaaatgggagttgtcccactcttgaaaccagccaagacactttatgaacaaagaagtgtttcctgagtgtgtagggcagccgtgaactactgaatcttagaattcagtctcctgacctcctccctggaatttcagctcagattccgagtgctctagttgtgctttctgwtggggcttatctagttcgattgtacccttcaggtgaaagggatactccttctgcggtttcttgcaggaacctgtagctcagacctggggccaaaggaaagccgtttacggaaggtgctcaggaaggcccatctcctctcgctacactagttttcttactggcaattcagcaaaaggcttatttttgactgtcttgttattttttcttgaaagctataggcaccttattatgcctttgcatatgtgccagaattttttaaacttcaaatgaatgtggcagatgttcataaaagtttagaaaaagctaccataggaagactttttaaccatttttatgacactcaaatttgttgcacaaaaagaaatataaattacaaacttgcattgttatttttaaaaaggttattttggggaaagacctaattctggttcatgctcttacaggatgccattaaatgataacctagtcaccttacagagtccgccttcctcccaaagtgacaagtgtatacctgatcgccattcttctctctccttctgcctgtttatagtttctctctcatttaagcaatctgaggctagtggcatgttagcagaatagccaagggtattggcatagacctagtttcttcttggagagaatgatcatgctagctggcagctaggaaatcccaaaacacggccagattccacagtgactgtcctttcattcaagcgatctcaatttagctcaagagacatttatgcagcccctcttctgtgccatctctggtagcaggtgccaggtcatgtctggtcgatggtgcttctcctgtttgataaatgaagaccttcctcctcaagcctcacaaacaatgctttgtgtacagacctcagagtgacatgagggatgcatccagaaggtattttctatccttcttggtggtgggatggtcaggaaggagaagggaaaggtgacagcaatgacagttccagacagaggatcmggtggcttgtaaatgaagttccacccatacacaggggcagtgaagtagagcagttagaatgtgacacctctacttcctgcttacttgatcgtgggcaaggtaattgacctctgagtctctattttctcacctgtaaactgaggataatggctgtgtctcccttatgggatcactgggaggatccagtgagataatgcctatcagatgcccagcacagttcctgcacataaagagctcaacaaaggtcagcaatccttgctggttttacttctttagtggccttcaagccgtttccattgttaagctgatggctttgaaactgtgttttaggagctcttgggttcccaggatcatcatcctcatgtcctagggaaagacagtttcaacacaattggtttgtgcctgcctcgttttctcctggtctgcaatgcagaggcacggtaccaggcttgggagtgacacttctgtagaatttgacaaatgtacttccaaacccctgcttgaccacttccctgctgtgctaactccagccatgatactacatstttctgtatcttgctttcttcctaagagctgagtcctgtatatggacagcatatcccagtgtctggcatgtggtggggacacaatatacattcctttctgcaacagagttttgagagctttctgtgtacggggcaccatgtttatactaggggctctgtataaaaatggcaaatgtgatataatatccaccttcacaggattgtgtgtagaccagatgcagaaaaatataaagtaattgtagtgaatttgggatgctgtaggctctgggaggagagatgctgaccctagccttgagaataatgcttctcagaggaagagaatgcccacactgaaacctagtagataaatakaagaattagataaaccagggagcagagagcagcatctgcaaagacttaggtgtaggcaaagggggctttccaggagatatgagtagttcagcctccgataggagcatgagctgaggtaagcaggccaggcccagcccatccagggccttggaggctgcagtaaagagtttgaactttatagggcaatggagagccattgaagggtgtaaatagaggagggacatggtcaggccttctccttctgggccattagaaacacagtccttccgtataaaatgcttggaaaccacttaaccatgttaataaagtaaattgatatttgcaaagatcaaggtaattctttaggaaattacacatcaaaaacatgtacataaaattcagatgggtcagtgtcccaaacctgagcttctttgctaccaagctgtgacagaggtgtttgtagtgatggctttcttcgaagtattagcaccacttttactagattgtgtcttttcttctatgttttcaagtactttttatgaattagttactttttctacacctcagtttaagggtatgaatgtattttatgtactatgtggtagttcaaggcagtaggtgcagggggagtgagacccagggaccagttggggggcccccagctgcttctcccctctaatgcagtttcaagaggcgtgtgatgggtgcatggggagctcctggcattctgctgctttcaccatcttttacctaggaatgcttagccatgggtccctagaagcctggtttttcaaacatacaagtgcttaaaacagcactgagccgccattcagaggacagcatccaggtgccaaatcaaagctcatcttggtctcgggatccagaggccacatttgtctatgtctacaacaaggttcccaatttaactatggagcttttacacaaaataatataggattcatttatttacaggcaaggggaaagtaatgggattttttttcctttgcatttcaaagaactggaatttctgtcaattgagttggcactattttaactagttttttcttttcatttttcccctggcatagaaagtctttcatgctttgttcctttctctttttttgatatttattttttaacagagtaaagaagagtgtttcttgtttaccattgtaccattttgcttctttgtatgactccacatgtagacagaagtaagatgtagttcacatttgttaatgctgcaattgatgcaaaattctgagccatagttacatccaggtataaatggtgacttgtatatgtgtcctcacaagaacagagatgttccatgtgacatttattagtgccaagtgatcctattcttgctttattaaaaaacagcctgggcaacacagtgagacctcatctctacgtaaaattaaaaacaacaacaacaacaaaactagccaggtgtggtgacacacagctatagttccagctactcagaaggctgaggcaagaggatcactcaagccaagcccaggagttcgaggctgcagtgagccataattgtgccaccgcactccagcctgggtgacaaagaccctgtctcaaaataaaatgaaataaaaagtgatatttgcatgaaaaatctcacctgatagtttcattcataggctcatggcaagaaagggaaagggttggaggagactttaacatcttttgagtacttgccaaccactgtgctgaggacttgacctgttttcatgtttgagcgttcctcagacactctctgcgaagtaggagatattcacacttgcagatagggaagctgaggctctgagaggtaacatacaattggcgctctgcatccacaggttccatgtccacagattcatccaaccacagatcaaaaatatttggaaaaaaatatatgaaagaatataaattaaaaagccaatatggtattggctatttttgtataatatttgtataattgttgtataatagttgttatatacagtatcacaactatttaacatttacattgtattaggtattgtaagtaatctagagacaatttaaagcatacaggagtatgtgcattggttatatgcaaacattataccctttggtatcagagacttgagcatctgcagatgttggtattcacaggggccctggaaccaatccccctcagatactgagagacgactgtaatttgtacccaggccttcagctgcaaggggtttatcagagcctctgatctgcgtaccctcccatcaggccatgtggattatgcctgtgccatcccagtcctgggcagagtccccacctgtcctgggctcttccttctcagtgctgtgtgctggggattgtggtgaggaggggaaaggagggcttacagctggtggccccatattcctccagagacaagctctgagtatactttgactgggacctggttaacttatctggtccactcttacctggtccactcttatctgtaaaattaaattgatattatccacataaaagacttgtgagaattaactgatatagtttattcaattaaatcaaatatgaagagctttttaaaaatactatgccaaacattcattttcctagttagtagtataaaaataagaggcaaagtttatatcagtgaaaccctgggtggagattgctttattttgtaaagaaaaaggtaattgaacggtggcttggtcctggaatttccttagcatgctatgtgttctcatgcacagtcatcacttatgagtctcgtaccatccagwagcttcctactgcaaacgcagcaggctctgctcaccttaggcctcgaggaaggccctggattgagtggatagatttcccttagaagctgtctcctcttcacagtaagcatttgcttttaaaatgaatatgaatctcaaatgccacttatcctaatgttggaattagttaatataaaacaatttaaagctctagcagtaatttatgtaatcaaagggaacaagtacttctggctgagttaagtatctcttgcagtcagtacgttttcagtctaactagtcatgatggaaatattctcacgtgagatggaatagccctctgttacagatgagaaaaactcagtaatgatgaggagaatcccagtaaaaaaatgtgaaaccatcattgatgcttttgttttcgtattttcctatcatcatttatgtcattatatataggttgcatttagcaatgttaaaactggcttcagagaaaacttaaaagtttataaattgttaccaagagaagcctgaatgagtcaaattcctgccagattgaggtaaggagcagtgggcagtgagcagggggactgtgtaacagagagctcgtgggcactggagtcatatggacctgagttcatattctagtttcaccactactagatcactttaaacaagcaccttttttttttttatgatggagtcttgctttgttgcccaggctagagtgcagtggtgccatctcagctcactgcatcctccgcctcctgggttcaagcgattctcctgcctcagcgtcccaagtagctgggactacaggtgtgcaccaccacacccggcctaagcaaactcctttgtttaaatcagaaatcagtttctcagaggaaaagggtatggttactacatcacacagtttgaccactttgcacaaaactattcttttgctatcctcttaaaagattcctgctggaaatacctatacataataatcttgaccattgaatgagggtctactaatgtgcatgccactttggccgtgtaatttctaattgccaccactctgagagaggtgcccctgttttgcagatgggtacgttaaggtgcctctttgagccccagactcctcactggtaaaataggtagttgccccatttcataggagttttcaatgaggagtaaataagaaggtacatgaaaacactcagattggtgtctgacacatggtgagtgccaaataaatggaagtgattatcaatattatttaggtgtagaattgatatccttcccttacaaagaaactaaaagacttatctacctaagattgactctgccctcctttttcaacctgtttttatttttctaatgagtgactttttctaaactgacattaacttaaacttactttttaactgagcccggccacgtgagactgttgacttcataaactccttgcaagtgattaggggcggggccattgtgggagctcagagaccagcagtgtgatgattgaagagccgtacccttggcctagacaaatcccacttgaaatctgggcgcatgtggttttgtttaacaccatgctcagccgactcatggtatgggtttgtgaccatcaggcatttgttgttgatatgtgaggtcaccacagtaggggtgtttgtcaaccaaattaaacttcctcttaatgacctaaaataattgatttggaaggccgttaaatgggccagggcaatgtgtaagcaagccgaaatccggcattttctgcacaaattaatgcatgttcttgttctgtttgttcgtgttttgcttttgttggggaaaatgtggctggaccatgggctttttgagcagtcagtgaacctgagtttgaatcccagctctgccatttatctatctgtaatttgggcaagtcgctgagcttctgtgggtgtgtgccttaatatccccatcagcaaaatgaggacacctgccataaagtgatgacaattagaaataatatgaccgaagtgccatgaacattactaggccatcaccctctggtagctattattatgaataaaatatttccaataggcatctctagaagatagctcaacagtcgttttgtacaaagaggtcaaactgtgatgtagtaaccatgccttttttcccccctgctaaactaatttctccacacactactctctgtactaaagttaaacatccagagagaaaagtgtgtttaaaaatggagtctatagatctctctttacatattgtttgattctcagctgatttcaagatgaaattaaagttggacacttaagagatatgccgtttaggctacaaaagaagtaggttttttctttggctattggattcaaacatttatgatctaagttcaggcctttgcaggtaaagcttgggaccaccattctatgtttgtttagaaacaaaggcattgactgggggcttttctgaagtatgatgaacagtggcactgargttttgttttgtggttggaagttatcaacatccctgagagtggtttatgtgtcttgcctaaaatccttccctccataaacccaaatattgacaaaagctaaaaggtgcagattggagctgtgcctagactcctggacacttccttagccaaatataatgtctgctaaaccttggtgcctaggagtccgttgtttccaaagatccagtggtaataaatttatatcctccctcttcagcatttaactgcaaatattttgtactgaccgaatgggttaaattatgaagcttgataagtacatatgcacactacccatccctagctttagaagaagggggaaaaaaaagaaagaaaaagatagctatgatttttggatgtcatcccaatttttaaaaataagagaatttggacattttggcatatggggttttttaaatgaaatttcatggaactgaaaacagtcaattttaggtttccaaaaattgtttagattttcgctggtataaatttgctgcacatggttttggggaagttctgagagatgcatttgggactttggggttggtttttttttttttttttttttgagatttgtgattgagttttaaaaggtgattttcccccctcccccaacctcaaagtgtaaatcaggggagatcagagttccattttctaaggacacttttgggtaatgacatcattatgcactgctgcacaactggacttggggctgagttattgagccttgtttcagcaccatttggacactgcacagtatattccccttccctgcctcggagtgattttggccgtgccattagcagcagctgctggtgataagcaccgggagagtcacctgtgtagggtcaggcttattgcacatcaaggtttggcagtgtcagaagagagggaagatgcccaggagggggctccaggccacctgccgagtgaagatcaaagggttgaaaggtcagagggctcagctcccttaacyrtatctgtctgtgcaatagctatttcagattgtaaatcttggcgatttcattaagtcctcctggctgctactggggcattgaaataataaaattttatatctattgcctttcctgcctctggcagccaggctgatacgttgtctgcaagatggggtcgtctttatgaaaaccttccctggaatgatctgagtagcattaatgaagcctcagattgggaagttggggttcataggacgtcatcctcagcaggagggagggggtttataaataaagaagacccacacaaaccatttagcagccttttagatttgtgtagcacctctcttctgaaaagcaggtcagcaaaatattacctattgctaaatgtttaatcttaggaggaggggtgcactttctcactgctgctgcttattaaatagcccctgttctaatgaccctagggcccatccttttgaataaccccaagagcagctatacaggtctcacttctcactctgcagaccttttgggtgcttttagagacatgtctcctgaatatgattttccaagtatttttcctagatcttaaagttgttaaggactgtgagggctcctaggctcgtgggtaggacaaatcaaagtaatagctgcccctttactgcccatatgtttaagaccccctgtagtttgtttgaaaagttaagagattttcacagtgaaggtgccatttctgaaatttaaagtgttccttttcaccgcaagataagttcactctgattaagtccgtaattctcactaagccatgtttatgggggcaataaacaatgtttcagcgtgcttgttaaattgggtttccaacctctccactctttaaaaattgacatttcaaataaaaggcaggtggagatgggagtcgggctttgcagtgcttagtgatgaatgaatgatggcaagtggcagttgtgtgggaggaatgaggtcctattttatgatagggtgaccccaaaccatttggggactagggaatcaacatcccccacactcccagtgaaactcttaaattcaagttctattgtttcactttggatggatgctattttgaactactgccagacacgttatgctcattatttaattttcataatgcatctgtgctctggtagtggggcccctattttacagatgatgaaatataggcacagagaggttaagtaacttgtccaaagtcacacacataattaggaggagcaggattcaaacacagttatttcattgcatgaagcagtttagtgtgtacaaaagaaaactattatactggccctacttttagggcttgcttgccactgtgtttcagcactctggtaagtctatacatggaggtcacaagagacgtgtggaagtggccactgtcctcagtatttgcttagcaccagctctgtgcctggaaagtggaggaggctgcacagcgaggagaaaggcaccaggctttggggtcaaatcccaagctcaaatcttaactctgatactctatgatctggggcaaattactgtacctcttggagcttcaggttgttcttctgtaaaatgtgaataataaagctcatttcaagaggttgctttgaggatattttaaaataatacattctaaaatataggtaaatataaaatatggtatgttcaaaaattcaacactgctttacaggtaccagtggtaaacattaccacagtgtatgtgaatagcgtaaggtttaaagcagttattttaaggggaaagtgatagcgcacaggaaacatcactaaacaagttttaactgcaggccaaagaatctgttgttcactgtgcttggcatggggtttagagatgacaacctgaggcggggataggagtagtcaggagggttttctagaagagcaggatctgctgggtggcagtaacgtggcgagctatctctgggccatgcttctcatcttatggagtgctctgccatatcatcgcatgtttgtgctttgcagctgtggggaaaggtgttgacacctttcttgtcctctttttacacatgaggaaactgagtctgcagcagtggsaagcctgcttcagtttgagacaaaacaccagcagagtcagagtgtgagtaggctccccactccgttctggatggcagagtggaggccaggctggatggaggttctgtgttggggtggatttctagagtggattgctaggaggactggcagaacccagctcccagaggggggccagctggcactgaccgagcgtctgcttgatggtggactctgtatgaaacatgtgttcccagtgtctcccccaatcttttcaacaaccctgaaggtaaggagcatgacctcggctcacagcaagggaaactggtgctagagaaggctgagtgccttgcctgaagctgcctagctggtaagtgaaaaggccaggaccccagcctggagactttctggccctgggcccaggaccatgtcggggagagaatggggctggtgggtgagtgggaatggtccactggtctgctgcatactactgtgccctttctcagatctacccacagcccatccacaaggagaggcggggagccccttgagttcagagatcatggtttaatcgtctctgtgtccctaagacctagcgtaaagttgacatgaatgacggctccatacgtgatgtaccaaatgagtgagtgaatgaacacccagtggatcgatggccaggaaaggggccattagaggaagagcccctttgctgacctggcttgagaatccctggacttgttaatgagagtcagtgcctgttaccttgtgaggggtggatttggcctgacctgggaggtgcttacaccacttccctcctctgccaagcttctgtttctgtttaaagcacactgggaaattccagcggtgttttcagggctcctctgaactgtcaggcttagatttttaattttgtggagcaggaaggagcaaatcagcgactcttggctccaaagaaaagccactgcgttcatcaactgcttggcagcttggtgacctttggggcctgaggaagggaaggaaaatgtcactcttccctctttgtgtatctgagatttcaggaggaaataaagagtttagaatacctgaatgtttgcctttcctttcctgtcctatccactttccctcttatttctctttcctttcctcctaggaggccaccagcttcccatgctgttctttgttatgtactcatatatatgcacatgcatttgggcacattttgtgcatgctgtgtagtggaaggaacactggctcatggaacccagattcaaatcctttctctgatgcatccagttgtaagaacacgggcaaattatttaatctctagcattgtttcctcatccatcaaatgggtatgattctgtaggaaagtctcccctccctgggaattttagtggagtctgggtcaggcatcaaaatacttaagggcttgattaatctggtatgcctaacaaaggtccgttatattagttgctcagtatgtttgttgattgaaacaatgtgtcagagcaaataatgccatgccttgggtagaataaaggtattgctgttcatctcaatgcctacagccagtgtttcttagccatgtgatttccgacgagttattttacctctctgaccctcagtttccatctctctccacagggacttcatgggaattacattaaatgatacttgtaaggagttgggctgtgggagaaacacaacagctagtggctgtaattttgttgttgtgtgtgtcagtaagatgatggatgcagagcatgtcacacagttcctgatacacacaggcctctgtaacattggctgtggcttggactgatacgtagccataggagtgcagttggagaagagaggcatgtattagtccattctcacacgactataaagaactacttgagactgggcaatttataaagaggtttaattggctcagggttctgcaggctgtacaggaagcatggctggggaggccccaggaaacttgcaatcatggtagaaggcgatgggggaagctggcacatcccacatggccagcaggagaaagagagagagaggggaatgctacacactttcaaacaaccagatcttgggagaactcactcaccatcacaagaacagcaagggggaaattagcccccacgatccagtcacctcccaccaggcccctcctccaacactgggaattacaagagggcgtgagatctgggtgggaacacagagccacactgtatcaaggcacctgcttggaacccagcaacagtcatttagaataaaattttgattaacaagctactaagatgtaatttttggtttaattttagccatattctctccctttaaaaaaaagaaaaagaaaagctcccaagaagtcatacttacaggggacatatagtataatgtcaggagccacatcaagtgtgcccctctcacagagggatcaacttagacttagtttgaacaaatgcaaagcatgttgtgggcatgataataacacatgacactgtgccctctcagagcaaagtgtctttgcaggaagccagcctagacccttcccctttgcttggaggtcccattactgctctcagaggtgctgccttgggtgctgtcttggccatgagagtagatgatgcttactggctttrggcgtcacccagaagagaattttttacttaatcctctcacaaccctatgtaacaagttgttatagacccattttatggataaagaaattgaggttcagctaggattaaatcatttacccttggtcctgtaactaggaattgaggaagataaaatcccaagcccaatctacctgactcctgctcctcctcaggactgcaaagacgtctcagaaggaccccaacaatgttgcagctttgcccttccctggagggaggcagtgcagactgagaagcagtgtgtgtcctggagctgtctgccttcacaaacacattttctaacagtgaaatagaatctcaattgagtcacttctattatagaattattgctatcttgattttttataataataactaatacctagtgcttctgatacaccagacactatcctaggtattacacatatattaactcatttaattgccaaaataacctggtgaagtccgtatttttttgtgtgtgtggtaaacattttcttgaagtgtgagggaaagatgcacccatcctaaatgtacagttaaagctgggcacagtggcatgcacctggagtgccagctgctcaggaggctgaggcgggaggatcacttgagcccaggagttcaagtccagcctggacaacacagcaagacctcatctctcaaaataaaataaaataaatccaaaccaacacagaaacccactaaatgtacagctagctgagtttttacaaggtggacatatacatgtaaccaccacccagatattgaaacaaaatattaccagccccccagaaactcctcttgtaccctattctagtcagtttccccccagcccaaggatgaccactgtcctggatgtcagtgctgtttttatctcattatacagatagggaaactgaggcacaggaagtctaaataatttgcccaaggtagcacagttttaattggcagagttaggattcagactcaggcagtctggctccagagaatgcacttttatatgagacatagccaagaaaagaacaatcgcttggtggtagtttaatttttaatagcatgagagtataataatagagacttattcgcattttcctttgttctgaaaatcagctgtttaattccttagtcttagaactctaatccattttattgacataacttgcaaattgcaaggatagaaacttgcctttaatagccccacatttattgatcactaattgcaatcagacattgtgttaaaatcttcatacctagtatctcactaaatcctcgcaacacagctgtgcagtattatccctattttattgataagaacactgaggctcagaagtaaagaacttgctgatgtttacacagtacagaagcagggcttgaatctggctgtcttgttccagacccacagtcttaatcgctgtgttaactcctatctggctttctgtgtccactgtgaattaattctacactaattaatcatgctaattttacatgattgttatcattgccatcgttattattattattcccattgcacttccttgagcaaactccgatttgctttcgttgagctgacattgtccattcgggcttacattgacatctgctgccaggcagacctcccagtagagtggatctagccacagtcgtttctcattccccagttaatgagcacttgccttgtgtcaggcactgtgctggacactggagacaaataagacacagctctgccctggagatggtcctggtctgaggacagcagaaaagattcactcagtgctggcctgtttactctatgcatgtcacctccctgaaccacacaacctccatcctagagagggtgtcctgtcttgctgcacagctgttggacgagcagaggcagaactgagcccctgctcctcaatgtccagccccacgctcccaacccggctgagtgctgcatgctcctggccactcttcagatcccccggctgacattgccagtgcacacccttgcctttcatcttgtggcttgcttttaagtactaccttttgtcactagctgcccaattccctccttggacaggtaggacactcccccgcaccaatctgtgtgggcagctggtgtggttttaattagtgtagctgatattattttatattttagggaggaaatcccattgttttcatacaaccaactctagaaagtaaggctcaataccatcttggctacagaaaagacaccaaagatagagtgtttatcaaacagaccccctcctttgtatagggaagtctatcagaatctctagggacattggctttttatatttatcctaagagggcttgaattgaaaaagttaaaaatcctggactagatgaaaaagttaggggacagggagccaaacacagccacagatcagaatgtacactgggtggtggccctggggagagtcaccttgtagcgtggcattcattcaccattgttcgcacactcttaccttgtatggttggctatgattttattctgtgttctggagagagtgctaatatgtttatcaacttcattgaggtataactgatcacaacccatccacttaaagtatatggttcaatgaataccttcattggggtatatttatcacaacccatccatttaaagtatatggttcaatgcattttgacagttttatacgatcatgaaaccaccacaataaagatacagaatattttcatcacccacaaaagatcatttgtttttatttaacaaacacttatcttgcacttcccatgtgccaggcactactccaagtactttaaaatattaacccattgaatcctcacaaatctgtgaggtaggtacggttatcatcccccatttatcaaggaggaaactgaggcacagaaagattaagtgacatacccaagttggcacagctggtggatggtagagattaattagaacccagactggctttggatctatgttcttcacctctgggctctgctgcctctcattcattcattcacgaattgtctgctcttgggcaaatattggagtaggagctgagagtagagaaatctgattcccaacccccaaaagccygtagactagggaaggaatcagatacctacctaagtaagtcacagtcaacgtgttattctaattgtgcagataaaccttaggggagcacaggtcatgggaggcttgccgctgcctcagtctctctagccaggcatggctgaggtctaggaaccatccaaggagaggggacgggcaggcaagagaactgatgagtgcctgttagggctattctgggaattatgctgaatcttttacatacattagcttatcaaagcctcacacaactctgtgagataggtggtgttatgatctccattctacagatgaaaacctggaggatttatgcagtcaagccagttgcctacagtaagccccctggtcggggacaagccagaggtgaaatactagagctggtgtcctctcagctgcccctgaccactccccatactacgggttttcccttccctggcctgaaaggcaggggtcaagttcagactgtctgtgacaaagcagaaagaggaagacattcttcattaacaatatatatgggaaagtgccattttgtgtgtgtgtttctctatgtaagaaatgccatttggaaagccagtgtgcatgtcagttttttttttttttttttttttttttcattctgagaaaaagcctatagagtctggtggggggaagggtttgcagctggcaggagctttggcatatgctgtaactaaaaagagagggaatgtgttggtgggacaagctaccggagagctgtctcggtgtgccgcagtactagtaagtgttttaattgggtagggtttttggaggactattttgacatctgctcatgtctttgctgatttttcttcacttatagtaggaaacacaagctgtggataaaatgactttaaaataattggaagtaaagatatctctctcaaagtcgaatttgagagggacactttttaagaagtggaaactaaattccacttctaggaatgcatcctaaagcacaaagctttatgcctacagatttcatgacgatattatatacagtaatttcttcaaaactggaaataacatsccacaaaaggggcttggttgagtttgtttccatgtagtagggcactctgtcgcagttagtaatgatccacgcaaagttcttaattaagtggatcactgcttatatcagaatcagtgagaaaatcagaagtgttaagaattatttcaactggccaaacgcagtggctcacacctgtcatccgagcactttgggaggccgaggtgggtggatcacgagatcaggagatcaagaccactttggccaacatggtgaaaccccatctctagtaaaaataaaaaaattagctgggtatggtggcatgcgcctgtaatcccagctactcaggaggcggaggcataagaacagcttgaacccaggaggcagaggttgcagtgagccaagatcatgccactgcactccagcctggcaacagagcgagactcccatctcaaaaaaaaaaaacaaaatagaattatttcaactttgctttaacacgtaggaagggagaatatggaaggaaatagaccaaaacattgtctccaaatggagggactgggataactgtaattttcttctttaaacttttctcttccccccccccctttttttttttttgagatggagtttcactcttgtcacctaggctggagtgcaatggtgcaatctcagctctctgcaacctccgcctcccaggtccaagcaattctccttcctcagcctcccaagtagctgggattacaggcacccgccaccacacccggctaattttttgtatttttagtagagacagggtttcgccatgttgtccaggctggtcttgaactcctgacctcaggtgatccacccgcctcagcctcccaaagtgctgagattacaagcgtgagccatcgtgcccagcctttcccattttttaatagtaggcatctataattttttttttttttttttttttgagacagagtttcactcttattgtccaagctggagtgctggagtgcaatggctgaatctcggctcactgcaacctccacctcccaggttcaagtaattctcctacctcagcctcccgagtagctgggattacaggcatgtaccaccatgcctggctaattttgtatttttagtagagatggggtttctccattggtcaggctggtctcgaactcctgacctctggtgatctgctcacttcggcctcccaaagtgctgggattacaggtgtgagccaccatgcccatcctattttttatgataaaaaggaaagtagtattttatgtaagagaaagcagtctctgagcatgttgatataactgtgtgtcctgaacagttaggtactcattctgatgtctgagcgatcggattaggggtatcttcagaagaaagtcagctttggggtcagactgtttagggagaccccctgaaactattgctacagaataaaagatgaaatgctcctgattattgtaaatacaaaattgcatgcaggattgtgtaaagacaatgccaggttggactgccaaaatgagccaacagtgtgtgatgtgcttccccatgcagagaacctatgaatggacgtgcagtcagggaggtttcacatcaccaagatgttcatagctctgggaatggaatacgacccttgtggagagcctataaacggacgcatggggggacgcctgtccatatggataagatagggctataaatgccctcatcttgccacggctcttctaggcctctttagggttagggcatactcccttctgagaatttctggtctaactggttgtctagcttcacgtcctgtttccatggattgtttgtaaccagcttttgttgcaattgttactgctgattaatagcttgctaatcataggttacggaaagattgtgtttctgttttaaggctctgttagaaattactgacgcacacactatattgtaaattcttatctctgtgtactctatatactgagccactcagttatgctctgtacttctacatacaaatgctatgttaaagaattacttcatccccatgtgaccatctcaccgcataatcaaatgaccctaaatccctcactaacctacccccgccttcactaaacttaataataaatgctggtatatccagtgcattgttggcaccgcaggaccagaagctggtgacccccctggacccagctttcactatctcgtgtgtgtctattatttctcaacctgccgatccacctgggaacaaagagagagccccgttgcattgcgggctgctggccagatcccgcaataagactgtgttcaaaagttgactgctgcttcctagctctgactttgggcagcttgtttgacctctctgcgcccccacttggttcccatgcagagatgctagtgtccctgactgatggcatggttaagatgagaggcaccggcacctggcgacggtctggctttcttctcatccgcgcttcctgtccccacccccagtttgagtttttcttgcctttcttcattcccctagttgccttgatcctttgggggaccgggcactgtccagcgagctgggctccaattctttccttgggaacagtgagcttcaggaaggcccttgagtccacgccagcccttttggaagaggccttgccaccaggagggcagcattgtccttcaagaggaaactgtgccgtcccagctcctgcctggagcctggtrctcggggcattttggttactaaggggaccctggcctgctaagttagaaaaaggggccaggttttttcctattcttcagcctgctgccattgttgaaaaagtaaacactccacagagcttaaccggcaagtcctccagccaggagtgggaagaaatcaaaagcctattccagcccagccgtggagagcctacaagggctggtctgtgccaytggggcccaatgggagcacagaaacaaggcctgattctggtccagaatcaacatcccattcatggggccattcagccctggaggcttctctccaatggccatcatctcctgctcccttctgtttgggactatttggaaggtcagatgaggcaaagtagttgattctggggtgcacggtcctctgttgtgtcctggaggcatcacgtcctccaggatgttgtgagtccttctctgattctgtttcctgtgactgactgtgcatagcctttgaagtgagagaccaagcaagaaggggccccaaggatttttgccctcgggccattgccactacagccttccagactggctgtggctattgtgtgtattaaaaagtagtaataatagccacgatttattacatcctactgtgtggccagcattgtgggtgtgtttgctctcatcacagcagccctagggggagtgagagaagcagggtggccacagttagcattttaattttacagacgcagccatttaatagacacataaccttgggcaagctacttcttggagcctcagttactcatctctgaaatggggataatggtatctcacctccagccccattgatggaatgaaggcatctgtgtggcagtgctgtgtgagcctgaagtgtgacatcagtgaaaaagagggccattgatgctgtttttgtaccttcctgctagcacactgctgggcatttaacctgttgggttgcagagtgagccagctagagagtcctggacaatcccctgtgaatctcagcattctcatgtgtaaaatggagattgtgcttcatataacaaaagcgctgtaaaatatgaactcgttttttgtatcattaggttggtgcaaaagtacattctttgccattactttggtaaaaactgcaattacttttgcactaacctaatacaatcaaagttgtccattcgctgatatctttttaccctataaataaggcagcaggtaataatgggtgttggggtttggaggaaagaataaactcctacatcggcaattgtgtccctcctctgtggttctcagcccatagtaagcacttagtaaactatgtttaggaattgatggataggtttatggacaagccccagaggcgtggagaagttagtggatagcagaaggagttggaggctctgatggtgttaagtggaaaggttccgggattctgctgcctgggagtgttttttcaatcctasygaggcttgtgaccagtgtggctccaccctcctgctgggaagaatcttgaaatatttacttaggtaccatgttctgccctagaggctgtggtttaagagagtgaatgtcaaccagtattagtgtacacttaccgggtgccagtcatgttgtcagggactggttgttttgcagtggtgagccacagatgagcccctgaaggagcccacaccccagcaggggaggcaggcaggcagagaggtgctggggctcagagtgacaagggctgtgcggaggtcagtctccctgcgggtgtctgacgatgaggaggtggatggtgcagtacacagagcatggcctggggaggcagccaggcctgtggttgcctctgcctcttacctcagcactctgaacctcatcttcctcaagtttcaaacattgagggcaataacatccacttcacaggggttgataagaattaaatgaaataaggtgagtaaagcacagagcaagagctaggaagcttctagtatatgctacttgtccatttccagggcattggaaactggagcttgagcagccattggatgtctgcctctgttgccagcctacaccatgctctggggtgaattaggaaaaggcatctgcccccattccccgactggtgccactcggcaggcacgtgagttggcagatttcagtcctagcttaggtggttggcatctgaggaatgcatacctgcgcagccacatgcagcatgctcagaggttgaccagtaatggaattgatcctttatatgcagtgaccacaggtcccatcgtgtgcctgttgccctggtgtaagatgaggtctttcacatccaaatgtatcccagtttagacagcaaatgataggctctttctacgcaaaataaaataaagacaatagttctaatgcctctgactcaaaaggaatacgcttgatacgtgatggggaaggaggattgaatgggacctggagtggagagtaggcaggagaaacacaaagatggatcttagtagcggataaatagtgtgattaaaaatttaaaactcaggctacaccctgtcttggactcacataggctatggggaattgctgccagattgggggcaggattctttttttctccatattgtccgttcatcccttctcctgtcaccaagcatgaaaaccttgtaggcatgagtttccctcatcttttctattactgtgccagtagaataatggcttatggccagagcttctgagccattactaactggatatctgtggaaaatggaaccaaattgaaagtgtgaccttcctacttggcgtttaagggaagtgttaacagtaggccacacacaatattccatacccaagaatgacaggatccaaaagagagatgggcaagtagcctttgttaaattagggggctggattgaatggggatatcataagaacacagccgtatatcagcattcctggggmcagagcttttgacctcagcgtctgttaaatatataggggaaaaatgatgatggggtgtaatgattcctcttactttctggctatgtgacctggggcatgttactgagcctctgtgaacccttttcactcctgggacttggggatagtcatgcaagctcacagagattttatgagagttcagtgagctaacaaatgtgaacctcctaccattgggcctgctgcagagtaagactttgtcaaatgtcactttccttctctatgcctcttccccagagaaggcaggggaagtgtgtcttgatggcacctcaatgaccttctcttgtggatttttttctccttgcagaaagtcagaaacatggccctggatgatgtcgtgatcctgaatgtggacaccaacaccctggaaacccccttcgatgacctccagagcctcccaaacgacgtggtaggtaatgagcttgcgaggatctcacttctgtgagctcctgcaaaggaaatgaacgtgactttggggaatggggaaggaggggaaatagcgagggttttcctgtgacctgagaactgcagtttgtttctgcattgaaacctttgtctcagtgtagaaagttggaaggtggccaggcatggtggctcacacctgtaatcccagcactttgggaggccgaggcgggtggatcacctgaggtcaggagttcgagaccagcctgggcaacatggtgaaaccctgtttctactaaaaatacaaaaattagccaggcatggtggtgcatgcgtgtaatcccagctactcgggagctgaggcaggagaatcacttgaacccgggaggtggaggttgcattgagctgagattgcgccactgcactccagcctgggtgacagagcgagactccatctcaaaaaaataaaaaagaaatggccgggcacagtggctcacacctgtaatcccagcactttgggaggccaaggcgggcagatcatgaggtcaggaaagtgagaccatcctggctaacatggtgaaacacagtctctactaaaaatacaaaaaattaactgagcatggtggcatgtgcctgtagtcccagctactcaggaggctgaggcaggagaattgcttgaacccaggaggcagaggttgcagtgagctgagatcgtgccactgcactccagtctgggcgacagagcaagactccatctcaaaaaaaaaaaaaagaaagttagaagaaggtttatttcttgagtctattttgacttgaactttcatcagaaagactgtgaagtgaccttagtgtccagacctctcctcttcctgtgggagtctgagagtctcgccagctctccccagcacgctgccacctctagagatcagggcagctccctccaagtaacagcacagaaggcagctggcggggttttcagtgtgaacaatttggggtacttcaaacctacatttttttcctagaccatctagaacatggtagagtatcgggtggcagtgctgtcagtgtagctgtgcaccctccgcattgcactttgttgcctcaggtctacacagaatgtgggttctattgagcaaaaagtagctggctgccacatttgccatgctaacatctgcctatacacctgtcttctgttgctacttggagctgccctgtaggcagctgtgtgaggtagacccattctccccttgtccatgccagtgaggattgggcctcaccggcaagtgtggttttgctgtttctgctttggcctccgtagctctgcctgcaagaagatctatagagttatcctgacttccagagtgaaacgggttgttgttcctggccatgtggtgctcatatgtgtcctggtcggggaagtgttttacctggtgggcattggtgcaccatcactgccagaaggcccagtggcaccctgtgggtagctgttctgaaaggattgctattagttgatgaagtcttgcaggagaatttctttctttttttttttttgaaacagtgtctggctctgtcacccaggctggagtgcagtggcactatcttagctcactgcagcctctgcctcctgggctcaactgatcctcctacctcagcctcccaagtagctgggaccgtaggcacatgccaccacacccagctacgttttgtagagatggagtcttgctgtgttgcccagactggtctcatactcctgggctcaagcaatctgcccatctcagcctccctaagtgctgggattacaagcatgagccactgtgcccagccgtaacaggatttcaaacttctctccacctaactcactgtgagattttgggggagtcatttgtgccctacagcagtgctccacttataattcaacaatggctgccattcactggctcactgcactgagctcccatcattgacctctcatttactcttcatgccactctgaggatggtcttttccttactcccgcttgacccacagagctagagagaggaggagccaaggcatgaactcaaccccgtgggtctgcagagcccacatggcccctctgccctactaggtgtcttctgcgtttaggatgtcattcatcctgaatgacagttagtgttgtagccctttggaacaggtgatctctcctttctacagagaggagagaacctcagagagcacgtgccttgcctgaaatcctgtaggtgattaggggcacagctgagattggacccccagtctgtgctgcttctactctatgtatcccgcctccctctgaggcagcaagagatgacagaacttaggaaaatttaaagtgtcagacaggaatgaggacctgtgaggtgtgagaatcatgtcaggacagggtagtacatggttggtaccttagggcctactagctataatttgagttcttttggtccaaggaatctgaggctcccatccctgtttcctttcagtggacaagcacctcttgaagccatggatatctcaggcatggaccaggcaaatgcctagtgaatgtgggaagtgaacctgaggtctgttaggtgcaggaaatggccaagggccctggggcagcatgagatgagtgactggcagctcagaaaccatggagtggactgactggtcccacctgcactgctctgaccctgtgctggcactgagcagcaaagagaaagcagatcttcaaagattgtatgtcagtaaaggaaacagatatgtcaattacatatctattacagtatagcataatagagaccacagggaaataggagtcgggcacagaagggcccaggagagagagtaacaaaattttggggaggataatggagtctttctgaagatggcaaattccaagatgccttttaaatgacaaaatgaggtagcctcagggaaccaaagtaacttgggtgagttattttccctctttgagcctcagttttccacattaaaagaggagtaccaggcttgctctgaggattattatggcaaacagctatggtaatgattatcaaatgcttggcacagtgcttgcatgttgtcagcattcaagaaatggtacctgcatttgtttttaataaaattgttgctgataattataggcaagattggaggacagttaataacctctatgtcctgacagtctcagcgtgcacaaatgggacctcctatatgcaagctggtttgtaacagggttgagaatgttctacagcagtggtttccagcttgggcctctatactcattaaggattctgaagattgtaatggggggagatgtggtctgtaaggtatttattgtatttcaatggaattcacagctttgattctgtgatgctacatgagctatcaagaggagaaatcgtgccctgcctgtctttgtgtcccctgcatttggcataggacctggtaattttagtgtatcagcctatccatcgttgaccttaaaatctcccctttggccaaagttgtgtgtttactctgacagattctgcttcttaaacatttggtaaatccacatcctcttcctcatccctcctaaacaccacctaatctaagcttttattttccccctgcattattaccagcagactcaagactggctcatctgactccagcctcatccctccaatctttccgcctcatgccccagagtgacctttctaaaaacataaastccatttcccacctaactaaaactattccatcagtgaatgtaatttttcaaaaaaacatttaaggacaaaaaaattctcctataacttcccattacctagagattcaaggcaacttccctttgttggctttgaaatcaaacagacctgttttcacatcctggcttcctcacttcatgtccgtgtgatcttgggcaaaattacttaagctctctaagacttaatttccacataaggttgtttgagaattaaatgtaatatatataatatatttaaaacatatatcctatcagcacaatcgacagtagctgatgatgatgaattatggatgtgaattatgatccgcagggcattcagccctccttcatgatacccccctgtttttgtttctccatagctgtagttctctctcctccctgctttaaactctgtactgtaggtttttagaactgttaatggttgtcccaaatttacatgttgtttcataacttcatactttgtatgcagcatttcttttgtcccagtgtcttacctcatctattaatctctcactcattcttcaagacctgctctcaagtatttaatcacacacacacacaaacacatgcacacacacacacacaaacacacactgaatcttttctgaccttcacgtagatttgaccatatctttctctatgtccccacagccccttgtgtaccttgtgtaattgtactgatttattgcccatttcccttttacttgtcagttttttggagtagcagtaattgagttttattcatctttgttttccaagaatctagcagccactgaatagatagatggaaggatggaaggcacatatggattgggttattatggtagatgaaatcttgtaaaacatggcatctacgctggaaactttattaaaagaggcttggggccagacatggtggctcatgcctataatcccagcattttgggagtctgaggcagaagaattgcttgaggccaagaattcaagtttgcagtgagctgtgattgcgccactgctctccagccatgatagaataattggaactggattaatcctcccacaatttaaaactctggacaaatatgaaaacagctgttttcacatgttggacaacagacaagacaagattgttatccctgagtgaaaggaagccagtgaggtgaggcctactatcccactggctttctgccttgaggcattttctggatattggtactagaaggggaatccccagcaaagcacaacagtcttggggagctgaaagattaaagaacagtttgaaggggagatggtttacatttgcaagtgagagtatcagacaggagggagctactcagctgaagagctccagaaacctgaattgacaaacctgctgaagactaatctgcccatatgtagggtaaaactcctgacaggaaactataagatgaacagttctcagagctcacacaagtctaggaatcctgcaggttctgaccaaccagagtcagagatcttgttggtcattcaggacaatgataagagacaccagtagggcatgacttgatagtacatctaaattagctataaagatcattttagccctgccctgaaagagcttaaaattaagctttgagaggcacaagagagggctttaggggtcctaaaatgtgctggattttaatctgagtgccagttacatgggggtgaattcgtcaagctgagcaccaatggtgtgtgcatttttatgtgtgtatgttaaacttcgatgaaaagttttaaacaaacctatttctttttaaagaagtctttaaaagatcaatctgatgtgcaagaaatctaaccttgtgtcaaaataaacttcaaccctctttaaaagaaggcaacacaatccaatattcgataacataacattcacagtatctaacatcttattttaaaagtgcaagacatgttgagaatgaggaaaatgtcacccctaacaagaggaaaattagtcaatagaaacagactcagaagtgacagatatgatagaactagcagataaagactttaaagtagattttatgaagactataaatatgttcatgaatttaaaggaagacctgattaaatgaagggagaaatggaagatatttaaaaatgaaagggaacatctataagcaacaaatacacctagaatgaaaaaaaaatcacttatgggattaagaggatatgagataccactgaataaaacatcagtgaatttgaagatatagcaataaaaactcctcaatatgaagccaagaaagaaaaaagactggaaaaagttaacaaaactcagtgatcctatagcataatatcaagagggctaacatacttgcaactggagtcccagaaggtaaggaaggtgaggaaagacagaaaaaatattttaacagattatagctgatttttttttcaattttgatgaaattatactcagagctccaagaagctcaataaacctgaaacacaatggacccaaacaaaaccacacaaagatacattttgattaattgctcaaaaccaagaaaagcttaaattagccagagagaaaaaggtatgagaagtaattctagcagacttattgccagagaccatttaaggcagaagacaatggaatgacatttttaaagtaatgaaagataatttttatcaacccagaattctatatccagtgaaaatatccttcaaaaatgaaagcactgaggcaggtggatcacctgaggtcaggagttcaagaccagcctggccaacatggtgaaaccccgtctctacaaaaattagccagtcatgatggcgggtgcctgtaatcccagctactcaggaggctgaggtggcagaatcgcttgaacccaggaggcagagatttcagtgagccgaggctgccccactgcactccagcctgggaaacagagctagaatccatctcaaaaaaaaaggcaaaactaggactttttaaaacagatacaaaattggagaaatcattgtcagcagacctgcactacaaaagaagttcttcagcggggaaaaatgatattatagggaaatctgaattgtaaggaagtgaagagaaccacagatagtaaatatatggatacatgtaagaaatttactttctcatttgtaatttctaaaaaagttaattgagtatttcaagtaaaaataataccagtggaggtattctgctggtaataataccagtagggggtggagaatagaagtattctgtttaaaggttgttaygttacctgtatacaaaaactggcataatattatttgaaggtagactgtattaagttagagatttatgttgtaaaccttacaagggccactaagggaggaaaaaataagacagagatatatagctaataagccagtattgaaggtccaaaacattttgtggggaaagagtaaacatgacaacagatggaacaaatagaaaagttagcaagatgatagatttattcaactatgttggtttttacattaaacatacattgtctagacactccaatttacagaggttattatataaaaaagcaagacccaattgtataatttctgtaagaattctactttaaatatgaagagtcaaatagatgaaaagtaaaaggataaaaaagatataccagccaaatgctgatcaaaagagagttggggggcagagaaacaaatcatccttatacaagtataccaaataatatttgtaaagactgtcctgtccagaaggggcttaatcgccccttgcccctacttgggtgtgggctagaatgtatttattcctaaaaaactgtgtgtgtaaagagaaaaagagtaactttagtggagaaactggcagacactaccttaaccaaacgatcaattttaacatcaccagtgatgtcatgtggatatcatataaccactgatgtgatgtaatgaggatatttcacttctgtggtattctttccaaaaatccactctaatcatgcagagacttctgagaaattcaaatttgggaacattctgcaacaggggtctccaaccccygggctgtggattggtgccagttcatggcctgttcggaacccagccatacagtaggaggtgagcagcgagtgagcatgaccacctgagcactctacctcctgtcagatcagcagcggcattagattctcaaaggaccatgaaccctgttgtgaactttgtatgcaagggatgtaggttgtgtgctccttatgagaatctaatgcctgatgatctgaggtggaagagtttcatcccaaaaccatcctcccttgcacctctccaccacccccagcagtccatgaaaagattgtcttccatgaaactggtccctggtgccaaaaaggtcgtgggactgctgttctacaaaatatctgaccagcatttctcacaactgtcaaggtcataacaaaggaaagacaaactgttctaaaccagaggagactaaggagacatgacaactaaatgcaatgtaggatcctggattggatcttgggatagaaaaatggcatgaatggaaaactgatgaaatcacaataaagtctggagtttagttaatactaatgtgctrttgttagtttcttagttttgacaaatgtgtggtggtaatctaagatatgcaagcttgtccaacccaccccactttgttgttgtggctgttctgttttgttttaggcttttagcagcccaaagccatagcttttagtttctctctctagtgataagtggaaaagagggatgaggaagaggctttgccggcccaaccagaaacaaactaagaacccatgactgcattctctccctttaacacccctgtttaggggaaactgaaactgggtaaggagaatatgggtcctctttgtactatctttgtaacttttctgtaaatctaaaaatatttcaaaatgaaagttcattttagaaaaagaagggagtattatgaataactttacaattttgacaaattaggtaaaatgaacaaattccttgaattacagaaagtgactcaagaagaaatagaaaaatggcactatttctattaaagaattttawatctgtaaaactttcccacaaagaaaaccctaggcccagagagcctccctggtgaattctatcatatatttaagaagaactaacacaatcttatcaccaactttttcaaaaaacagaagtaaaaggaagatgtctcatcttattttatgaggtcagctttaccccaacttgaaaaccagataaataatttacaaacaaaaaaaaaaaaaaaaaaggcaactacagaccaatatagatgcaaaaatctttaacaatatattatcaaattgaatccagcaatatataaaaaaggataataaccttttttaaaagatgtgaatacaggttggctaaatatttgaaaaaccatgtaatctattatatcagtaaactgaaaaggaaaataataacaagatatatgaaaaaaaaaatttaggaaaaattcggcaatattcatgataagaactcctagaaaatgaagtattctcactgtgatagasagcatctagaaaagacctacagctcacatcatacttaatggtgaaagactgatttctttcccccgagaatgaaagaaaggtatctgctcttcttatttctattcaacattgtactggaggttcccaccagttcactaagacagggaaaagaggtaaagccttaatgattagaaagaagtgaaattctctttattcagacaacttgatcgtgtatatggaaaattctaaggagtctcataaatgaatttagtaagggtgcaggataaagtcagtatacaaaaatcaaatgtatttctatatactagtaacaagcaattgaaaatgagattttttaaagtaccatttaaaatagcatacaaaacacaaaatacttaggaataaatttaagaaaatatgttgaaaatttgtatcctgaaagctatgaaacatttctgaaaaaaaatttaaaagacctaaataaatggagagctattccatgttttggattggaagactcaatatttttttactcaatatttttaagatgttaattttccctaaattgatctatagattcaatataatcccaacccaaattccagatggctttctttttggtaaacttcacaagctgattctaaaatgtatatgaatatgcaaaagatctagaatagccaaaacaatgttgaargagaagaacaaagttgtaggacttatattacctgtttgcaagactcactataaagttacrgtaatcaagacagtgtagaaacacatataaatcaatagaacaaaattaagagtccagaattagacctacacataagtggtcaattgatttttcaacaaatatgccaaagtaattcaaaagggaaagaagagggatcttttwttccaacaaacgtgctggaacaactggatatctatatggaaaaaaaagaagccttgacttttacctcatgcaaatattagctcaaaatagactatagacctaaaaatagaagcaaaaacaatcaaatgactagaaaaaaaatatgagagggaatcctcatgaattgggggtaggcaaaaatttcttaggacataaaaagcacacatcataaataaaaaagtgataaattggatgtcatgaaaggtaaaaacttatgctccccaaaagcatcatttaaaaaatgaagaggcaagccacagacaaaatgagataaaatattcttaacacttatacctaaaaaaggacttttatccaaaatatatttaaaaattccaaaactcaatagcaagaagatagctcaattaaaatgggtaaaatatttgaagaaacacatcacaacatgcacatgaaaagatactccgcatcgttagtcatgagggtacaaattaatgtcacaacaaggttctactgcatacccactggtacggctaaaataaaaaggctgaatttcttatagatgtatattttaaacatatgtttactgtatgaccaggcgatcccacacctaggtatttgcccaagaaaaggaaaacgtatgtatgtgtatgtttttagcaacccaaaccagaaacaatacagacgtcccccaactggttaatataaaaacaatcagtggtatacccataaaatagaaggctactccacaatcaagaagaagaaactaactactgatctattccacaaaatggatgaatctcaaatacattagaagtgacagaatccatttattttgtattctggaacaggcaaaactataaagctagaaacagctgagtggttgccaggactaaaagtggaacaagggaaatttgggggatgatggaccgtctgtatcttgattgtggtgatagatatatgactgcatgtatctttcaaaattcttagaactattcactaaagatggtgaatcttaaggtatgtaaatcatacctcaataaacctgactttaaaattatttaaacactggcaacaccaagtattgtcaaagatgtggaagcatttatgtggagctttcatcacggctgatgggagtacaatacggtacaaccactttggaaaacagtttgtcaatatctcatgaagttaaacttacgcctaccatacaacccaacaatcccacacctggctattcacccaagagaaatgaaactatatccaaacaggcttgtacatgaatgtttatggcagctgtattcatagagaacaataactgaaagtaaccgaaatgtctatcaaatggtagatggataaataaacaatgtattatatcccttatgtttatgtatttactcagtattctgtagtaacaaacgtttgatacaccaagcaacatgaatgaatcttaattcacactgagcaaaagaaaccagacacacagcactgtaggatttcatgtatgtaaaaatagaagagagaaagctagtctatagtggctgaaagcagatcagtggttgccttgggctgggatggaggaggcagggcctgactgccaaggggcaccaaccaaccttctgtggtgaaggaactgttctgtttcttgattgtggaggtggttacacacgtgtagacattggtcaaaactcactggactgtgctttttaagtgtatgcattctattatatatcagttatgacttagttaatttttaaaagtagcagccttggaaattaattttaaaggtggagttccaatattaagtagctttcagaacaactctgctgatttttagatgatttatgtacatgagcaaagggttactttggaggcaggatggctcggctttgtgctagatgcctagacaatttagtctcaaatgtataatcttgtctgagttagctttgttttaccctaaaaaaaaaaatgaggttggcaaggttaatgccttataccttgctatgttccatgaaagttgccaaagtagtgttttcactgacaatattgcattgttccctagctatggattttggaggaaaaatatggcaagaatactccttcttttagatctaaaggcgtgtttacagacttcatgtttatctcaagccctggccttctccacgccatatttctttaaaggcccagaaccctcagactctcgagatattctacagggcttgtaggaactggtgtgtgatctttccctgtgagtcaacaatgcatttgattccagaagcgagggactaggcctttttatggacttgatacttctaccctgttaatgcatttttgttagtattttctgatagagtgtttattcattcagcaggcatttcctgagcacctactatgtgctaggctttatattgggtataatgagtatggaggtgattaagacataacctttattctcagtgaggtcccaggctggttagtagaaaagctaatgcaggctggactgccagtcttgcccccacttctccagtccccatccatcctccaggctataaacaaaggtgtattacagagcatggagaccactccccaactgaaaacctttagtggtgcctcatttttctcttggtgaaattcaggctccataatatgggcctttgtaatccactttctgcccatctctcctacctcatctcttgccattgctcttctacccatttatactttttactgacagctttgcttccatacacaggagactctggatgtttctagttcagagtcttccagatgggcagatctatagccacttcaggtatggagattatttgttcattattcatttagccaaagttttttgggtgtatgctcagtgtattgagccatggggacatggaaacacttgagaaacagtcatccttcctggaaaggagcgatgagcacactgggggatgagaactgaatgcatggaggttggaggtgtgaaccaggaattaacagtttattacggctagaacatagggtgtgtggttgggagggacaaaagatgagacccaaatagacaggagggaccagattgggaatggtcacaaaaacaartttggacttcaagtttggggcagtggggcatctactaaggtgattaagccagggaatgatgtgataaaattcatgctaccaggagtcccagactaagggtcgagtgttggatcccacctcttgctgctttgctggttgctagaatctgaccaaagctttcccccaccccacgtctactgatattggacttggggtcaggggacagtgtgctagagagaattyttagtagcacctgtgaccagcatccagtcattcatcccttgtgcttttcaggagttgtttgtccatccctgttctgtcttgggccacttggcgacactgtccatgctgtgacttgtaaatttcattcattcaggaagagagcatcgtgatccagtgagccttgccctaagcgtgtgtgtatgatttgtcaacgatcgaggattttatgggagtttatgggacttcattaaagatgctggagcaggagcactgtgggacatcagaagagacctcagcaataaaccacaattccaagctttggaatgcagtaaatgtttaagagacttccttcctttcattactgaattttactttactttcataccagtaaagagttgtgttttattggttgaaatttcttgattctgtttttcccaggtctgtttaaaagctacattttatctttgaggatgtttggctcgtggtggaggaagtgctgccagcgaattcaattaactggcagagctcacagatattgtacacggatttctttttttcttctttttcacaactgctacataaacacagctgggtttaatatttgtcgtaacaaagatttaacttgaatcattttaccccgggtaattaatgcttggaatcttggctactttttcgttcgtttgtaatcctctgcatttctttactctagctatctagataatgaagtgtgctcctctaggtctttgccctgccttaaaactgcttaatatttggccgttcccactagagagcagatgcttttctttgcaagaattgaatttctgtcagctcttttatgcatcatgtgtttggaactgtaagtggatcaagttgttcatcacagcggggacactgtgaaacacatctattatacacacttcccaccccccttcctgttttgtttttttttcctcccctgaggaggtggagatgcccggatccccttgggagatatctcgctctgtgtggatgtatccatgtgatccaccatgaatccggcctggccacatccctaagcagggaaatctgtatccattcagcccaggattgtggctgagacaaaccccacttttatctttgtaaacaccaagctcttcattaactcccaaatacacaccaagtttgggtcactaagtaaatccactaggctcagcataatgagtgacatttcagtaattgatgccctagaatatgttmattgtgaacccatgattcttttcgatgctaaaataaaggcttgggtagttttggctttggagttgagctagcgcagaagaatagtcaccatcgattaggcccctacagtgtgccaggcactgtgctaggggatttgaaaatcttgacatttaatctacataagaatcctgcaaaaaaaagaaggggagggtactttatcccctttttatagatgaagaaaaggggccaagtaacttgcctagaggcatccagataattgccaggaggagagccagaatttgaactcaggtcgggctgagcccagagtaaatccatgtactgtaaagtgtggtcccctcatgcctagaggtcactagaatatattcatccattgatcaatcaagacattgatttattatgcatgtttatgacatgctgccattgctccatctgagttgtctcattccatgtcaggtctgaagtttggttggcatttgtgaacacctttgtactcatctaaatctgaactcctggtggtgactggaatagttttagttttgcttttctctcaaagctcagtgcaaatacaacccaagtgccccaagcaacctactgttttcttagagttttgtgaatttcaatttctagctgtgaactgatggttaaaatttctacacctctatggtttagtttgttaacacggctttagggaagcaggcatcttggtggcattcctgctgtgatatgctcatcttttgggcctcagatagtggctctgagggcagaagtgcattttggttcatttttaatatatgtcattcaatttgccagagtcattgtgagacattcacatgtctgactgagatactgctgatctgtagaattaattatagttaaatggaaaggtggcttttgctcatgaagaaagtcgttagtctcttgataaacatttttaattatgattaactttagtcttcctccaaatactttccattagaaaaggcattaatgttctggttcattagaaatagagcaatccttttatttttggtttgcagtccattttgttcttgaaagatattggtccacttttttaaaaaaaaattggtggatgttgtgttgtaaaaaacatataagtttccttttgcaagtgcatatcagttttttcaaaggtaacttacactttaattttgtgtgttgtgtttgcaagagaatgcttcttggtttattcatgttgacaactgaaaagccttagacctaattaaaagaatttccatgagcacctttactgaaccatttcattacgcggcactgcacagattgcattgtgaaacatggtgatagtttaaatctgacctttaaacctgaactgccagaagtatggggggaaaacccttctttgaaaacactccccggataaatatatgtgtgtgtatgtgtatgcatacatgcatgcacatatttggttagaagcaatctttttatggaatgaccacctaataatataaatacacatttactttgagctcagatcttgtagtctcctgtagcttgggtaggattttctagctacattaattgtgtgtgtgtgtttgtgtgtgtgtgtgtgtgtgtgtgtgtggtgtgttaaagctaaattgttgtataaggaaaacaaagataatttcacttactctgggccaacaaaaaaaagtatttggaggaaggtaaggtttacaaatagaaaaacacaaaagtcttcactactgtgtgtttcagtttcaaatggtgagatactcagattaatctcatggggagagggctggagtgtatatgtgtgggcaagactcctcctgagctttatttggcagatagtggaaacaggccttttttggttttgttttaaaattgcacttttttactccaaggatgtcattctaaggatttgatagcttattcctgggatgctcagcagagccactatagcacataacgaagtagccattcacataatgataattgatgcttttgtctgacaaaaagctgcctggaattctaactcttgccactaactttctgacatatacacagcccacaagttgtcaggggagagggagggagcagagacccgggctcgtagggtcatagccagctccagcatggaactccacataaatagcacagccctcactcccccatggagaaccaggatctttgaggggagaatgggatgcagaagaagcaattaaagccaactgaggtcaaggtacaaccatgttctcaagaaagaagcaggaaagcaaggaatgagaggaaacaataatggagatatattaaatcagggaaaaaataaaccagtatcatggacatatctaatttggtggtctaagaaaccctggcagcagtgagaatcaatggactagcacagactctggagtaagacagacttggacttgactttggcttccacccttgccttactgtcagtgtgatgtggaactgggtcttactttcctcatctgtgtagtggggatagctgtgcctacctaggccatttgttctgaaattttaatacaatactggatatgaaaatacttgtcattgtcatttgggaactagtagggtgcttgataaatactggtttctgttcctttctcctgataaatttcttgttcttacagaaactattcctgggaaagagactagggtgttattgctttgacatattaagactttttgttttgaatttgaggcaagaactaaggaaggcataggtagatatgcttatgtaatggaagtgacagtttgccatttctcattgccagtgtgaaagtggcagagggagccaatgtttttgtgcccctgaggatgggaaaacaagtcactaatcctttctcccctctccagacgcacacattccctatgggactttagaaaaaagccttgatgcctactttatccaggtaaggaagaattaatcaacttgccttagtccttaaaggggggaggaaaatgtgactctgttgcccctccacacctgctgctgtgtgtctaatttgtaataataataataaaaaatctttcaactccaactgtgacacccagcagttaatgcaactcccaggaaagagaagcagtacctgcacagactaacttgagccgggcttttagaactgtacctctcaatgaggtgcgccagcactgagggtggacatggttcctcccttcctagactggtcagtctaatagaagagacagacattaggccgggtgcggtggctcacgcctgtaatcccagcactttgggaggccaatgggggtggatcacttcaggtcaggagtttgagaccagcctggccaacatggtgaaactccatctccactaaaaatacaaaaattagctgggcgtggtggcacatgcctgtaatcccagctactcaggaggctgaggcaggagaattgcttgaacccaggargcggaggttgcagtgagccaagatggtgccactgcactccagcctgggcaacagagtaagtgagactccatctgaaaaaaaaaaaaaaaaaaaaaaaargaagggacagacattaattggattcttgcagaatgcatcattatacattgttgtgtgtccctaaatgaaagacacagtgagaatgtataataggggaaccttcgtctagcctcagcagttcaacagaggaagtgatatttgaactgagacctgaaggatgagtagtagtcaacctagggccctgtgttgtccaatatggtagccactattcacatatggctatttaaatttaaatggattgaaatgaaatagaataaaagtttcagcttctcagtcacaccagccacatttcaagtgctcagtagtagctagcatattggatggcattggatagaagacagattatttccatcactgcagaaagttctgttggacratgcagaattctaggcaggggggcaatggtgggtgagagcactccacaccggaaataacctatgcaaaggtcctggggtaagggggaggccagtgggactggagcccagtgtgggtggctaaagccacaaaggaggatgcaagagcctctcatctcagagactggccaaatcaaacggggccttccaggccaggctagggctttagtctttttctccagagcagtggagaagagctgagaaatcttaaggtgccagcattgatggaaagagatagataggattgtcttagaggtgaacactcaatagtmtgccatccactcccaggccccagaagttgcaaccaagtgataaaggaaaaacactctacttgttgagcactaatgtgtattaaaagggtattttcattctcctggggagaaagacatgtaaactgctggtatataaagggctaaagaataggatgatggtttatacaacatgagaaccccttctgaagtagcagtaagctaacttgtagccgatttgtaggggctaaactggaagtccttgggagacaggccctccctcctctgcagttccgtttccagcacatctccagcatgggacctgcaaagattaggaatcaacaaaggaataggccatcatgccctgagaaagagctatttgttctgacagaaagttggaggcttgtattttttaataaaaagtttgttagagaatacgataaagaatatcccaggtttgcgaatgggttttgaggcctttgaaatcaagtagaagacaaaggtgcaaatggagcttgagccaagcccataacaggccttaaatattgtgctaaggaatttagactttattatattcacagtagggagccactaaaaattttagagggaatgacatgatataacctcttgttttaggaaggtaattcaatgcgaaggatgaattagactaggaagagaatagaggaagagatacgagctcaaagactgttgtaatagtactggtaaaagatgaatctaaactaaaaaaagccaggcactctactacatccattcttcattttatatccattatattttactcctcacaatgtatacatgttgtacatacttcattttacagccaaagaactaaagctcagaaaggttaagaaagtagggaagccaggtccagcgaagccaatcttagacctaggcttctgtgattcaaactctatgttttactgcctgaggagtgcagtggggacagaggagtagatgaagccaggggacctgagaggttgagaacagtgaccagtgaaaggaggaacaggggtacacggtcgggtgaaggcagggccggggcaatactgtgtgtgttactggatgtggtaagtttgtggttgtataagaccagtctccttgttccctctgactcattcagcatgcagatagatgttcatttctcctgccattgtggttgtgtcttagcaatggcattctacagaagaggaatgaatatcactttctcttcccatcctttccaacagagaccagtttcttctaatgatccgtcactaaagaatgtgatcctagactttcctccaagcagagaggctcagccactgaaaatgcctttcacaatgtcaagcacttgctcattcgttctttcatttggcagaaagtactgcatgagtacactgagtcaagaactgtgctggctgctggccctgcggggaactcagtccatcaggaaaggaggtagaaactgcagctcaccatggaaccacctgctcagtccaaggaggcccagacttagtggtcagggcaggcttcacagatggggggacatctggattccctctttcccttaacccaaggcaatgggtaatttgactattaaagaaaaatacctcattttaattctttattataaaagtaacatatgcttttttataaaggataatcaaaacaatcaagtgtgtaaaatagaaagtgaaagcatccttgcatggttaaagtttggtaatgtagcattttagatttttactgcatatatatttatatataatttttaaatggttcatgctgtacatgttactctgcaacctgcatgtttttcctcactcgacagtatttgacagacatctttttgtgtcagttcatagagtaccgccatgtcctttttggcagctatgtgatatttcctggtgaggatgcgggataatgtatttcagaggcccccattgatggagacttggatggtctttcagaggctgaatagatgttcacaagcaggacaggaagggacaagagacagccaggactgagctagtgacatggaaatgggctgaagagtagcctgtgcttctggacatccaagtttaacattaagtggggcaggtggaagtgaggctgatggaggacagcctgcacagtctgctcgtggaagtttggatgtttttctgaaggtgatgatggtgaagggcgggggcaccgaagggttttgatggaggatcaaagtgattggatttggatttttccaagattactaggacagatatgggtgaatggcattgaggagaaactgaaggcagaagaaggcccactgaggaamccgctccactagtctgggccagagagggtgatggagctgaatttgcagggccaatgtcatgggcactgagaggagaggatggattcagggcatatctgggttggtgttgaggagatgtggagaatgtttgtgggaaggagggagaagtagggaatctgacatctgacgcctggcccaggagactggccggatgatgctgcggtaaccaagatggcacacagaggggaaagggcgtcttagacagaagctggcaagttcagttttgccccctctttcctttgccttgtcttcctcctataacacccgattaaaggaggaagccatcctcaccagcacttacaacacacccaaattacccctgatgaatcccgatgttaatgatttgaccagcacccctcggggtactgagggcaagttcagctttagatatatgactctgtgttgtttaaacctgaaattgtcttcccttacttttatttaaaggacaaatgctactccccagcgatcagatgcacagatacttgcagtttcaaagtttgaggtgctggcaggtcaagacaaaagcttctccatgtttcagggtgacaagaggtcttcagaagtcctggcctaagtggtcacaggggcatcaggagcccaggaccacttggctagtttcagaccagctggggcaggcaggaaggracacactcgtatttgctcagttacaatcaacgactccttctttgtgtaaaatggtaatgaggccattaggagaggctcacctgaagtgcagcgttgtgaatccaaggtaattaaacacctcccgaatgaaagagaaaggccagggaaggttaagtgaggaataatctgcggcacaggtggcccaaggcccttgaggagccagaaggagagcgacagtggcttgcaccatttcaaaggatggaaatgtcactgtagtccctgggaggggaaggatttttatttttattttgggggcaggggcagggagtgggtagtatttttagcatgttaatagagcatgctgctttttcatacttctctttgtaggtggaagtccatggcagagtcagcctgggtgctgagtggcctgcattgctcctcaggggctctcatcactgtggggctggggcttatgtgtccttgataaggggaggtcataataaatcagttatagatacccggatgttgaggtagacttcaaactgcttccaaaggaattgttttccatggtcccctcttggagtagaggtgggataactaccccctcagtgtatgttcccagggctttttacttttcctttttttttttttttgagacagggtctcactctgtcacccaggctggagtgccacggtgcaatcatagctcattgcaacctcaaactcctgggctcaagcagtcctcccacctcagccttctaagtagctgagactacaggcaggtgccaccatggctggctaaatctttttatattttttatagagatgggatctcactgtgttgcccaggctggttttgaactcctggcctcaaacgatcctcctgccttggcttcccaaagcgctgggcacgtccccatggcttctaacttatcagaggagggtatcagtcccatcttcactcagtttagtgtccaaacatgaggcacgccctttatcaacagcaaaggattgttttcctgtacacagttcacatttatgaatggcttcctaggcactgagcactgtgcttggtgacttcatgtatccttccagyttgtcttcattgcataaggtctggcagaggatttttgcttttcagattgtcacctcaaaatttccattgtctccacacaaaagcttgcacatgaatcttcgtagcagcattattcataacagccaagaagtagaaacagcccaaatgtccatctgcagatgaacagatcgataaaatgtggtctatccatacagtggaatattatttagccataaaaagtatgaagtcttgacacaatgctacaacatggacgaaccttgttcataaaagcactgtgctaagggaaataatctgatggcaaaagactacctattgttaattccatttatatgaaatgtccagagtaggccaacctgtagagacagaaggaaggtgagtggttgcttgggtctggtgtgggggaaaaattgataggtaatggggagtgacagctaatgagtatgaggtttctttcgggggtaataaaaatgttctggagttagtagtgatggttgtacagtcttgtgactacactaaaaaccaccgaactgtgtactttaaatgaatgaattttatatgtgaaatatgtctcaataagctattaaaagtttttcttatcagaagcttgggtacaagacctaatgtgcgtggatcatttctaaagtatgatctagtccttcccaggtcggatttttttttccccagacttctcagcaagtgattcttaatatttctagggtcacaggcacctttaggaatctgaggaaagctgtggatcctgcgcccagaaaaataatcttcactcattcatactaaaaatctgtaaaggattcatggaccacctaaatctaattttctattttatcctaagttttgtctttaaatgatgtcataccagtagctggtctcttacagaattagtttctgtgaaacgtgctcttgatatgttacctgcatgcttaaaaccaatcattagttttctgtttctctctcaagatgaaggaaaaaaatcccttcaggcccctgcctttctctccagcctcatttcaagccatattcccctcattttcgccaccgaagccagggttctttctgttccctgaactcttcttcgctgcagggcctttgcacaccactccccgtacttagcacgcggtgctcacccctctttgctgagttaaccaccctcacccatccttcagatcttagtgcaagcttgttgccctccaggaagccttccttgaccttcttgacaagctctgttacaggctcgtcacagtagcaatggcacatgcattcctgtttttctcactagaatgtcagctgaatgagggcaagacccacgtgtggtttcattgtatcccttgcattctcaacacctaacatagtcctcggtacataggaaataataaatatttgctgagtgaatggataactcgaggtcaccacgtcgcacaattcctcttatggggaacgcagcgtgaaaggtgtgctctgaagcgtggcatcttgagatgaatgaagggcatgttagaaatagtccgggaagcttgatgttgagggcaacagccaccatgtcacacagtctttcctacattgttttttatgtctcacttttcaggaaaatctttattccatttggccaacgggtttgtttgtagtacgtggacctgtggagtctcacaaccttcatctttccctccttgctttggctactaggaggcttttaagtcaaatttaagctcatttctagccaccatgtaagacctggtggcttacatttatataccaaatgtattacgtgcttctttgcccattaccatcacttccgagttttttgttttaacctcttgagtacatgtctattagtataagctgccacacttcctttagagtatgatgtgtgagaaatataaataagcctttattctaacatttgtaagtagctttaagaggggatagaatgggaactgaaagtctgagtttgggcccagactacmagactttgattggaatgtggcccatgtcttgagtttgttgctaggtatgtagcctaacctccctgaggctgttttacccttgtaagatgggaacattaatcccttcctcaccggattgttaaaataactaaattgtaaaatgtatgcaaaagtgcttacctggcatggagtaagtcattaaaaattgtttttgtttttattagacatgttctaataggaacaacattcatttaaatttcaaaaacatgccctaattctgaacacttttttttttttgagactgagtttctctctgtcgcccaggctggagtgcaatggcgcaatctcggctcactgtagcctctgcctcccgggttccagtgattctcgtgcctcagcttcccaagtagctgggactacaggtgtgtgccactgcacccagcctgaacacgtttttgtcctcccagtaactgaggtatcaaatggatcctgccatccgtaggatcttccagggctccatatgtagtgggcttagtcagccaccctactttgaccctgtcctcaacctgtgttttccttctctccatcaccagatctcttccctgaagaacaggctgaaaaaggtctccacaaccactggggatggtgtggccagagcgttcctcaaggcccaggctgctttcttcggtagctaccgaaacgctctgaaaatcgagccggtgagtagccttggcatgtcacagagcctgtgtttggtcagggctgagaagcatacctcaggggccacaagaaatgccatgattcttctggtttccagattcatctagaagagcttgtgtgtgtttgtggtgggggacagtgtactccccttgccatacctctcaacacaaggaggctgtgctatcatgtgtgagaccctcactgctctgggggctgttatgccctgtgcaccaccctagacagtaagccccaaccgcgtgtcagatgcagcgccaggcccctcacactcacctgctctccctggggcttcacagtgcacctgtgcagtagcggtgatcagctccactttacaaatgaggaaaccaagactcagggaagagaaacaacttagcccggaaaagccagatggccccggagcccctgctttcccactgggcctcgccacccctgttctttcacgggaccgctcctccacgcttgagaaagcagagcctcctgggtctcacgcctcatggctcctgagagtggttttggtgtaagtgaccacaatgaagaccgggaagtgaccttgcccacctctggcccttccccctttctgggcctcgttgacttatctatgtcccctgcctgcctcaggaagtgactcgtgattgcaaggatgtgaagacagcaggtcttctctgaaaccaagggcagtagcagtcctcttagcttcagagagaagttcttctttgctgtttctctcctcggcctactcttggctttctggttgaggagaatgcaggaactggcctagggacctgggtcaccctgcagaggggagaatgttggagggaaaccttgccgacaggcctgttctcccaggagcacagggctgccttcgtcttgaacgggtgagtgacgctgtcacacccagcctagtcggagtcagaatcagagttgggtgtaagggaccagcactggcttcactgcctataggccggggctgtttgtttctatttttactttaacctatagcatttaattagatcaaatcacaaaagatgaggggatgtgagacaatgcattctttatagaaattctgattgtgagcaggggtcacgcttccttgtaagccgcaattatacattggtaagtatctttactgctctgactccgtcgtgtattcaagtaaaacacaaagagtaacagcaaacaccttgtttccccatcacccaggacctgctctctgtgaagtggccggggcagtgggtgctcagggagcagcgtcctaaccccaccctcctactcctttttatccatctagcacttaggccttactctctaggctgcctgagctttgggcagtgccatcgtcactgtgtgctcacatagcagaagggatacactctctttttgcttcctgagacatatttcccttaggtttctcgaaagcccttcagcttaaagccagttcttgatagtgtcctgctagtctcaaagtgacatggctctgattacttgtcacgatcttgggtccagccaaaccaatcaggttcaaagcagtgacagctggcacaattcaaggaaaatacagttgtcttcccccctttaaaatgggaatgaataggacaactggcccaatcctttgcttgggttgctgggaatggacagacttgaagtattttcactcttgcagtgatctcattgttggcctgtgtgcatctggaatccaaaggcagctgaagttcgggacatattgctgctgcaggatctgggcacaggctcctccacgggaggagtttatcgttgtacttgcacaaggtgctggaaggcactggatttaaggacagaagccctggagtttcaagcctggctctgcacttcttagctgtctaaaagttgagcaagccatttaatccatttaaacttcagtttcttcatctgtgaaatgaggataagcctgcctgtccttcctgaggatcaattgagccataacacatttcatcaggaaggtgaaacttgaactgggtctgatgagtaaggtttgggaaaagaaagaagggagcatcccttcctasagtgagggtggaggtaactgaggaagcaaaggcttggagacagggcccctcatagccagtgagtgcgccattttctttggagcaattgggtggggagatggggctgcaggagaggatagagccaaatttggcggagccttggatgctacgctaagagagtgaactttaccctgtgaggagtgtaagtttttgagcagaaatgtgacatgactgaagttgcctttgagcagtagtacagtgatggactaaaaggagagctggaggcagagaaaccagttagaggagtgttatgggaactcagaagagagccccgggtggctccaccaggaacagggaccatgaaggaggaagtagcaagactccgcaatagatcaaatatgggagatgaacagcaagaagtgtcaaaatgtctcccaagatttggagcctaggagaggatgaagacacccctagttgcaaaaggaaatgcttaatgccaaggtgttcacagtagcagcatttctaatggtaaaacactggagtatactgagtatccatgttaggtaactggtgaaataaattaaagtctgtcttatgatagttttaatggctatgtaatattctatcagcttagagataacatgatggatttagatggagacatggcacttgtccttgaatgtaagatgctgttcagtcataagatgtactattagtttatgtaccattaagaaagggaaaagagtggtgccaattataatcgaaggatgccaccaattataagacacatccagatttcagaaatgttacaatgggaagtaattttcatcttagaatcaatgaaatatggcagacctgtcagcctttcaatcctgttcatctgaaccacaatggctttcttccataaggtggagaaggaaaccagaaggcctggaattttccaaccaagcttcaagtcgtggtcatcaccatgtcacctagatggtttttaaactatagatttaattttggcaaattcycctcttctaaaatatgatgtaacaacattccccatgtaagattgcttggggcagccaggcatggtggcacatttaagaccagcctgggcaacatagygagaccccatctctacaaaaaataaattagctggatgtagtatcacatgcctgtggtcccagctacttgggaggctgacaggaggaccacttcagcccaggagtttgaggctgcagtaggccaagatggtgccactgcattccagcctgggcaacagggtgagaccctgtcttttaaaaatrttgagcggattagtttaaaataatgactgcaaagtacatatgagcccaagaaatagggaggaggcgttggctgcatcggggggaggatggtgccttgagtgagcctgccagggtgtgctgaggccctccccaaggccacttgtctttttgttgtttytctggttataaaaatagcacctgctcttcattggctcacgcctataatcccagcactttgggaagccgagagaggtggatcacaaggtcaagagattgagaccatcctggccaacgtggtgacatcctgtctctactaaaaatacaaaaattagttgggcgtggtggcacgcacctgtagtcccagctactcaggaggctgaggcaggagaatcacttgaacccaggaggcagaggttgcagtgagccaagattgtgccactgtactccagcctggtgacagagcaagactaactcttaaaaaaaaaggtttgaagtaacaggactagaaatgagaaagcaccacccataatcctatcgtcgcaaggtgagatacagtggtggcaggtttccatccagcttctaggatttttcgtttcttttgtttttacatttttgggttttggttttttaacttccttctaggcagatgagatatgcctgagaaagcaatccagtatcctagttattaatattttttttgccttttagtttgtgtaagcattttccacaccacataaaaactcttcttagacatcattgacagtggctgagcagagcctatcaggtgacccttgtggttcccaaccctggccgcggatcagaatcacggagggatgaggagcggggggggggsggcttttaaaaaggcaaatgtccaggcccccytcagagatttctgtcaagttcctgtgatctgaaatcagagccaaggcccaccatcttttcctagtgctggtctttaaaaaaaaattattttactattgtattattattattattttgagacggggtctcgctctattgcctaggctggagtggcatgatcatggctcatggcagcctcaacctcctaggctgaagtgatcctcccacatcagcctcccagctagctgggactacaggtgcatgccactgaactcagctaatttatttttaatttttgtagagataaggtcttgctatgttgcccagctggtttcaactcctgggctcgagtgatccttcagccccagactcccaaatctcgtgctgagattacaggcatgagccaccgtgcccggcatgctggtctttttgattgtcagtaatgtttcatgataccacactgtgctaaacatctttatataaatctttatgcatggtttgaattattttcttaggcggattccttgacatggatttactgggtaaacggatgtgagtccatttaaggcctttggcacataaggtgtgagagaaagctggtgagcagacacagggggatgtctgcagggaatggcccctgaggcgggtgccagggcagggcctgagaacagtaggtcactgggggcagaatgagcctgcagggtagaaggccaggtatgtgaacgccacgcagggcagcccagctgcagtgctaccagccctctggctcacctgtgctccctgcttcacagtgcctccacaacagtgcccaccatgcagggtcctggggtactgcccatacaggtgggggaggtggaggtggggtcatggctgtcaggttactgcagtcacagtgctgtgttttgttggaaacagaaacatgagggacctaagcgggctcctgtctgctctgcttctgcctccctggaccctgagcagttattcacctctccaatcctcagttccccttccataaggtggatgtgtaatcccctccttgcaggagtgtagtgaggcttaaataagcccagcacggtgcctgtcctgacggccctgggaagatgggcagaaccctgccctcgcccacctcctccctctgaggaggaccctgccagtctggagcccgttgggggacagctccagtccgtggcctgcctggctctgtaaggaggggtcgagctctggcctgagaagcagaggtgggcatctcctcctctgcagtcacgtctgaagaacttttccctggctcagagctcccttgagatttttaccaccttggcctctctctctctctctctctctctctctctgtctctctctctctctctctcgctctcgctctctctcgctctctctcgctctctctctctttcctaatgaaaaaattcagaatgcagctggctgggggactcctgagctttgttttctttaccagatccagaaggaagaaggaaggggaccgcttgctgaggcccagccctgtgccaggagctaggcttctcctccccatctgtgctttctgcgggtttgttggggaggctgggtgcccggctcagggcggggagggccagtgttggctccctggtgatgtgtgtcttcagggccgggtgaattattccaaaggactctctcagggtcagaaactgagatgccaggggtgtccagtcactgccaagttcacctcagtggcctcccacagggtcagcactcagttcaactccgagttgcttcccatccgtgctctcagtaattctccatcccagcccctcactagccctttacacacaggggatggagcgaaggctgcagtgattcctaggaagcagcagagccagcagacagcctccaaacccaggttccctccaacacatcctcccgcctgtctttgttctagtttccacatgttccgtgttagtaactctctgcatttccaataccaggcacaggtcgtggcaccgtgtgtaggtatcagtgaatatattttggaataatagacgggagaatgggtgaaggaaattagggaatagggaagcatttgaggcagaggggctccacttggcctctggtgcatacacattgcatcctgtcctatctatgggcttcagaggttgctgcttcctgatagaggggaaggtgtctgcaaatcacaagggcatgtggcccatttttcggtcacctggagaaaatcagatgcaaagcccaagatatttaacaatatcagtcaaaccaacttgtccttctcgacttaaatgacagagctaccagcagccaggcagccccatccagagaaaccccctttatccatgtcaagcggcagcccaggctccagctcatttatttaggcctttcttgctctctgacacgcctcctagcagttgccaggcaactctgggagtagcagtgtgtgttagggattaactagttagggctggggtcctttttggcaagaaggggataaaagacaaatgagtttaattgctaggccgagggtcctttctctgcatggtagaagattgcaacttttggaggatatgtgtagcagtatggttctaaaatttgccttgaatattcctccttcctagagagaacgaaagaattttttaaacaatcttttacctcactcctttgtttaaaattatatcatcatgaaatctgaataaggctaatacacccccctcgaaacacatttcacacacgctggtctcagttttaaagaacttttgcagatagatttgtgtgctttcaattcatccccttttctgcttagagtttcttatttcataacccatgctgcatgacggtgcatgtgagggttcctctccccatgtctggcccaccgcaggtccttggtatatgttaggttaaagagcaaaacccatgggtattggtgtttgaagacgcgtcctcttctgtgccagtgtctgtggaaagrccagtgtagatggagcactatgggagctgtttattcagctagcttgtgtggccctctctgggccaacctgctagctgggcttccctaagataaagggaacagagctactgcccacaggagcgaatgctgggtgggggcagtaagcaaactgtttaaacaggcagcagccagctcactctggtcccacttgcttagttcatcccaagaggccagcttccagattcagctgtgggtacactggtatcatccaccttatagcccatgattttgcatgtgattctgctgagtcatatttatccacctaaaacccctggaggacgcagaagttgagataaaagcagattgatagcctggctttcaaggatgaatgcacgaggttgtgttggagcaggttggaaaaacaccacatatatctgtgtcctgattgagtaaccctgttgatctcaagttgtttatgaaaaaacaataaaaactgttttcggatttgtttttggtgtagtggaaagcagaaaaatatttttaaagtagtaaaatcaaaacagcaccatagtcccactgatttttactacatatgccttttgtatttactctttattttttcattatgcaaagggtttacataggtacaagcaaatctcagttaaaagttagttccccgcccccatttaacaagatttcatatgcattttkacataactgcagaatattccatcaagtataactaccataatttccataaccaccctcccttgttggacatttaggttatttccagtcttttgatattataagtaatactccactaaacatctttgtgaataaagctttgaaatgctgtatttcaaagccttctgagtggaagaactgagtctgtgagcaggagcctgactgtgggggccaacttgtcacagcatcgcaagaaagcagatttcggttgactcagcctcgcggtggctcaagatggaaaaagaatcaagaacccttgatgggtgggagggtgcgcactccctgccctccacacagacaagcagaggattcccagaacacacataagggatgtgactaatttgtctgtgcccccatcttgtgctgaaaataggtttgaggaaccttaagacactatgtacagtacagcaagatgagagataargaagcaaggaaaccgggagaaagaggaaactgcatgacgcctggaagggactgatgtgtgtgtgcagctgtgtgtctgtgtgaggctctgtgaccctccacacaggttgggagtggtggagctgggactcaccccatcacacccaggtctgtctaaagagcccatgctttaaggaaaaaaaatgtaaaaaatacatataacataagatgtgctattttaaccattgttaagtatacagttcattggcatgaatggcattcacaatgtgcaaccatcactactgtctatttgcaacatttttcatcactcccaacagaacctctgtatccagtgagcaagaacttctcatttccctttcccccagcccttagtaacctctagtctactttctgtctctatgaatttgcctattctagatagttcatagaagcggaatcattcaatatttgtccctttgcctggcttattttggtagcatcatgttcaccaggttcatccgtgttatagcatgcatcagaacttcagccctctttaagactgaataatattccactatctgtatataccatattttgtttatccactcacttgttaatggacacctgggttgtttctatgttttggctgttatgagtagtgctgctgtgaatgtgtgtgtataattaatagttgaacacctgcttgcaagtcatttggctatatacctaaaagcgcagttgtgggtcatctggtaattctacgtttaactttttgaggaacctccaaaatgtttttcacagagtccgtgcttttgttaagtgggtagcagtgtctgtgggaagcacgaatatggacccaagaatatctgtaggaaaagttcatgaaacatttgttttattttccggtatattttaggcaagtggataaggaattatagccaaaacctacaggccggagctaagcagattcattgatgggggagtgtaaaggggactgcagaaggggctggtaacttgctaattaacattttttcccattttagtggtcatctgaagtcaagatcatgtcctgggaatgaagcaaggataaggggaggtgcttctgccccaggacttcagggaccatcactatagctctgtggctctaagtggctaaggaggccaccgaatgtgatggaaggagtatggcctttggaatcacctgggttttaattctagttctgtcatctactagaagatgactctggaagttacttcaccatcctgagactcacttttctcatgtgtaagatgtaaataatgcctagctagcaggactcttgagaaaaatagcaataatatgcaccaaacaccagcatagtgccttgctgatagtagatgttaactaaatgatagtgaccatccctgggtgacaaagtaaaggaggaagggaaagatgagactgcgacattctagaatagtggtgtccatacttgttcaacaagtgcccaagaacctggagccatgcaaaacaccctgaaattattctggcccatttaattctttcttttgaactaattgtgaaagtatggcttttatctcaaatgatacataaaggatttgaaataaatcacatatttaattatttcctttaatatttatttatttatttattcattttattgcccaccagcaattatggacaaataggggtggaaggtaccaagagttgaaaatcagagtcatttaaaaaattacagtcaggttttgtttttgttttgagacagagcttcactcttgttgcccaggctggagtgcaatggcgacatctcagctcaccacaacctccgcctccyaagttcaagtgattctcctgcctcagcctcctgagtagctgagattacaggcatgcgccaccatgcccagctaattttgtatttttagtagaaacagggtttctccctgttgatcaggctggtcccaaactcccaacctcaggtgatctgcctgccttggcctcccaaagtgctgggattacaggcgtgagccaccacacccggccctacagtcagttttttaaatgcatatgagaaaatataattgaggcttaattcatcaaaacatttgttgcctattgagaaaaaatgaccattgttcaatattggcaccaaatctccactgcccacgtcacagggacactgatgttgttcagaacccagtttgagagtcttgttaccttggagtcacacaataaatgatcaatgaactgggaaccattgttctagaagtagactgcccaagtaaaaagtagctctctaagtgagagaagatgggaactagcaggaaatccacttaaacactatgatcaatctcaactgaatgatttcaaagagcataactgaatatgatcaaaatgaaatttcccatatgttcaaatgaaattcatatgaaatacttgaaaaataaaacatagctagtatatcttgcaccatcctggaggaattctaggctttaacttgatctcatttaataatcctggctcctttcttactttgctcctttaaagcatggggccatgttttatacacattgatgtccctcacatagtctggtattagtaggtgctcattaaatgttgactgactggatgaacaaatgaatgactgatacctgtttccccatgctatacatcagaaaggctggtggtcatatttcagtgttgcacaatagagatacttagttgttgttttttttttttgagatggagtctcgctctgtcacccaggctggagtgcagtggtgcgatctaggctcactgcaagctccgcctcccaggttcacaccattctcctgcctcagcctcccaagtagctgggactacaggcgcctaccaccacgcccggctacttttttttttgtatttttagtagagacggggtttcactgtgttagccaggatggtcttgatctcctgacctggtgatctgcccaccttggcctcccaaagtgctgggattacaggcgtgagccacctcgcccggccaatacttagttttaaaacgtatcagctgcagcttcatcttagaacctgagaggaataagccacacaaacaccacatcacgaatgtgtaaatgtaaagcgaaggcacagcccagcagctgcatggtggctaaccacaggcatttagagttagggaggatcatctcctgcagaattgtcatgaccagtaaatattctcttctagttagaaatacacaagagaggactatagtcatggattaagctgaagccaccacggcagttttaaatactctatctttgtggaagcagtggcaaagagaaacggttgctgctactggtgttttaaaatcagatgttctcactttagggtctctcactttttcagtgagactctgaaaaggaaatctttctgatccattttcaagcaatgataacatttgacaatttgcagcctgaaatggtgctaagtgacttcatatgcatagctagactatgaacttcttaagaacaggagatcttgggaatgggcgtggtgtctcacacctgtaatcccagcactttgggaggctgaggtgggcggatcatgaggtcaggagatcaagaccatcctggctaacacagtgaaaccccgtctctactaaaaatacaaaaaaattagccaggtgtggtggcgggcgcctrtagtcccagctactcaggaggctgaggcaggagaatggtgtgaacccgggaggcggagcttgcagtgagctgagatcgtgccactgcactccagcctgggcgacagagcgagactctgtctcaaaaaaaaaaagaacaggagacaggagatcttattcctatgcccccagcacacagttgatggagggatggtggatttgttctgtataggacattatgatatctgtgatgattagaggatacagttgtgttgatttcatccccaccctcagttcttggatatatatcttcactgattttctgtggggtgcggttgcattctctgaaatatatgactacatgacattcaggcttaggctacccttccacaagaaaattgaagccttctccagaagacagtggaatgtcatgtttactcatgtatccttggcacagaacctgatacatagaaggtgctcagtaggatgtgaatgaatgaagttgtcatagttctttttttttttctttttgagacggagtcttgctctgtcgcccaggctggagtacagtggcgcgatctcagctcactgcaagctccacctcccgggttcacgccattctcctgcctcagcctcccaagtagctaggactacaggygcccgccaccacgaccggctaattttttgtgtttttagtagagacggggtttcaccgtgttagccaggatggtcttgatctcctgacctggtgatccgcccaccttggcttcccaaagtgctgggattacaggcgtgagccaccacgcctggcacatagttcttatttataatgtccttagttgtttggaagctataaaacagcttcgttaaataaatcattaagacctgaagtcttaaggaaaagaaaagaacagcatttgttatatgctaggctctttatatatattcccctttttacagcccccctgtggagagcatgcacagccccattttactgatgagaaactgaggctaggaaagattgtcactttttaagaagtggcagagacaggattggcccctccatctgcctggttctggtgaccatgctcttttctctgactgcactccacaatggtgattaccatgtggttcatattacatgtgatttgagggcatttcagaagaaaactgagttggttccctcttaggagtcaatttctctaatctatacaagtgtttcttgacaaatacaggttaaactaacaacctttataaactattttgcaaggggtaatgtcaaaattttatatatcttttttaaaacattcctttaatagataattttaattggctaatattttgttgtttaaatatttgatatttgtagtgataattggatgaaaacttaaaacgctgggaagtgtagcccttcctcctcttttcctgggctgacacctagtggctagctttctcacagcagtgttaatccatatttcttgttggttgtttttcagttgatgttaggattttacaaaagcaaattattgacaatcatgataaaagccacattcatataaggtttatttattagggattgtattaacaatggaattttgatttatagtgaatttgaagtctattatagtcaagccttgttagcacaacatggaacaagcatttgaaatcttacaatagtggtccccaccgcagacctgaccagggcactgacttgcacacacactgacaaataagacctggtcactgttaaagacagtgagaggcagagaaggaaaggaagcagagagttgcagtaaggggtgggaactgctatagtagaatgtgcaasctgggagacatttcagcacagggctaatcactgcagattgggtgctgcggggaagcttcccagggacggatgtgtctggaataaggccttaccggaggaataggagctccccaggagcagggggcaggaagtagcacatgcagaggcaagcggccttgacagcatgtggcacggtcgggtactgtgagtgcccctgtggctggagcagggacagaaggagcgtggctgaggacgaagcagaggagtggtcagtttccaggccataagagactgtgttggcctctacaggattcagcactaatgtcataagccagcatttccagaaccctgttccttgaactattagacccaaagatattgatatattttctgatcccatagaatttggaattgttacactttacatctactgtaactttttaaatacattaacaatgtacactactgaagcccagctgtagagaaatctggatcactttgtttaacccagcatttttcagaccttttccacaaaatacatatcagcattccatgcatctagtactcctcacagcagtttacgaagcactgctagagctaatggctgatggttaatttttcttgctctgagaccatggaattaggataccagctgggttcatttttacccgttccatgactgggaatctcaaaaacaggaaagcacattgtttttccaaagcatttcttgtctggccagacagaggtttggggccaacaggtggtcctgagacgcagagctgagccgccattcggctttcccagctcaggacggcaggctgctctacttggtcctctaggtccagcagcttaatcagtgtgtcagtcaggatctaaggacaacagagactactttcattgtttacaacagaggggaaataatgcaaggaagtggttacacaagtgatggaggagctgaaattcaaaagaagacagggaggcaatccagagattagtaacagcagaggtggtgttcgtgaggccagaggccagggtcacttgaccacagctggtccctgcgggtctgtgcagtgggtgcttgagtcagggaggaggtgaaccrttgctagacagcccacccaagcagagagagcgtgaagagatactcaaacttttcccttccactttcctcctcctaatctctcgctggtgccttgcatgggccaaaccaagcggaaaccagctgatctgggagcccagggaactcagtgtgcaaaggtcaccctcctgtctgtagagagcagagcagaaaagtggggtgagtctgaggtcaagcaggctgagaaccagcactgcsagatcccagagaataaggctatttggtgatcgctccccctcatcccttccccaggcaaatgaatagcatmatgaagtgaaagaccccttgacttgaagttagacttgatgctaacctggactctgccttttctaagctgtgtgactctacacaagttactatacctttctgaaccctattacctcaactgtacaataggtaagggaatctcgacttaaacgataccttcatagagcttccttgacatgtgtctggctggtttctattttataatgaaataagaatgaggtatttaaaactttatgggcttagcctggagctaacaggaatgtcaaaaattcacatatgttgattgactaccccccaaacttcagtgaatttgctgacgttttattagctaccaattactatctaacagatgtctaatttcttaatgtattctctttctggaggcacacrggtagaggaaagcttgcaaagtgttcgatggaatatttgagtgttggagaggcactgtgtgtgcactgtagtttggtactggctaargaaggttgagattccaggagagctactttttcagagctatgaaactttgggaagccctccctcctccctgaaccgcaggtttttcatttgttaagtggggataaaaatgccaccctcgtaaaattgttttcagaattaaatgcgatggcagatgggaagtactcgtcctctgtgcatctttcctgccctccacagcaaactttttatccagtgaatgcccaattcaccagcagtcacattccatggaggcgtggcaggatttttggaaaccctttaactggagattatttatgtttggcttgctggtccctgttagtgatgtgacctggcaggtctccactcaaccctgtttccatcagtcacagctcactggcattattcataagctagttgcttgggacttttctttgctcatattcctactgcgaggaatgttcactctcgtcttcacaataaaatggtctggaggttttgaggttgtcttgagcaagtcagctgccagcttaaaaggtcattatctgttctctgaagggaaacttttatcccgggttgattagttttatcctgggttgataagtgtttatgcaaaagaagtaggggtrggaaaaacctggtactcactgaactcctacttcttgccctttatgtatattttcttggttaaatgtacacagtattatccccaacttgctaaataagaaacataaagcagagagaattgaaattacttaatgcaacaactttgctcaaacatttaccaagaccctactaaaccaggggactattctagatgcttggaattgcagcagtgaacaaaatgaagtcctagtcctcaaatctcttctacyttaggaagacacagagagtaaacaaagatgaaaatcaacatataatatgtctgatggtaataagtgttatgcagaaaaagaaagctaaggaagaagatagagaaagctcctgggtgaggtgaggtaggtgccaagaagaaagagtcggactagagccaggtctgtctgcctctagaactcacggtttttccactggtcccatgctgcttccgatcctctttggtgatggtttccagcatctagggaggaaacatgaactcctctagcatcttgcttcttagtctaaagctgataattcaatgtgtcagggtggtgactttgcattcctggggtacagaaaacatttttgccgtactccctgctgtcagcagcatgtagctgtttctttcgtctctctggtttcacagacacatttagtcttgatgcagaaagcatcttgccagcttggactcgagccctagtgctgaggagaccagtctgtcctaaaggagggtctctgtgactgctgggctcaaaggaactcatcacttcttttttctcttcttccaaaaagtgatgctccagggagtggcttatgtcatcttaatacctgtttcctgatctttaggactcaccaagacagtctaattctatttttaaaaatgctgccacctcctctgtaccaggcccagtggcaggcactgaagaaaagagatggaacctacttaacaggagtcagccagacctgggttccaagtaccacttttctatttctgtaattttgggcatgctacttaactccttagcttcagttttgtcatctgtaaaatgggaagaataaatgtaatctgcctcacaggattggtgtgaagattaagttagataatacagcatggtacctggctcttcgtaagagcttaatattagtttttaaaatataccacagtaaccatttaatttatagctgagtttacattttgtcctatgaggaaacagttgggtagatacaagattttctttctcaaagtgtatgtattttagtggaaaatacagtaataatcctcatcatgctgacactgtttacaaagaagtgttggcattcaatctttatagtgtatttcccactaggtaggtaccgctatacctttaaaaatctatttattataaaataaaacataaaactgccttaatcaagtggatgatgtaatgaatttttttttttttttttttgagacggagtctcactttttcacccaggctggagtgcagtggcgcgatctcggctcactgcaagctctgcctcccgggttcacgccgttctcctgcctcagcctcctgagtagctgggactacaggcgcccgccaccgtgcccggctaattttttgtatttttagtggagatggggtttcaccgtgttagccaggatggtctcgctctcctgacctcatgatccacctgcctcggcctcccaaagtgcatgaatttttataagaccaacactttccaaaacaagaaacagaactttcctgcccaccctagaatcccctttcatcccaactctttccttttctccataagtaaccactatcttgatttcatgccactatcttgatttcatggtaatcacttccttgcattaaaaaaaaatagttttattacccaaatgtttatgcctggaaactataggtgactttttctgttttaaaaatatatgacttttaattctctttcaacttataggttcctcctccacccctttcatttacttacaatttatttgtgtatgaactcaagcctgtggtgatttcccactgtgtgagttttgctgatggcataccatgttcctctgtcccctgtatttcctgctaattgacagttgatccagagattggatagactgaggttcagtcccttttgcaagactgtaggaggcataccaggtcttgttttgtctgttttagtgatcttagtagccaatgtgtttaatatctatatctgtttattcactgggagttgaaaaatggtgatattctaagcttataatttgtttttcatttattggttggaatatttttataaagagacagtttccctcatttaatatttactcagtgttagcgttcatacaagccaaagcaaaataaatgtttgactctttctctttatttaccactttttaatataatgaattgttggttccctatcatcctccaaaggtgacaattgatacatacataaatatgtatgaattcatatatatatatatatatatatatatatatatatatatatatatatatatgtatgagttgtcacctttggattcatacacacacacacacacacacacacacacacacactcacacacataattgcctggtggatttcaacatatttgatggattttggttcattgcgattgtcattttttatttaattacttttaatttttaattattaaaataattattttattaaactcaaaccctcccatctttggtcagtgagaaatacttcaggttgacacctgagtactttttttctacatgaacctagtagtctttgatagctctcttgctatctgatattacaagaggttccaggcttatcttgtacatcctacccccaaacctggaatcagacatttcttcaggaagcactggtttctttttagtgagaaattatatctcaagaccaaaacctggcttaggatactcattgctactgagttggccattgtttctaggccttttcattgaacagagctaggaaacatatgcttatgtacgtaaatctcttgtcgttcatattgatacttccaattaaaattcaagactacagagcttttacttaacctcttctctattacatttgtatttcctctctcccatatgaaaattctgattctcaagggcagaaggaataataaaatactccagaattactaatttagtttcataatctccaaaaataatacacatactaccatgagcataattacagaaaaccttttaactattttttggtatgttctttcctcccatttttgactagttccgctgtatttacattgctagagcatgcagccattacgcaagacactgtctccctctcagtcttcaggggactctgtctgttactgccagtcctaatggtgatgcctctgcagtcattttttattgcctgacacttgctccctggtaaatcccctaggaaagttcctgggaacaatattctgtccgttgttaaaagttgataatcacttttctatgtcctttaaacatgtaagtcagttttgctggatggaagatccttggctcatacattctattttgagtatcttgaatgtgttacttcattttcttctcgcaaagtgttgctgtcaaagttaatgataatctcaattttattttgttaataagtcacttttttttttttaactacatgcccaagagttttttctttgtttttttgtttttaagttcagcaattttattagattgactttggtagttgttctggttctgtagaccaggaatacaatttcatacatcctttttttttaatttcaggaaacttttcttgaattaactttggttctgattattactttttcttcttcaggcactccagttagccgtatattcaatcttctttgcctattttcaatatttttcaccttctttaaaatctcttttatctctttatttctttttaaatatattattgagatgttattccttttgctgtatttttgaattttgaagttttctggttttcttttgtttttattaaggcattgtctgttgagttgatttgttcttatattcctttattctgaatataataatctagttctttttttcttatatagttcttatttctgaaaagagttttcatttctaatattttcctgagttctatcccctcatttttaggtttttgtaattcagatttatgttggtttttcatgctttatgccattttcttagtgtctttagctcattttgacacagtaggttgtagttttaatctgttttgtgggcatacctctcaggcatgctgtcattgtgtacaaggctgttattctgtctctttttatttttcttataataaccttatgtgggatttgatctcagtgttttgttgttgttgttcatttttatgtgaaattaggtttcctgactttagaatgagaagaagttccagaaagcttttctaacttcactgagttaacagctcttctgttgtttttggtggtggtcaataatgtgacagctgctttctggtgttttgtgggttcccttcccctactttgatctagacctccatttcctgtcctctctctctctcgtatctgtcctgctcaatcttggttccattcccagcagtttctccccattgtggacccctgtcctggaaggaggtcctcatgcattttctcgggagttcctaggaactcctagcatttgcggaggctggacggctcggtctccttcagtccttcttaccatgggcccctcacactgacctgctgttgcagaggccaaaacacttccacttgtagaagctgttctcagattgactcactgagctttctgcaagtcgctgacagcttttctttttcttttttttttttttttggagacagagttttgttcttgttgcccaggctggagtgatataatcttagctcactgcaacttctgcctcccgggttcaagcaattctcctgcctcagcctcccgaatagctgggactacaggcatgtgccaccacgcccggctaatttttgtatttttagtagagacgaggtttcacaatgttggccaggctggtcttgaactcctgacctcaagtgagccacctgcctcggcctcccaaagtgccgggatgtgagctactatgcctgtccaatgttttgaggtctacttgtgctgaggtctgtcagtgcaaataccaacatgaagccagtttggtggtggtttgtacttgcctgcttgcatttgggggttcattgttcacctggttttgttgtaactattgcacatatttgaggttttgctatatagtcagtttgccttttttatgtggaggtttgaagaggttgaacaattatactaccactgctgctaccactgccagattcccagaatcccccttttctgttttcccaatttttccttagaaatcctaggaaaggtaaaatatctttcatgagtgtagtaagtgccctcttggaatttacattctagtggaggaagacagagaataaacatgaacaaaaaataaaagaagatgagttcagatagtgatgcgtgccatgaagaaaaaccactgtaaaggggtagcaaagccaggggaggtgtttttctggtactgttctccaaagaggtggtatctgagctgaaacctgagtgatgagaagtcaccggcattcaaatagctgggatctgagcattctaggcagaacagacagcaagtacagaaacctgaggtagacacaagtttggcctgtttcagagatggaaaacaaggcagcatggctaaagcagagtgaacacagagagaaacataggagacagaggccgagagaggcaggggccagattgtgaagggtcttgtgggctggggaagagagtttcaatcgttgggggcttttttagagacagggtttcttgtgtcacccaggctggagtgcagtggcacgatcatagctcaccacagcctcaaactcctggactcaagcgatcctcccaccctggcctcctgagtacctgggactacagatgcacaccaccatgcccagctgtgagagtctggattttaatctaagtaccgtggaaaccattggagtgactttaagcagaagggtagaatgatccagcttaagttttacgacacttattttggctgttgtgtgggaaaagggctgtagggacaacagagtgaacgtcaggtaatagtcaagggtctagggagagaccactgtggtcagtggaaatggtgagaagtggtcagatttggggtgttatttgggtagaggtgacaggatttgctgatgtgttcgatgagggaaagagaagaattaaggatgtcttctgggttcttggtctgcctccaactttttgtccttttgaatcttaagagaaggccaggtagcaccttggtcctaaatagtcactataaagcaagtgaagggggggaaaaaagccacagacaggaagataatacttgcaactttagctgacaaaaaaggcttggcgtccaagatcatgtaaagtatttctataaatcaatgaagactaaaacaggggaaagatatgatcagacgtttcacaggagagttaacatgaatggtttataaacttaggaaaatacactcaactgataatcaaggaaacaagaccaagacagtgttttgttttgcacacattcaattagcaaaaatcgggaaggcagatacttatattgctgaggtaggtgtgtggagcaacaagaactctcattttgctgacagcagtgtaaattggtaccagaattttggaaaacaatttggcattatcttataaagttgaaactcttgcacatttaggctaggaaacatacacaaaaaatgttcttatcagcaaaaaactggaagcaattcaaatatatgttgaaagatagtagatgaataatatttacgtgatgaaatattatacagccatgaaaactagttactttaagctataaacaacaacatgaatgtatcttagaagcatacagcatgatactgatttttaaggcccaacagtaagcaaaactaaacattatttgagctacatacatgtgtggtaaaactttgaaattctcagaaacagaattgagaaaaagtcttaktagggtcagcaggaagaggcaagaggaggcagtggaaaaactcttaagacaatgtgaggaagacgaaaatgtctgtttctttaggagggtaggttcgcagatgctcattgtgttatgctatgttgcttaatataagttccatatagtctttcacatataaattgtgtgataaatgacattcaatggaattacaaaatagatgaagtattaataatttccaaatcttgtctttcataatatcatgtttaaaatccagctcaaaaattctgaggtccagacccctctagtgtaacacatttcaaactttccaaggatcttgaaatatgacttgaccccatatattgaggttctgggtttccacagtggccgtggaggagagggagtggttcagcttgaatgtacgtaaacattctttcccacatttttagtaactaaacacaggaaatcccactcacagcccttaccctttactgacctttctagaaagaattcagaaactctattggacaagtaaattccttcctgcagctttgaacagagcatctccaatgggtccccctctgtagtggcagcatccagcactctccacctacctgactggttggaagactctctccctccagttcgcagtgcttgagacattgtacaagtacacagacaccagacaccaacctccaaaatccaagaggtctgtctttctgcagtccatggatgtgcagcaaatggcaggtgagctytgggctctgagaaagccaggcttgagtgcagtaccatttcttcctctcctgttctaaaactcagaatgcccaaagatattggaatagtcccatggattccatagccatgtttttcttgtgctaaagagagtgggcgaatgaatttgtgcctttttatttttaatcaagataaaaatccaggtgggagaaagaagcccaccatgaaaatagagtaaaagcattctcaaaatgtgtaccgaaacatatcttgagcaccttctatgtgcttggcacagagctaggcactctctgaccacgtggctagtaagtggtagaattaggattcagagataggacttgattctgtagaaaatgtgagtttccttttgcaggagaattcaacagcagagatagagaaagccagaatgagatctttctttctcattttgatatacattaagctgtaaccctgcatttcctacataaaatgtcmtatgtgtacttgtgtgcatgattgttgtttgtgagtgccaactcctggtgaagctaccatctgcattatttatccaggtttaagatgcagcttctttgattcatgctgagctctggcctgcagccttattagtttctttttgttgattaatacacattgcagctcttagaagatatagtgagacctctaaaaacaactgtctggtgagtgataggtacttcctatactttgggctataggaagccagtttactttctgtggcagatgggttttctgtgcatcttttagtttttaattctcttaaaagaagggacttttattttaagggcagttgggtaactgccattttctaggtttcccaatgtagatttcacttgatttttcaaaggggtgctatgataaaagacatagagcctaccttcatacttgaatcactttcaggaagatttcagtcattaacagtgctttcactaacaatgacagattgaggtaagactagagggtttgacctgaattgagggacattctacaaaatagctggcctgtactcttcaaaatgttaatgtcttgcaacaaaggacaacccaagaactattctagattaaaggaggctaaaggacaggacaacggaacgtggtgtgtgatccaggattttcttttggtataaaaagtcattattgggacagttggtgaattctgaatcaagtccaaattttagatttgtattgtatcaatgttaattttctaattttgatcatcgcactatggttatgtaagaggacattcttgattttaggaaatatagtcagtttgttataatgcctgttttgacaacacaatgttccaatgccatcagtatgtcagggagcaatttgagcataatgtgaatttcatttcatttgattcatttgattgtacagggtttcacctatgaaaaattctaagtgaatgaagaaaattgcccccagcttagccaagatgcacatgcacagaacacacatgcacacccttcaggtatttgccaattacctccattcatcacatgttataagccacatctgtcctgcccatgtctggtgctatgattttctgtcctcttctcgccacttcaccatatactcacaagctgcaaccctctgccccttccacaaacaaactgtagatctttttcaaggtaaaatgacatatttattatggggtttatatatttcttaaccatttgctatgtgtaaaagtaggctaccatttttaagtttcttatttctagcatgtcactgaagtttttgagtgtggtgaaaatgtgatgatttttaggaatgcttaagtatttgagggtaaaaggatatcatgtctgcaattttttcttaaatgttttaggaagacattttatatgtaaaacacatataattgccttctgtgtgtgtgtgtgtgtgtgtgtgtgtgtgtgtgtgtgtgtgtgtgtgtrkagagagaggggggaagagaaggataaagccaatgtggtaaactgttaacattttgggtaatctgggtgaaaggtcggtggtaattctttctattattcttgcaactttttcataaatatgaaactatgtcataataaaaaggtgaaaggaagaaaaagactcagggaatggaaaagattttttaaaaatgaagtccaaatgtaaaaaactaaggaaggcaaaaggaaagggaaaatgattcagctgggaaaataatgaaagcagagtgggagagaggatcttaaacaaaccttctacgaagtggattagaacatgagtttagtttgatgcaagctgtttgtaaaatatcataggaatactacggctacaaaatgggaaagaaacatttgctttcccagaaagatttttttggaagtctaacccagaatagtaaaaaacagaatagacccacatatatggaaatcatataaattaacaattctaaatgtatttaatatctttatctcttcctaacaatacaaagactttgatatacagtagtctccacttatctgcagtttcactttccatgacttcagttatcaaggtcaaccataaaaatattatgtacaataagaaatttggaaagagagaaaaagaccacatttacataacttttattaccatatattgttataatggttctatttattttattaattattgttaatctcttaatgtggctaatttgtaaattaaactttatcataggtatgtatgtttaggaaaaacatagtatgtttagggttcgatactatctgcagtttcaggtatacactgagggtcgtggaacacatcccctgcagataaagaggggactactgtgctttactaattggacactcacatgtacaaatcttagtgttattgcaattttatcttcacttttaaaaaaactaacaaaatattgacagtagttagttgtacagtcaacatccatgttcactattattttcccatgagtttacttttcttcttgctgaattatatcttttaatatttctttcagtgagagtctacaaactaaaatgtctttattttgctatgacgcctgaaggatagtttatctgggtatgaaacggtacattgacaattattttccttttgccccttgaagatttgtcttctctcatctgtttctattggcaaacagtctgttatcaatccagtcatcattcttttatgaaaaatccatcttttctctccrggaactctgaagatgttctctttcgccttatattctgtgattttaccctgctgcatctaagtagatttatttatcatacttgatacctagggctcatgtctttcttcaattctagaatattctcaggcattatctcttcaaatactacttctctgccaaggctagttttttgtttttttattctggaaactcctatataaacatgtcggcatttcccaatttattagccatgctcttacctgctctttcatcttcctttacccttgatctctctgttatttgttctggcgaactctttagtattatctttcagaataggtgatagtgtcctaattttctggattaaaaacaagcaaacaagaaaaatttcagattggatttttcccgaggtaaaatagctagtaagaggtagagcctggatctgaatccatgtctgcctaacacctgacctgtattctgtcctttgtgaattcatgagttcatccttaaagttaaaaccctagcatagtgaagtagcttcacatcactgcattattctatcatgtgggtggatgaattgggaagatgaatgtgacttcagacccagactgtgggatgtcatgtgccagaagacctgagaagtgtcaagagttatatctggcctcttttccattttcattctaacttgtttctgagaaagaaaactttagttcctttttatcttttatgatgcgcagaatttccatctttcacgttcttttggctgtctaaatagactgtttactgaggtttgtttgtataccacttgtctcttctcggtagcagaattttggttttattttattgggcagatgttgttaaacttagaatttttcagcaacagggaagtgatgaaatgtttacaatgctagtctataaatataaaaaaagtctattgttgttattcaacatttgttaagcgcccacagagtgctgagtgctgagtatcactacagtcgggggagaaggggtctaagctcacacagattgtttctttgtaaatcacatttcttataatttgtttttaatgtatctattacttgtctcaaatagttcagtaacattttttaggtcctcataccacccagcttgggcaatatagacaaagrtgagggtgacacatacattactttgtcattcattcatttgtttaaaaaaatattgcattggtcatatgttatttgacaggggaactcacaggcctataaggaaaacaaacatgaaacacagttgcaatgcaatatgatgaagactataatgaaagaagctgctaaataagagagtgacacaacgaggatgtgattaactctgccagagtaagtcaagggcagaggaggagatactcactcgaaatgggtcttgaaggagaagttttccagaaagcaaacagttacttcaaatagagggaatggcatgggtaaacatttaggaaaaactgaagttgttctccgtggctggactatgaagtgtgtctttgaaagacgacactaagaggggctagtttggaattgtttgaatgccttaccagctgccacccaaaagcttgggtgtccttgtggttagtaaagccacttaagggtttaaaacagggagcatttccctttctggaggcagggaggaagctggttggaagatgacagcatggcagaggccagtgagaagggcattatattagctctgggaagcaaaaccagctcaaaactctgatcagtggaaatgagtgagaagaacacatctgagggagattgaagagaatcagtcagtcaaaaaatgtgcagctggagggaaagggaatggtctaggataacttctaaaattctagctagggatccatgtggagatttttttcacaccataagcctccagcaataaatatatggcaaatatttctgtttttatctcagtttctgccaagcaactcccagtcctggaggaaataaagaatattggtttcccccaagaacagtatactggagaagctgcccaagaagaaaatggcttcactttctcagtrgcttgctaggaaagtaatgagaataaggtttcaaaacttagttcctctaatttaatgtctttggaggaatcggctcctttgcagagaatagctttgatattgagttcatgactcctgcctttagctttctttcatcattgcagatggagtgctggtcatgtgtgtcttactagccagctctattctcatgttccccaaaatgttctctttgaataattagactttttcacttaatttttaaaacatgtctgatgcctattatgagccatgtgtgatggcaggtgcgttcacatgtcatctcatttaatacagcaacctgagagatagatagcaacatcagttttacagatgaggaacagattctgagacattaaacaatcagtcgcagagcacaacacaagttagttgcagaatcaaggttagaagctgattcaaactcttttctagcattcatctttctttgagatttttgttcattcatccattcattgttttaatcatatgtagctcctcttgtgtgttagtatagtaaccacattgggcactgggttgatggcagggaatgggtcagaccagtgcagaaaatgacaagcatagaggcagttataatacagcttaatgagtcctccagatgggtgcgggagatccaaggggggtacccaactaggaattggggctcagcaaagtgccctggaggaagtgatacccaagctgagagatgaagaataaatgagtggggtagccagggataggtgagagggaacatcctccaggcagaaggagaagcagacacaagggagggtgtggcaagagatgaacctgaaaggcagtcttggaccakatcagagaggaccttataagctacatcatgaagcttaaaatgaatccttaggtcattggacagctgtggagaaagagtttgtaagggagggaagttatatgaatacacaggaattttttaaggtggctatggtagtagtgtgaaaagagaaatgattaacagtaggcaagctcagagaaagaagccgccaaggaggctgtcaccataatccagcagaaagaagatggtggcctggactggggaagtgactgtagggatggagagaaatggatgggcttgggaaatgagaagggataggatccacagggcttaggatttgagtgaatagaaaagagagagaaaagtaaaacaagaccaacccaggtaactgggtgaggctattcccacccactaggatgaagggagaagaaccagtttgggagggaagatgacttcaagcttattcatgttgagtttgatatgtcagtggacagccaagagatgtccacttgggcagctttgaatgagaatccaggagaccagaggggaagagtgagatgaagatacggatttgagttgtatcaacatatagatggtaattagctagagaaaaggtacaaagtaagaagaaaagagcatagaccagagaacagctaatgtatatttaagagactaccaaagaaagaggggctggcaaagaagtcagaaaaggaatcttcagaaaggtgaggataaatccaggataacatgccaacgccaagggatgcgaatgtctagggccaccaaagagaggttaatcagataaagacagaaagtcccctgtgtgttttagccattagaaagtcttggggatcttgggtgagaccagtttcaatgtcgaggtggcggaggtagagtccagacaagccctcggggcattgtggctgggggagagggaaaatgatgacaaccagatggtcatgtagggctgagggaagacatgggagttccagtgtttgttggttgtattaacattggaagagacttgagtacatggaaatgctgatgagagagcacctggggagataagcgtattcggtaggaccagggccctgggatggaaggggtatggcgaagccaggtgagtggattggccgtgggactgagaatgcaggctctcttgagtatcaatgggaaaggaagccagaagagaccagatccagggaaaggatgaggagtcagagggaatttccatctaacagcaggcatgggggtgtgtgtacgcatatgtgtgtgtgtgtgtgtgcacatgtgcaggtgtgtgcatgtgtgtgcatgtgttgggcagtgatactggcatagagggagaagggtcagtggtatggggagactggagaaggtttgaataaagaatggtggagtggctgagtgcagcagctcacacctgtaatcccagcattttgggaggccaatgtgggaggatcacttgagcccaggagtttgagaccagcctgggtgacatagaccctgtctctacaaaaaaattttttttaattagctggtatggtggtgtgcacctgtagtcccagtgactaaggggctgaggtgggagaatcactggagcctgggaggttgaggctgcagtgaatcataatcacaccactgcactccagcctacgtcacagagcgagaccctgtctcaaaaaaaaaaaaaaaaaaaaggtagactgcactagctgggtgaacctaagtttattgttttctttggccctaatgctgggggatttacccatttgtgaggagaaagtggactttccaccagctgccttgttttgtactgtgtttggagtgtgttcttattttcccctttagctcctgtagagcagggtcatagtgccagccggtattgttcagtgagttattgatcagtgagaaacggatccggttaaagctgtcttctctctgtccttctggcttgtggcatttatctgctacctacacgagtatacaggtgattgaggctaactcaaacagtgtcttctctcttggagttttgatggttagcatgtttttcagagatgccctcgaaaaargaggctgggattcttgctgtgttccttccttgtagtcatcttcccacttacccccaacaagagtaaatttaaccgagcaggccagaatctacctaatagcaggccctaaaagttagcatagaactttctctctgaagagggctgctccctgggtcctggttcccatgcagcctttccatagaaatagaaggtgtgcttagaaggacagcttgcctggtttcagatcttggctctgctgctcacttgcagygtgacctcgaacacgtctcctcctttttcggagcctcagcattcttatctatcaagtagagtgactatgcctgtttcccaaggtagtcagagaagctagtgagccaagggctatggaacgccttagcgataagaggtatgcagtgcctatctactccctgtccttccctcatttttcagttattaaaatgcaattctctagctttccaggtgtgaaacagtctgggttgaaattcttcccatctcctcctgcaaggtagctaagtcggaggtaggcgtttggttatattccccagttgctgtaacaagagcacataccactgtctgctcaccaatcagtaaagagcacaaaggtacaaatgttgagtacgtgggacagtgaccccctcttgaaagacagcctcaactgttactgcccagcctccatcagagggcagcctgagacattgtcattgaagagattccagtcgggaagaccgccctggttcatctgccactttaccagaggtcaaactggcagcctgcaggccagattcagcaaattcagcccttaaatgtgttttgtttgtcaagtgctgtgtttgtaacctttttttaattggatgcttctaaatatttggagacagggcatggctcatctgtgttggccaccactcactgttgtcttacaccctgccgccttcactcagttctattccttgtggacccatgaaggcttttgcgtttgcagcctttctttctagatccaccctggacttattcctatcataagcccgaccatccaacccgcagatatcattgaaagaggttttgaatccttttattgtgtttgctgaagcatattgttgacagcatgattcgtttattatccaaagactatttactgagtgcctactctgtgcagtgtaggatgccctattctcagtatctctgagcatccagaggaagccccatcaagtggcctcttctccacagacatcaggaaggagtaaggtttccccctgggtaattataataaagacctggcattcagtaccaaggcagcaccctgggttacgtgtatttttcatccctgacatgccagcagattcttcactctttttctctaataccacatgctccagtcatcccttctgtcatcacgctgtttcagcaggcacaaaagggcctgctctcttgtttccttaattgttagagagattctagttgttgagggagtttcaggtcctctgcccrtgatcacctcatagaaactcaagcttctggactagaagagttttcatgcttatcaactataatattgattcaaagagcagaccgaggtgctttctgcatatagcccatacattgaatacttttcaggccagttgattctaaagcctgaccttggaatcatattctcatttccaagtcaaagtagatggaggagcagagccctttgcactgagccaccaacatttctggccttcgctcttccacaagctgccactgtaagtttttggctagttttccttttcatgagaaataggttaactttacagtatgaaagtacagtttttcaatttcaactctaatattccaagaacaagctgtgaactttttcacctggtgacccatcgatctgaatctgtagcctaacacacaaatactacaggttccttaattgggatgacttgagttcagatctctaactctgtaacgtattatctgtgtagcagtaaaagcaagtcaacgatttgagctttggttctgtatcttcttatacacatgraataagagttaccgcctcgcacggttcttgtggggcaggcctccacaagatgaggaatgtggagcgctgagcagagcacatggcatgctgttggggattagcctragtggcctccatcctgttgctgtcacacgtaagggggttagagtattgttcatccacaacacagctaacagacctagcccatggactgatcggaggcaacactctctaaacatttaaccctccctcctttacccctcctgaaatctgttttggtttgttaagtatgttaccaattgtggtctcctaactcccatatgttagcaattagatgtggcctcacattaatgctttacctccatgtttctctgccccactagactgtgagcttttggaaggaaaagagagctcagttcttattcacgtctgtattcctagcacatagtggggcctcttaaagtgtttgttcaagacttggctcagatgctgccacttatcaaaagcaaatctgcttgtggctccatctctctagacttcaagcttcttgcaggctgtgacagcatccgggacgtctcatgtttccaatgcagatatagtatgctcccagtcagtgtcagctgaaggaattaagtgatattttcatcagcccggagcccaggacatagtaggagctcattaaaaggtagctgagctgcagttgtaatcattaacaccaagaagaagaagaaaataaaaatgggcatctggtcacccactttggtgtgaagtatggacattgattggaagactatttcagagaaacaaaatggccctttattcattttggggaagggaggagggttagtaaaagagggtctttttcaagtgtttgctccatcttgctgccactttactatgtgtggctgctgttgctatggcaattctttaagcaattgaatagaacagcactagttgttgcaaaccagctctaattgctcccatgcaccaggcctgcccacacgaccactctctgcacagcattccctttttcagatacgtattttcataaacctctgggcattgtgcagctcccttgctcctgtgacattgccatcctctggcagagggcacaagaagcagctctgggtgggagagagggctccgccaattttccctgtgtgaatgagcaacacagaccccatgtccaagggggtagcaggatgcaggctcagcagggccttgaaaccaaataaaacatttgtggggtaggtttattatatatatttgccattgttgggcaatttagtcatctttttaaagccaaccataccattcctgtgccctcctgccatgagggccccattcattgtgtactgagaacttctggttttaacctgaatgtaattggggagaactgatattagaagaaatggaagggagccggcatgggtggtgtccctcctgtgtgccaggcagcrtactagacacttcccatgcgttgtcatttcttacacagattcactgggcagtgggtcgggataggtcgggggatggtagcatccctgttacagatgagggagctgaagggcagagatttagtatggaacccatggtaacagccagtgagtatatggctgggattagatcccagtctgatcccagtcttacaatcactgtgacggattctgagacctgtgttcttttcattgggccacacttcctctaggaaggaggccagcctttggtgacacagagaagccagatttcagtggactggcatttagccagctcccctgtccttccgcatggaaggcccttctttaaggaatcatgaaacttaaggattatcttatgaacaattttattgtaattatagcttgtttggaacactgatgctataccaagctccaagctaaatgtcatatgggtatctcacttaatcttattttttacaaatggggaagtcgatgcccaaagaaggtaagtgacttgcccaaagttgtaacaataggggtggcagagccaagataaaaatccaaattggactctcaagccccttaaccacgaggctgcctcccacgggcttatttgagcatgggtgttgcatatgtatttgaaacctttcatgataatactccaagaatcctgataaccaacagaaaaattgtcttcctattcctgagatatttgtaaaaattaaacttacccggtgcactggcccctaaaggcagaagcgtagcatgggcacacaggggagctggatgaaatttcatctggggaaccgcgtcttggtaatgtgtctcggcgtgaggatctgtgtttacaataagaacctgtactccagcagctcagtcctgtcatacatggtagaaccgtgtttgaaatttcttctttctccctcttttcttcctttttatttkaatgtagtttgtacagtaaaaaggtgagagggaaaagaaacaaaaaccagacactgttctcatagaagtgaacctacactaacagcaaggtttttctcttaataatctacattaaaccctgatgaattcatttgaacaagggtttctaaatgcctactgcgtgccagacaccactttaggtagtgggaacagagtcaggtaccaggaagcattcagttgtgggtaacagaaatctggctgaaatgattatgaacttgattatcgakcattggaaggtcagaggcaggcagttcagtgattggctgattgagaaactcactgattatatcgcaatatcagagccaggattcacatccaaatctgactctcaagaaatctgactttcctatcctttcattcttgagtctgcaggcatcagcctacatgccatcaggcaggctttgctcatgagctcagggtggctgctatttcacctgtggrccttacaccctcaccacaatttccaaaggcagcaaaaatttttgttgttgttgagatggagtctcgctgttgttggccaggctgtagtgcaatgacacgatctcggctcactgcaacctcgcaggttccagcagttctcctgcctcagcctcccgagtagctgagattacaggcacctgtcaccatgcccggctaatttttttgtacttttagtagagacagggtttcaccatgttggccaggctggtcttgaactcctgaactcaggtgatccacccacctcagcctctgaaaatgctgggattacaggcataagccaccacaggtggccttttttttttttttttttttttttttkgagacaggatcttgctctgtttcccaggctagagtacggtggtagtcaaaactgcagcctcatgagctcaggcagtcctcctgcctctgcctcccatgtaattgggaccacaggcgtgcaccatcacacccagctaattttttaattttttgtagaaacaaggtctcactttgtcacccaggctggtttcaaactccagggctcaagtaatccacacacctcagcctcccaaagtgctgagatgacaggtgtgagccaccrcgcccagcctgggtatttcttaagattcagaagggctttcccagatgctctcctggtgacttctcctccagtgccattgaccagaattgagtcacatgccatgcctctgctccagcccatcactggcaaggaagtgaggccaccaggttaacttagatatgaggacccaggccaggtgtggtggctcacatctgtaatcaaagcactttgggaggtcaggcaggcaaatcacttaagaccaagagttcaagaccggcctggccaacatgacaraaacctttctctactaaaaatataaaaattagcctgtaatcctagttattcaggaggctgagacgcaaggatcacttgaacctggcaggtggaggttgcagtgaaccaagatcgtgccaccacattccagcctgggcagcagggtgagactctgcctcaaaaaaaaaaaaatttaaaaagatatgaggacccagcccagctctggggatggaatctgaaagagtcagcctcatggaggaggagggagkcatgaacaaattgggggttctgttaggctagagagaggagggaatgagggctgggtgggcagccaacaatagtgactggagacagatgatcccctccttcaaggagcttacactgtagggaaatacaatagtaaacaaggagacagaccgatgtaccatttacagttccatccgcgctgtacaggaggtgagcagagtttggtgcttctccttcagatggtgcatcagggaagtcctcttggagctgacatcagccatccgtgttgggtggaggggagaaaatgttccaggcagagaagggaggcaacacggcccctaggagggaccgaagggaacgggggagcccaggatgtagcaagcaaggtgagtggcttgagttgaagttacagatttaggcaggttcacgtcatgcaaggttttagaggccatagaaaggagtttgggttttattcaaaatcagtggaaggccagtgtagggctttttaaaatgggtgtgacacagttaattttatatttgttaaaagtcctgctggctgctcagaggatggctttatgaaagcacagagaacaattggaaggtccctgtgatgatcacctagaccacctagacaggtgggggtggcatggactgtggtgtcagtggaaatggagaggaaagagcttttttggagatgggatcagtaggacttgccaggtactgtgctagctccattcccatgggctctcttgtccagtcttctctgtatgcctagacagtcattttttaaaataaattattatatcccctttgcaaataagaaagttctgaggagtggcctgccctgggtcacagcatttagctgagccagagtagggaggagtaggacagctggattctggggtaggtgggcaggaccaactcaattagcattttactgggattgttttcctagatgaagcttttgtttttgagggtgatattttgagaactgctgtctccgtgggaatatcttagttgtgtacagcaaagccatctctgcatctacattttcttgttcaacacatggctgtctttataatgagtgccttctttatatggggttatcagagtaactctgagtctattttacaactaaattaatgatgtcgaggaaacatttatttggctccctttctattataatattgttaccagctaattgcctttgaatattcctacttataaggtcctttgtgccagtttaaatctaccccgtgtaggtgaatccctaatgccgctcagggctactcagtcacttggaaagtttctcttcttgtaataacaagagcaatcatgaaaatttatgccaggaaaaaagggtcagcttgagacaacacctaaaaaataataatatatatttttttctgattataaaagtaacatttttaatgcagaaaatttggaaaagacagaaaagcatagagaaagaaaggtcactcacatttccaccacccagaggcgttccgcattcaattttgctacttctctttacaagtgttttttatgcctttttaaataattgagttcagtcaatatcatttttcttcctttttcatgcaattatggattttcctcacactatgagatattgtgtgtaaataatcagttgtaaatggttgcgcaattcctctgcttgaatttgcctcactgtgccacagtttatttaactgtgcccctcttgttttttttgtttgttttgttttgttttgttttgctgttgtttttttgagacagggtcttgctctgttgcccaggctggagtgcagtggtacggtctcagctgactgcaacctccccctcctgggttcaagcaattctcctgtctcagcctcccaaataactgggaattcaggcgcaccaccatgctcagctaattttttgtatttttagcagagacaggatttcaccatgttagccaggctggtctcaaactcctggcctcaagtgatccacccaccttggcctcccgagtgctgggattacaggcatgagccaccatgcccggccctcccttcctgtttaaatttttgttgttgtgatatgaatgggttttttggggggggttttgtgggttttttgttttttttttttctgagacggagtcttgctctgttgcccaggctggagtgcagtggtgcgatctcggctcactgcaagctccacatcccgggttcacaccattctcctgcctcagcctcccgagtagctgggactacaggtgcccgccaccacgcctggctaacttttttgtgtttttagtagagacagggtttcaccttatacataaagattcattgaattttagagtttttccttaaactaaattcccagcaattccagttctggattaaaggatatgattatttttaaggtccttgagacacttgacaagtttcatttcataaatgttttactattgtccgttcttttttttttttttgagacagagtctcactctgtcaccaggctggagtgcagtggtgtgtgatctcaactcactgcaacttctgcctcccgggttcaagtgattctcctgcctcagcctcccaagtagctaggattacaggcacacaccactgcccagctaatttttgtatttttagtagagatgggatttcaccatgttggccaggatagtctcgatctcctgacctcgtgatctgcccaccttggcctctcaaagtgctgggattccaggcatgagccaccgtgcctggcctactattgtccattcttattaacattccatagatggccactcttgactacaactaggagtttttattttttatatttgccaatttaataggcaaagagaaatgaattgttttaatttttgtttccttgattactagtgacattgaactgttattcatgtttatttgccaggtgtttgttttttcattatgaacctgacacttctctactgggctctcagtgttgtcttatttttatttacataagctccttttatattttttagtattaaccttcttataaaattgtaacaaatacatctttctggactgggattccccaccccagcccaaatacacgcaaaagtacagagtacacaccccccatgtacccatcacacagcttcaaccaccattgacattttgtcatatttgtttcatttgttttctaccctactctccccccaacctttgtgtgtgtgtgtgtgtgtgtgtgtgtgtgtgtgtatgtgtgtgtatatatatctatatatatataattgagacagggtctcactctgtctgccaggctggagtgcagtggcacaatcatggctcactgcaacctcaacctcccaggctcaggtgatcctcccacctcccaagtagctgggacaacaggtgtgcaccaccatgcctggctgatttttgggtttttattttttattttttgtaaagacagggtttccccgtgttgcccagactggyctcaaactcctgggctcaagggatctacccacctccttcctgggctcaagggatccgcccacctcagcctcccaaagtgctgttactataggtgtgagccaccacacctgccactcctcactttttttgctggaatattttaagaacaatttaagtacttcatttcatctttaagttatattaattagtaagcatctctaaaaaataaaaatttgacattttctttttccttcaacttttcatttaaaaaaattcaaacctatggaaaagttgaaagaatagtacagtgaatacccatttacccttcacctrtgttcactgataattaatgttttacaaatgtgcgttgtatttctaaatatatgcacactgtgccttttgttttgtttttgttttcattttgtttgctttatttttgcgsaaccattttaaagtaagttattatgacgcttcactcctaagtatttcagcctgtattttctaagaagataggacattctctatcctaatcataaagccattatcgttctcaagatatttgaaattgttacaataatattatgtaatggaaatatcacttttaatagcaaaaatcgcagttacttttgcaccaacctaatagacaatctgtaatctacatacagttttcccagttgactccaaaatatcttttctaatcatctttcttgcttaatgtacttgggctcaaatcgaggatcacacattgcctatggttgttatgtctctttagtaccgtttcatgtaggatagtctctsttgctttttgttatgttttggtcttccaaggcatttacatttttgaagagtccagaccagttgtcttgtagcctaccccacaatgtgattatgtgactgttaacacatgaccgtattccaccctgccaaactgcctgaggttcatcttgtgcatttcctgtctcagatctggagtcagccctttcctccgtgagtcctggttccttttagtagggagtgatacttagaaaccaagatctaggcaccaggtatactcattcctacttggtattactgatgctaggcccttctagttgatacagccaaggaatgtgtaacacacccagacccacgataggcactttatgtctctgtttctgtatccatcttcccatactgaaggccgtgggttcacaccaatggttcctattccagtccaacataggaattattctagttttctccctttacatatctgtgactactttctacaaaagtgaaaaacctggcctatattttcctaatatatttggttatttgtgtggaaccacgcttctgtcgctgcccctgcctccatccccacccagatgctctccttgccctccctgactctgacatccgaggttaggcctcctctgtctacttcctcacctcaggctctaacaccccagcgctagaccactgccactgcctcccttctcacatggattcttctagatcctacttaagttccaacatcccatgccaacccaccacctccactctctcacataaacatcctcctcatctccctcaggctctgacaccctgagccaggctgccccctggctcaggccctccttgccctgccatcccttccacgtggaccattccatgtggtgcattcctcattgcaccattcaaggtctgataagcatgttgggtccatgacccaaacagataccttagtcacccaccttaggctgagacaccccatgctgggtgtcatggacacacacacacacacacacacacacacacacacacacctcaaaatagaaccctaccttgcccaacctttccagtgacttttggacttggggagggaattctgtttttaataaaaactcttccctcatgttctaatctggtgaccagcactttgcaaacagttaagcctttggggatccatgttgggcaggctccagttaggaggggagaaagcttttaagttctcatttaagatctacctgaagcagacatcatagtgggcagtgcaggacatgatcaaaagggtatgtgacactgttctgcacagtcatttttctgttagttgcagtaaatccatctggattgaccagcccagcctgtctgtcaagtgcctggctagctgcttcctgtcagtcatcaagagcaagtcttggtatgatgctgtctttgggcccagaacagggcagcatcaacccaaagcagttcttccaatccctcttttggtcctcagtgcttccagcagtgaaaggaagagatggattgtatgacacccagcggctcttcccgctctggcgtcctcagaccctgggccttggtgtgtcctcttagcaaccagggaaagatgtgccgatctcaactgagaaaattaaaggatagcactcaagtctgtagagaaaattccagtgcctcrgttctgtaggatctcacctgtcctctgggacccaccctaaaaagtgtttcttacttgaaagtttgagtaacatgcatccgacgtataaagaggacttagaaacagaccttttatcacagtgagtcagtgggaggctggggcttccaatctcagtctctggctctgaagcctgagctccattcagtgtgccaggctgattctcgtgtgggtgtggggtgaacaaggaggaccgggctgccctgagaatcacagtcaacagaggagcccttccacccagaggtcaggccatggccacctcaccggactccggagaagaagggccaacaggtaaacaggccttgaatgacatttcggtagtaatcaacttgaacgatccacattcctatagcatattcagagaagagctacaggttatgtatctctttttctggcttccagaattctgagactgttttaagatatggtagcatgtcttttacctgagttgcacatctgtgaggcagacacgctttcagacaccctcacatctcatttaatttaatcctcacagcagcccttaagggcacgtattattatccccattttccagcttaggaaactgagactcagagaggtagaggaatttcaaccattaccagcaaagctggtatttgaaccagtgtctgctgactccaaatctgcccctccttccactgtcccaagtcaccttcagttctttaaggcggccagccaaacttatgcacatgcccaccccacatattcgagaagcttccagttgcatccatgccactaggcttctggctcctgctttggggaggtctgtgacgctctgtcagtgctggctgcagaatagccagtgggaccgtgcagcaggaaggagcactgaaaagtgccgcgaaggaactctagtccccacgatgctgaggaggacactcacctctcctcatttgaatctccaagtccaagtcccaggatgctgttcttgcccgagacctgcatctatagaggcctcggagctttcaagtgaagtgagccgagtgccagcccattcagtcgcaccccactcccatggccaggggccacgctccccctcgaagccagcacaaggcgaggtcctcatggggcctggccctctgcattcacggaggaaaaatgaaagttgctttattccccggcctcttcatatctcctattatgaggagagggctccacagtgaggagccggggctgtgatatttccgctgcagcatgagagattcatatgtttgactaatcaattctttggcactgacttcctggcctgcattttgttcttttgcctttgatcacctgtttgcctttttgccattctgctggttcttgtttggagcttttagtttccaggaacacggtgacctactcgatcctctgtattcttctcctctctccctttgtcattttcctctctgattttggttccccttgtgattgactgcacacggcttccacatgtaagcagagtggagaccctcaagtcacgagaccctgataactgctgggttttgttttgggagccaagggacactggaccacagacaatccctgcaacccccagccaagctgggctgcagctcttctgtctctcctgtccccattcccgcctggcgctgcaacattcagtagctgttgttggcttggcactctgtggttcacaaagccttctgtaatgctcacggcaaactggaagtgggtgggggtgcaaatactagcatcagtcacgtttttcaatgggagaaactgagtagtggaaatatgagatgattttttctggcattcagagctcataagtgtccagccctgaagccaggccttgtgctgctgctatggtggtcagttgattgctaacttcaccatcctcagccaacagtgacygagcagctgctgtcctcagccctgtgctggggatgagacagggattctgagttaaatcggacatgcttcttgttcccagcacagtctagtcccgtgcaacaggcaactgcactgtgcactgtggcagcaggtgcttcctgagcactgactctgtgcctgacatggcacctagcacccccgctgtgttagccctcagatcctcaccatagcctaggctcaggacagtgaagtagcttccccaaagccacccttctgatgccagagccaggactggagcccaagttcgaaggcctcagacatctgagcccttaactgaagagttacctgcataggactgtggaagcatggcagaagtccctacccagagagggactctgggaagtcttcctaggagtggggatatctggggccttgagggatgcatggaggtttgggaatcagaagaaggaggggaatgtagctggcctctgcacagcctgcttctgggcctgttctgaggtcacagtgttttcctaagcaacattttgcatctgagaatcccaagactggaaggattgtgtggccttattgcctattccatgctcgagtctcccctacaacatcctcccatgaggctttccagcttctcttgcmtacctctggtgccagggaacttacttccttctgaagcaacctttccatctttgaaatgctcctgtttttaggaatgttttcttattttagtgtaaagcatcccctttctgctcctccaccttctgtgttaagaaagcctcaaggccacatctcctatccttggaagcagtgggtacctttggctgaactgtgagcaggaactgaggcttctgcatttctagttgcagagagtgacatggcaggggatggcctgtggtatggagtctaaaaggcctgggtcacatctcactctaccacctgtgctgtgtgcccccatacaggtcactttcctcctccaaacttcctcacctgtagaatgggaacaccagtcccttctctgcccatctcatgtggctgctattcacaaaaaatggcaggtgcatacatgctgcttaaaatggaaagtgccacacaaatgtttcccctctgtatcctgttgtgatgggacacagttggggatgtgtccttgtgtgctcacactgatcattctattgtgtatttccctttatcagatgagttcatatgaccgcataacatgtataaagatgtaatcaacaggttcaacccacttgcctagacacccactctgggtccagctctggggtaatacaaggagcacaaggatcaataaraggtcatctctgcctttgaggaactccacggtggtgagagatgaggaggaggttgtgtagcgactgtgttttcctgggctacagcagagaagtgggaaggcgcgactcacagggcaggccgcactgctggggccatggcgggcagtgcagtcataggacattactctgtatttttgagccaagtctttgaaggggacagctttctcgtccaggagaggaatgacaaggcatgaggaggcagagatgtcttgtcgacaccttacaggtaggttcatctgaggtaggcaacttctcagaaataaggagaaggagatagaggcattggagatgaccctggtcatagaatccaatgagtcagtcagtggagatttccttgcctgaggtcaagaatgcagcaggccaaagggtgggggaaagaagtgttcaggattggagtgtggagtttgagaaacatgtgggtcctccaagtgtaagcatccagcatacaatggatagaacaggtcttgcagttcaggaggaaagtctggcctggagctggagaattggaaagctctcatctcatgttcaggctcttctataatttgaggggcttgcttggtgccacccaagagtagtaaaggactgaaaatgcaagtgacctttcttgcatgttcactggggatgtgccatccatctgtgacccagagagaaggctcaaaaacgaggccataaaggaagatggtgcaagagcacctctcctgtgtaagacgctatgctacgtgacccctaatgctcccagcagcccttcccagtatttctcctcgctctttacagaacctgaggttcagacaggcttagtcagctagcaagtggcaatttagaagacagacctgtctgactctccaactccatgtactgtccaggaaagccaggtgtcccatctcrtgctttctgttggtgagaacgtcttctgcgaagtcttgtttgcctcgcttcttttccctcagagccaaaatttgtccacagtacattcagtatccatgagccatcttaatttkgcagctgctctgtgtgtacgggcttgtgtttgagtgtgaggatgatcatgtgagccatcccctactcacctttaagacagtgcccctagtatatcagatcaagcagaggcacagggcctcttcctctctctttctttccttcttcgtttcatgttccattccttcacggtgccttctagaggctgattttgtatggtgacgtacatgtgcattttgtaagtcataattttattttgtatttaaataaactgtgtgcacacagagtgtgagatatttggaggacacagccgggggtactctgctctgaattcctctggcttcagtgttcttttcaagtttgaaaatgtgttaggaaaaagacaacattatgataattgggaattcagtatatctgtcttttccctctattcttttatacttttttttagatacaattaacacttcacacttcacctgatctctcctcagttacctttgacacttccttgatatttatttagatgttcatgccacgttcactttgaactctgtggttaagagaataacttttaaaacaagcatttttcctcactgaagatgtgcaattagcgaattacacacatgtggatgtccacttgtctttttttatttgtcaaaagatcatggcacaattacaagaaaattgtaaagaaaagtgattatcatcaaatcaaaatacctgctgtgaagttgcagaaacagctcattttattacagtttctagaacagcacatttcacagaagatgggaaaatgcttagagatatcttcatgggtgtcgtcttagaatttacgaaccatgaataatgcatttaatttaaaatggctgtattttctgtaagcatgtatgaatgcaaatggcaaagacacagtggaatttgactctgtcctatcaggtccggacaatatgatcccgttgtcatcaccaaaaacgaaagttaaaaatgtgctttttgccaaaacttttgctacttttccagtttcattttaggagccttgtcttgtataacactggctctggacttactaagtctagctgaggcggtgtttcttgatgagtcccatctctctttgcctgtgttatctgggagctgtcagataatgtcaccattaacccatcgccgatgtgcttgaaaaagaatactgaaactctagatggattttgatgctagaacttgaaagataaaaagcaagttgttttctgagtcaatgcattttaagaggaactgaataaagtcaaagcttcacagtagcaatggaaactgtcttttaactctctgaacactagtaattttaagacaaaaaatatttatttatttatttatttatttatttattwtgagataggttctcactcccattgcccaggctgcagtgcagtggcctgatcatggctcactacagcctcagccccccaagtagctgagggctgcaggagtctgcaaccacgcctggctaattttctttttttttttttttaagagatgagggtcccgctatgttgcccagactggtctcaaactcctgggtttaagcgagctgcccccctcggcctcccaaagtgctgggattacaggcgtgagccactgtgcccagcaaaaagtaattcttatgttaaaattttctgctttagtctacttgggagggagaacttgtaatctcacatatctggaagggctctcagcctagaaccttgcacataactgcctaatgaatgagttggtctgctaattataactattgttagcctcagtgattataaagatgcaaactttaaaattcagatcatttactacatcagatgacttaggtcatccttttgtatataataagatctatttagaattcctttttggccagaagttctagatctcataagaaaaacagtagtggttacaacaaccttgttcctcttagcacagttacccgtgtaaaaatattatgtttcttttctttctttctttctttgtctttttgagacggagtctcactctgtcgcccaggctggagtgcaatggtacaatcttagctcactgcaacccccatctcccaggttcaagctattctcgtgcctcagcctcccaagtagctgggattacaggcacgtgccaccatgcccagctaatttttgtattgtttttagtagagacggagtttcaccatgttggccaggctggtctcaaactcctgacctcaagttatctgcctgcctcagcatcccaaagtgctgtgattataggcgttaagccactgtgcccagcctttttttgaaagagcataaggaaattttgagccatctctgggttctgaagcttgaatatgtgtttattctgtttgccctcaaagcaacatcttttggtgggaagaaccctggactgaagacaaacctgggttcaaccccactcctgtgactttctggctatgtgaccctgtacaggtaatttaatctctctgagcctatttcctcgtttgtgaaacagtcataattaccctaatctctgtaagttgttatgaggataaatgtggatacacttattaataatcatcatagtaataattcttttttttttttttttttttttttttgagacagagtctcactctgtcaccaggctggagtgcaatggcacgatctcggctcactgcaacctccgcctccctggttcaattgattttcctgcctcagcctcccaagtagctgggactacaggtgcacgccaccatgcccagctaatgtttgtatttttagtagagacaaggtttcaccrtgttgcccaggatggtctcgatctcttgacctagtgatccgcccacttcggccacccaaagttctgggattacaggcgtgagccactgcctggccaataattcttaaatagtgcttactccgtgcggggcactaattaaagcactttatacatattactcatttaatcctcacaaccaccctgtgaggtaaataatattattttttctgttgtgcagatgaaaaaactaaagcacagaaaagttaattgatttgcccaaggtaacacagctaggaagcattaaggtcagaattgtaatgcaaaatgtctagctccaaagtccttgctcttaatcaccatactgtgtgggctctcggaggtgtttggtgaatgcttrtcatttctggaaactttcggctcaggcgcatgaagggggcacactcactcacgttgaggagcagcggcacagaggatggcattgctagcctgctcctcttgatcacagggcacttgtctaagggaggccacgttgttgaagagaagaaatagcatctctgacccaaggccatccgagagcctcgtgtcgctgggggacctttaaatattctatttctaaatttcaaagctagtttgggctatatttacagcatttaacatatgaaaaatcattgggaaagtgggcttttaagtggaacggttgtgtaatggaatatttcacgttccggttcagccataaagctcagggctgataaacaaagcatctgaagccaaatggctcctcatctgaccccaattaaaataaagatttcattccattctgtcctgacagagaggaacatattgttgcctttaagggagtttggtttagttaatgaaataattttatttcatttttccccccaaatacaatatctaattaaataagattcaatttgttaggacttctggtagggatatgttaactcttttaaagctatgttgcctacatgcctcaaaatgtggagggtgcttgtgaatcccacttcgcaatccattgtttaaagaagaaataagcccaagtcactttaaagacaaacattatcttctccaaggtatatctgtttacatctccactatagcaacctgtgtatgtaagtaagtagcatggattctgtacaaaatatcacatatttacataaagccccatttcctagaagcatttgtacttgtacatattgtaatttaccaatcaccatagatctgtccatatagaatatctcacgcagggagttgtagctgctaaaatatgttaggtaacataagttgggtattgatgccaaattatcacggagttccttcagagttatcttgcagaaatatgtgactgtctaaagacttcattatttaacattaagagtgaacaccagcaaaactcttcttttacaaggggggtgggttcttgtgtcatgctgtcgccgctttcttgtagtcttttctgtatgtgctgtggttcatcgtgactgttgggtccataattaccaagcagaacatgttggtgtcattatggagaagttctcttcagcttagctaggcatggggaggcatttggattgtgaggccctgattggtcacctccatgcccctgaagaactgccttggtagtccacagagctgtagggaactgctggcctgggcatcaggagtgccggccctgcctgagcgcctctcttctctgggcttcagtttcttcrtctttaaaatgacagcacggggtcagcaggtctccaaagacccatggctctgcctccctcagattctgtattcagtagagcagaaagtacatgatgttctgaaatccactaagaatttgtagtcagatgctaaggatttatattctgagaaatgaaaaattttttaactgtataaaacctaagacatttaaatcagacttaaaaacactctgtcattttccagtggctccttctgatgttctgtgagcatttggtcaatgttataagcatgcatcccgtgcaggcctagtgtcaggtatacaaagacaaaccattcatggtcctgccttccaggagcttacctcccagtgggggtgaaaagagagtcaagaagtcatcccttgttaaagtacaacagggtagggtaggtgagatgaggtgaggggcaggtgtcccagaggaggggatattttggcgggacctcgaagggcgagtgcagtttcaccagatggcgaagggcaactcattccaggctgaaatgctcaagaatagacggcacagcctactggggcaaaatgatcatttctgtgtgcttgcagcatggaagtgggctgagaaagaagcaaagagaacgataaaaccagaaaggaaggcttgtgaaaaacctcagaatcatagaagttcctttcaaaggagtatggccaatgtttttcaaactggtagaaatgggtattctttgaataaaaagagccaagaccctgggagtacagatgactcagttcccctgtcagaagcacacagggaacgataaagacccgacaggaccctcagccattgcccagactgaacttggcttaacccagtgtgtctcagactcattgaccatcaagccctcctgaggcagaagacctgttggtgatggggagatgcactggagctctagtcattagaaacacagaatccaatcagcattttagaaagactatgctggcctacaggggtgggaaaagggaagggaggatgtcatagtatcagaaagtatcaggcattagacagctagttgcacttgaagtttttcagggtacatttcaaggagaatctcctctgaatgtaatctataccttctcaatgctgatatgtgagttttacgtgagtccgatgagctcaagactggccagatgctgctatttaaagtcatctgcctggcagcctttcaagagctcatagataacattggtggctgttacagaaatgggctgagtgttaagaggttgcaggcagaagatgaagactgatgttaaagatttccatggctctttgaagccatttgttgagggcataccagtgccaggggctgtgcgaagtactcttaaatacactcccagctattccttgaaaccatctaaaaagatattgctgttgttccactttgatgaataaggagacagaggcataaagagagtagttgactatgccaaggtcacatggctgatattcaggtctcaaatccatctgactaactcctaagtccatcatcttaacactgcgcttctgtagatagcatgccgtagataacctccatctcaaagcactgaccacctgccaggtattatgtgaagcacctgacataatgatatttaatgtactctccccaaaaagcctaagaggtgagtggtattatccctgctaaatcaatgagcaaactaaggcttcatcatagcagccatggtcacggctagatcttgcaaagctgggaactgagcttcagtctgtctgctcactactccccctaaataatttttagaaagttattcatgttgctcagaaatgtttctctgtagccatgttagaaagttagtgggctcaaaatagatcaagacctaaatttaagacctaaaactatgaaaacctgtggaagaaaacattgggcaaaagcttcacgacactggttttagcaatggcttcttggctatgacaccaaaggcacaggctacgaaagaaaaactagacaaattggacttcatgaaaacttaaaaattttgtctatcaaaaagacaatgtcaacagcttaaaaaggtaacccacagaatgggtgaaaatgtttttaaagcatatatctagtaagggattaacatccagactatatagagaattcctaaaactcaacaacagaagaacaaacaactgattcaaacataggcaaaagacctgactcgatatttctccaaagaaaatgtacaaatggccaataagcatatgttcatcactaatcattcaggaaatcaaatcagaatgacaatgagataccacctcacacccattaagatggctactgttaaaaaagcagaaaataacaagtgttaaaaaggactcagaaattagaacctgtattagggttctctagagggacagaactaacaggacatacatatgtagatatagatgtagatatagatatagatatatggagcctgtattatagtcagggttctctagagggacagaactaacaggagatagagatatggagcctgtattagtcagggttctctagagggacagaactaacaggagatatatatgtagatatagatatatagatatggagcctgtattatagtcagggttctctaaagggacagaactaataggagatagagatagagatatggagcctgtattagggttatctagagggacagaaccaataggagagatatatatatataaaggggagtttattaagtattaacttacactatcacaaggtcccacgataggctgtttgcaagctgaggagcaaggagagccagtctgagtcccaaaactgaagaacttggagtctgatcttcaaggctaggaaacaatctagcacgagagaaagatgtaggctgggaggctaggcccatctctccttttcacgttttcctgcctgctttatattcactggcagctgattagatggtgcccaccagattaagggtggatctgccttccccagcccactgactcaaatgttaatggtttttgacaacaccctcacagacacacccaggatcaatactttgcatctttcaattcaatcaagttgacactcagtattaaccgtcacagaacctttgggtactgttgatgggaatgtaaaattgtatggctgctgtggaaaacagtatgatggttcctcaaaaaactaaaaatacagtcgccatatgatcctgcagtttcactactgaatatatacccaaaggaattgaaagcaaggagggtctcaaagagatatctgtatacccatgttatatttggtacccatgttcagagcagcactattcacaatagctaaaatgtggaagcaacccaggtgtccatccacagatgagtggataacaaaatgtggtatatacaaataatggaatattacacagccttaaaaagagaggaaattctgacacatgctacaccatggatgaacctggaggacattatgctacatacatttagccagtcacagaagaacgaatagtatatgattctacttgtacgaggaacgtagtcaaaatcatagagacagacagtggacaggtggttgccaggtgctgggaggagagggaaatggggagttattatttcaggcctacagaatttcagttttacaagatgaaaagagttctggagatagayggtgataatggttacacaatagtatgaatgcatgtaatatcactgaactaaccgtacacttaaaaataatcggcagtaaattttatgctatatgtatcttaacacagtttaaaaattggacaaaaaagaaagttagtagacattatttttgatgcagcaaccctctagcactctgagctaagttgagcccactggttagatcctgcccttgatactggagatgaaacacccagatttgagtatggttctgtctttgtgtgacagcgtttttgcattcaattcattgtgtgttactgagctcctaccctcatcctggcactgagctagaaacatgagtgaacagaacactgtctttgcccttcatgctaagagggagaggygtgcggagaactctcagtgcaggtgttaagtgcaaatagaagcctgttcaagtgacccagaagggggagagattaactccatttgagagagcaggataggcttcacaggtgttatgtcaacagtgggttttaagggatgagtaggagttcatagaccagacagtgaaggggggaaatgcctgacaagttcatttttctttcttggactgaatattgaagattcacttcagaacaatagcagaacacattgacrgcttgaaatcggtacccttgttgcctcagtttccttttaagaaaaatctaattccaccctatctgccaagctgatgtgattggaatcctgagacgtggtggcctatgaagggcttttgtatctgtcttctctgaatgacatttacaagtgtttgttcattttgagacaaagatcatggcatatccaggtggcctgcttcatttaaaatagttcaaacgatggaacctgggaaaaaataagtgacttttagacttttcttaacttttattttaggttgaggggtacatgtgaaagtttgttgcacagatcatttcatcacctaggtattaaggccagtactcactagttatctttagatagtaattaaacccctatgtagactggcccaaaggggtatagggctttcctttgcccagtgtgaagggagcccatgcttccttgctcatygattcattcggcagtggcaggatgctcgctctgtgctgggtgccaagcgtacagagaggagaggaccagatcctgcttgccaggtgcgcatagacaggtagaggagtcaggagcgtttgctgtgagccggaagagctgtgggagcagccagctcagccagcagagaggttgctcggcagcacttccctgaaagatgcctgagctgagccttgaaggatgaatttccaacatcaacaccactgtcataaccatctgccgtaagcaggagaagatggtggtgaagtgtgtgggtttggcggtaaattgcaggctccaactgccagcccttagtgtccttggtaagtttttaatatctttgtgctttgtctcgtcatacaaaatgggaattgtaatcatctctacctcttggggttgttgtgagggttgagttaatatatataaagtgatgagagcgctgcctggtgctcagcaagggctgggggaaaagtaagcaatactgccgtgtaccatatgccatttgctaagtacattagctcctccccacaaccctttatgatattctggtctttttcctataattcagatgaggaaatcaagtattgagagaatggctaagtgaggccgagcgtgctggctcacgcctgtaatcccagcactttgggaggccgaggcgggtggatcgcctgaggtcaggagttcaagaccagtctggccaacgtggtgaaaccccctctctactaaaaatacaaaaagtagccaggcgtggtggcgtgtgcctgtaatcccagctactcgggaggctgaggcgggagaatagcttgaacctgggaggtggagcttgcagtgagccaagatcacgacactgcactccagtctgggcaacagagtgaaactcagtctcaaacaaaaaagaaaagatttttttaaaaaggcggggcacagtggctcatgcctgtaatcccagcactttaggaggccaaggtgggcagatcacttgaggtcaggagttcaagaccagcctggccaacatggtgaaaccctgtctctactaaaaatacaaaaactagccaggcatgggggtgtgtgcctgtaatcccagctactggagaggctgaggtgggagaatcactttaacccaggaagtggagattgcaatgagccgagatcacgccactgtactccagcttgggagacagagcgagactttgtctcaagaaaaaaaaaaaagagagagagagactggttaagtgatttgcccaaaattgcatctartaagggactacacttgcccattggaccccaaagccctggcccccatctttactgtgccccttcttccaagctcccagatattttgaatagtgtttggctttaatggtagttgaaactcttttcrtaagaaaaaaattgttgacctttggtaagacatggtacagagtaaaagaatgggcttagagataagagagacctggattgaaatcccagctctgatcttgaccagcgctctgctgatgttggacaagctcagctgttgaccagcacgctggtgatcttggacaagctctgctgttgaccagcacgctggtgatcttggacaagttctgctctttatacaagttacttccctgagcctcctcagtaagacagaaataagaattccttccccacagggatggtcttaaagactaaatgagagaatgtgtagaaagctagtctgtaccaagtgcacataatagggaccctataaatgtgaagtgttcctccatttttcccaccctcctatgttgtacagaactcttctttataattagaattccccagtggctatttcacccaaggctttacatatttaagctatctcttagttgtcagcatggaaattcttctattacaagtgtctttctgacatgagccctaaaattgcgcatatctttcttcatccctgtgcatctccacacacattcttaaggctccttgcacagtaattacaacctttctctctgctagcatggggtctgggttgatgaagtaactgctccttttgtggctttgcttataaaatcagtgtcccatttcctaagatttgagccttacttgaggagtagaatgatagattttttcttttttttttttttttttggatggaagagagattggactgtggaaataaaactagaaatagcctgtatttctatatggtgaaacagaagatagatgaggatagtgctaacgtagttttttgggttgaaataatgctcataaggctcttctgtgctactgataggagtgttgaagtcacttagcagtttatatcaacagtcttagaaatggccaggcacagtgactcatgcccttctatcccagcactttgggaagctgaggcaggaggatcacttgagaccaggagttcgataccagcgtggtcaatatagtgagaccccatctctataaaaattaaaaagaaagatttagctggacatggtgttgtgcatctgtagtcccagctacttggggagctgagctgagaggatcccttgagcccaggagtttgaggctacagcaactcatgatcatgcccactactctccagcagcctgggtgacaaagtgggacctcatctcttaaaaaataagtaaataaaagagccttacaattgttcgtgctctgtcagcttcaggaaacgttttctgagtcactgcactgtgcctggccctgtgttgggcagtcatccctaagttctaaatgtgcacacttgagtaaaggaagtcggctgtagatgcaaacacttccaacaccrcgtggtccgtgctgccctgatggggactgtggagccccacagaagacatcaaactcagcctggaacagggatgcctgggttcatgttaaaagttgtcactcaaaggaaatttgtgtagggacccagtcacggaggtaagcagcagtggtgttgtgtggctggaacataccaggggagatagggagtggtgggaacagacagggtccagatttggggaagcccagaaatgcacattctggtcctcaacccaaaatgacagtgggcagtatgaccagtgagtttgatttcagcactatgtgagcagccccgtgaagacagctcccaccaagggcaccggcagcacacaggctgcggttttccccctacgtgtaccagcgcatcaataacggtgtcccaatagcagcttctaattaaattttatcacagtcctgaatgcaccgctgacccacacactcttccaagtgggtccgattcacaggatatttgcgcagttccgcagatctgcagatttgaagaggtatttattctcatttctgccttcccagtccagcagaagttctaatttgtggacggcagctttggtaattaacaaagtgtgttctgtgaagtgaagcaggaaaactcaggactggggagtctcgctttgggtatttatatgcttagttgtaaataccagtgaaatctttgaaatgaagacctgtctgtcttaaaaataaaaataaaaacccttaccatgcatgtcctcttcaaaatcacttgccagaactgagttatttgaactctgactagtacttaattttagctacttttttgttaaaagcaccaggaaaagcagtgagactttcagatctttaaatctccttttttggaagcaatgacaatgctcctccaaagtttgtttcttacctttgcacctttgaacaattgattttgattagaaacattacaccgagcatttactttgacatccctgagtacaaacagtcattttaatggtttttttaaaaacaaaatcatgacaggaacatcaatcctttgcctggtgtatgaaggccgggtatattaattggctgtcagattctgaagaaataatggattaatgtgcttgatcgtaatgctctgttcagagactgaagtttgatcctgatgtccccagcctctctgcttaacgcaattacagatatgcattcaggacatttgagtggattgcatttcattaatatgatttgagcggacaacattaagctgctgtcgggtcctctctgacagctaattactagaatgaagcatgtataccgctaaggaacaatggtgcccttattggggccattataacaataggaaaatagtgctttaaaatacttggatagttactttccatacgtgtcatgggccatgaagatagcttagtgtggggagttagaagaaaaaggatggacaagaactggaggagtctgtaacagcaggattcttgcttgtctttaaaagaatctaacagtctaacctacggtccttctaaaggaattgagaaatcacttgcttcatattgatcggtgggttctctcaagatgtagaagtatcatgggctgtgaccacacagacctgatattttgctctctcctctttgcctcctcccccagatgtctttcatcctggagaaagtggccatttgtaacacccgtggttttttaaatgtttcctttgagaaggaaagtgggcctttgactcgtggtgttgtgacttagccacatgggccatttgaatgtccacccaaggcgggaagagctgcatgtgttaatgaaagctcatcctctcagagctattcccagctctcagaattcctggatttactgagaccatgcactcaacacattcgtttggctcccagtgtccagcactgctggctactggtgataaagaggtgaataaggcatggccccttgtccccaaactcctcaagccctgtgagggaaacagacattataagagagagagagagagagagaaagagacaatgatgggtcataatagatagacatacaagagaagtacaaaaggccaggtgcagtggctcgtgcctgtaatcccagcactttgagaggccaagatgggcagatcacctgaggtcaggagttcaagaccagcctgggcaacatggcaaaaccccgtctctactaaaaatacaaaaattatcctggcgtggtggcacacacctgtaattycagctactcaggaggctgaggcatgagaatcgcttcaacccgggaggcagaggttgcagtgagctgagattgcaccactgcactccaacctgggcaacagagtaagactctgtctcaaaaaaaaaagtacaaaaaaagggcctgaaggcttctcagtggaagaggtaataagtgaggcaggtcctaaaagatgattaggagcttattgaatagttagaaggtggggtaaggcttctaggcagagtaggcacttgtgcataggccaggaaatgggatcatcagactgtgtttcctttaatagggatgatctggcttaaagatccatctgaggaccagaaggaaatcgtattcttagctgcacttttaagggtgtgttctgtaaccttgagccacccctgaccaaggctcctaagaggctctggaaaatcttgaactcagtatcaggagtcctggtttctagtcctaggtctatcccttaaaagtcatttggcctcagttgtctcatctatgaaactgacgtacccccaccatgccagcttcatagatggcccaggtttgatccaagagggtgcgggtgtattcccaggacctccagacttccggggaatggcaaaaccaggagttaaactcagattaggccaactccaggcccatatgcttcgcactgctccaggttcctttggacagccagtgtaaaaaagtcagttttattagcaagtaggaagctctaggccatccagcctcatctttggagcctcttccagcagtacaaggtgacatgaaaacgcctgacagtgaagcagctgtcatttgagagaccctgagccctgcccactcaaagcaatttcctaggggaatgtgccattcttctaggaaatgtggggggcctctggctacttgcccagacccctgttttcctgggatgtagcatccctggtgcagagaagttccccccagaaacctcagagtctttttagagtcctagagacagatcatcccagcttctcccaagatgtttgcttttctttcaaattgctctcaggaaagagagccagaagctattggtgaagcaatggagggggcggtccaagcaatggtcgcctggtgcttcagcgtgcatgccttcccctccgccctggcagcctccactcgtagtccctgagtgacarttcatcacccgcagctgggcttctcgggctattcttcggtaccactaggggcaaagtgtctaaatttgacccccagaaatcagatccctgatccaagccaaattcctctggggactagagattcttcrccacactggatggaagagcatagggcagggactccctgtaacggacactctgtggatgtcttctggatgaaggagtgtctgacatctgagagaagtggcaatggagcaggcatttctggtgtgatggccccgctctctgggcactgtcagttgacatcatagcagttcccacccctccaagttttcatccggacccgctgcaccgcccatcctctttcaccctctcagtattctgagtgattgccatgacaagaggaacttgatgctaagcaaagtagcaaagaatcgattcacaaagaaaccaagtctccccccaacctccctggttgcccacagatgtggaatgggggtgatgaggtctgtcctgcctccctcaaggctccagtgccaccatgtcagggagtgtgagcttcctgaggatgaagccgtgtcttagtcatggccccatccctagtacctgacacagtgcctggggagtggttcagacttgaggatcagctcttgcaaggagcctgagcatcccagccctgcctgagcatcactgcccctcctgggaaggaccctcctactcacctgagcctgtagtagaccactgggcaagtcagctgcctcagcaggggttcctcaggtggtaaccatgtgtcattattccccaagagcctcaatgggtaagcacagaagcccctgctttcttccctgaatgttttttgctaatttctcaatgggtaacacagccctgccaagatccatttccctcctattaccaggctagcgtttttctaatggctcctttcctagtgatcctcaaacaaagagacgatgttggagggtgacactccagcgctgcctctcactccctggtcattcctgctaacgggcttagctgcgcttcacagtcattatcacatgtcgcactgtctttgggatgcagagatgatttgccagctccatgatgcttcgtttttactaaaatgaaggcagaacaagaaaaattcttgtatttaaaaaagtgtacaattactcctgacagatctcatcctaaaactctcctatgtcccctagtccctatatgatggtgtctcactccttggcctggcatccaagaccttcacaacctggcccatgatctccactttcaattcccttcacattctcctcccatcactccaagtcccctggtgcagctatgttcctgagtgccttgggctgttcccacctgcattctctttgcctagaacaccctctgtggtctgcccagccaggctgtcaaggctcagcacacgcttccctccctctctggtcctctgtgaagctcttcctgactgtgtgcctgggagtgaccccctctcttcctttgtgcctcctttatacccagcaagcctctgtcctgacacctgggccaggcagtgccctcatgtgcctgtctgtctctcccatgaggctgaaagcacctcagtaacagaagccacgctggagtccttggtggcccctagtgcccagcacagagcctaactcacagttaaccctgtgaacatctggggagggcaaggaagccatctctgagaggccttctcaggctttctatgtagaattcatctcygtcttcctctcttgctctgaaggagtccctcggaaatcttctcttccagctgtttctttagagttacgtgtccctctcccgtaaggtagtaagatccagcacccagtggtcaaagacaaagccaactggcccaatagcaaactcccctcccactccacccaagtctagggttacagaggagtatgttggagggtgaggacagaaggagtttggtttgggacacgttgatgttgacacagcacattcaggtagagatgattagtagatagacattcaaaggagagtgctggagagatctagggctcccagggtcctggatgggctggaggacctctagccttgaagtccgtgagaacaactggaaatgttctttttctgtgagatgcaggaagagcagtcacacaggatctgtaagtggggaggagctcagagacccttcttcttctttctgttgactagtcagctgagacccagcaagctaacattatactagagcgttcatggcagaccctcacttataagctccttgaaggcagcagctgtgcaargtaaggccccacaatgcgggtatccagccactggaattacctgtgaggctggccagaacaagccttgacctcccagaagactacctgaaggaggaaatgtctctgggtgtgtacattctggtttgttggctaggcagccagtcattttccttcatgttgttacttagcatctcagagcctcagatcagagaggacatcagctttctatccacacagatagcctcttttgcaggctgtctggccttggcctacaccgttccttctggtgtcagggaacctcattctaaaaagggcccaaatgccatcatcacagttttcatgccctagtcctagttctgcactctgcagccacataacaccggatcattgctggtgatttccccactagtgctagaaggatccagttcttttccactaaccgttctcactcccagtccttcagatagtcttagccaggctctggtttatcattgtccctcctaaaaggcctgaaataccagatattctggatgtggttctgttgagaacacagtgcagtggacttatctccacccctactccagccttgtcgcattcagtacagtggcctctggctacatgtggctgcagagcacttgcaatgtgcctcgcccaaagggagatgtgccgcaaaggcggaatacacagcagtttcctgtggcctaggatgaaaaaaacaacgtaactctcattaataattttctatattgattaagtattgaaattatagcatatattgtataaaataaaatacattatgaagattaatttaccttgttttttttttaatgtgctactagacaattgaaaattatgtatgtgactcacattatattcctggtttgtttttgtttttgtttttttgttttatttttagatggagtcttgctatgtcacccaggctggagtgcagtggcatgatcttggctcactataacctctgtcccctgggttcaagcgattctcctgcctcaccctccccagtagctgggattacaggtgccccccaccacgcctggctaatttttttggtatttttagtagagatggggttttaccatgttggccaggctggtctctaactcctgacctcaggtgatttgcccacctccgcctccgactgtgctgggattacaggcgtgagccaccttgcctggctgatatattcctgtttctaatggactccaccacacttgagtacagctcaggattttctacttctgtgaatgtagtgggtcgcattattcttttgtttgaactatatcctacactggccattgctgaaccatgtattaaacataaaactttgcaccttgtacacctaccatggaaattgttttcaaaacaggccggccttaactagtacttctaaaggtgattttttttaaccaaagtgtaggaattcacaattgtcccaaatacacctcaacttgttagtttcagcctattgttccagtctcctgagaatttttctggtcctttttgtcaccagcttctttacagattttatcagcgttttctgtgttttaacctaggtgactactgatgatgtcggttgggatcagaacatgcagggagcgtacaaagcaccttcaccagcagtgttgacaacagctactaacccactgtctagctgtggctgttcagcccgtgtttttccattttgcccataaggagactgagtttctccagttatctcactgacaccagcttgtgctgtgtctaaagtagcctcgtcccactgaacccaagccccactcccaagccacctgaccacctattaataaaagaaacttgcccttcactgcttttagacaccaaatggatgaactaattttcactagtgttagtgactgataagagccaaacttgacttttatgtgaaacaacaacaagctgtaactggggccttcggtaccacaggcagaggaagaaatttatttggagcttatgccactgaggcagagttaatagagaaaaagttgggggacttaggcgaggaaaaagttcagtgcccttcaggccatttctcattgctcttgccgaaggatgaggcttcctgcagctagtggtggagacctggtcaggatcatctactcagtgccaggattcatggatggaagcatttcctgtgtgtgccactgctgtgctagcggctcacacggagtgcctccacctaaactctctctcccttactctcctttcatcatagtaagttttgggaataggactagaacttctaacttcagatcacttgcttttggcatgacctttatctgtggtctcaaacatagtcccctccattcgagctaggtctgtggttttggttctcgcctgcagctgtatgtgtgcrtgtctgaggtgtgtggatgtgtgtgtgtgtgtgtgtgtaacagagggaagaggaagatattctctcagctggcatagggcagaggggaaatctttattcgcttctctacctttgaagccttcgctataggaaatgttttgagtgtgggaggccagaggggagcatttgcagacctcctgcctggccgaattgtaagcattagctgtctttcccgggtggctcggcaggccctctctccctttctttggggatgatagatgaaggcaggcaccacgcaaaggtgcctgttttcaagcgcaccgcatgagggatactcactttatctcggtttgtggagcatctctcccccagaggacagagtttactttatgtaatgttaacgtctcgctttaatgctgtctccttaagagaactacatcctctgctttggagatttgaggttcatgtccagagggtctctagtccagggacgtggagtggggaggccccctaaggacctcacagagggtctcttacagaactaaaactgaggcaggctgggggataagcccttgagccccaaattagtagaggttgtgtatttactaatcttgcccatcaagaagagaatgatttcatgatttagaccaaacaattctggtccacttttcaaattgtcagttacaaatcagactccctcattgggatctgtctcagaggctgtggtgtcttttgcatttggaattagctggatgtaatgaattctggattttacatatttattaccattgtccatgctccctctggtcttgtaaccacttctgctacccagcctgactccctccagggagaacaagagggaggctcggaggcagctgggggagggggaagcactgtctcacaattgaacaagcagggttcacatcatgactccattgtccatgtgtttactccagcaagcattcattgcagccctgtccaggctaagccttgtgctggcggataggatctagaggtgaatgagtaatggtgtctgccttgagatcccatctagtggcagaggctgccccgtacccagcaggaggacaccctgtgggagctgctggctggatgtctgtgggtgctctgccgctggttccgggaaggaggcttcaggtcacatgggaggcaacactggctgggccttgaaggaagaggaggaggcatttgcccagctctgtgttggaaagcaaattaacctctgagcctcagtttcttcatctgttcttcacctgtaaaatagggatagtacatcaaacataagggctccagaaatatcagcagtcccctttcagcrtgcttkgtacttacatttaatgggaacaagtcttttgttcccccagcccccctctttttttcaattcttttaaagctgttgattctgcaggacattgtgtatgtttatatttctgtggtctctgttgtccagactgggaaaatggtagaaaagattcaaagggatctcaggaaagacctttgagaaacaggggtctttataaggagcatgtgggacaagaaagtgtccacaggacaatcgcatccaggaaagccatttgggggccatgcgcattggtctgagagtagcctcaggttctgccgtatctttgctcatggttcagggagaaaaccaagaactgtgaccttggctcgtaactaaaagacacaagagagaaaacattctgaagaccctgctctagttaccagcaataatattggtgtggagggggcaggtaaacaaacctgccagctgacttgggccctagacttggttaaaccctggcttgscttcccttgattgtagatggtagaagcccaacttaaacgaacttgagcaaagaggataggagggagaatttcttggcttatataactgagacatcccggacttgtcttgctaccagcatggctggatccaggagctcaaatgatgtctagactctcagtgacctctgtttggctttgcttttcattatctgttttattttcaaacattctcttgctttgctatagaaatatgggggcctctatggtccttctagcttgaagtgagtccctctcaactccagtgtctgtgcagcaactctcagtggagactgctcaagttagtgtcgatcacttctgggctaccctaaactcattggtgtgaccagaggatggagtcctccagtcggctcccagggtcgcatgcccacccctgtggctgggcagggggttggcaggatcagtcccaatgggaaaagagagttttattacctattcccagaggagtgtaagaggcaaatgtgtggtcaataggagggtggagggtgcccagaaggttgggggaccatggaaggtatgggaactaacatatgaggtgggggtgaggagttggatatcagggatggtttcaccaaggtgcttgcaccagcactgggctctaaggacaaggaagaygatgccagcacactcatgctcaaggcttgctggctggacacatgccrtttagttggtgccaactttccaagaggctcctgttggccatggctacaggttagaagatcaaaggggtgctttagggagtgggactcatgggggatgcaggagccagctgcttccttcctggcctcccagaagtctcggtgtgtatcaagctgaggcagaaagattccagggctgggctagcagctctggggctggcggcagagcccagagccaaggtgacgctgtctgtgaacagtgcagagatgccccacagcgctggcatctaagagcacagtgttccgggggcgagtctctgttcctgtagccttgacctgggacacgttgccctctgactagctcaagttcagggtggggccttcattggatttacctgcccacttgcctgacattcagcctctccccatttttactgaaattttaaacgtatttatgattgagcttcttttacagaggaggaaattagggctcagagaggttgtgacttggccaaagccacagaactgagaaaagtgacaatgccaaaatccatcgatctcttctcttcccacctgctcccatgcaccccaccatgcagccagtgatctatggcacccggggtatgccagccactgaagatccaggggaatcaaccccttgttcccaagtcacagagcccatgggccagggagatggattcagaaaatgaaatctgctgcagtgctagctaaatgttagcaatggctagaaaatccagaagcctaggcatgagagtttagcctccgcatgtggaggccaaaaacagagtctttgatccattccttatatccaggaaactttgtaaaaccagcacatgctcctcaaaggtgagtgcaaactgagagcaaagcgtcttcttggatgctcaggcttctttccccggcagctgaccccacactgcgtgtgtgtgtgtgtgtgtgtgtgtgtgtgtgtgtgcgcgcgcgcgcgtgtgtgtacgcgcacacacacacacggtgtcccctggtggaacctggcagggggagaggtaaggtctttcagcctctccaaagcccatggtcaggtactcaggtgggggagccctgctcgcagccccgaacctgatctgctggtgttcagcggaggagattacagagcttaatgattagctcctccaagctgcagctgatgccagcccctaccccctttacacctaattactctcattaatgagctcctctgctctccatagagagagtttcctctttggaataagaggcaaaaataccttgcccaggtagattgctgaagcctttaattattgcccacacctgctaagccttgtgactcacacctagtgatagtgcggagctgaaatggagcttgtttataatcacgagcagattttaactctttcaaagccaaaaagccttctgatttcaagagacatgtttccccaagacctcacacatgctcatttcatgcatgcacgccaggctctgctcccccaacactggggatcctgaggcagcagaagtgcagctcctgccctgagggagtgcacagtctaggaagagtgacaggctagaaactacacagacaattatagtggctaccactcaccacttccctacatcaggtcgcctgtagccctcgaaataaaactttgaggcagatgttactacctccatgttacagaagaggggagggggcgcagagggaggatgtcacttgccccaggtgccacagctagggagggtgtgaggagagtgggatcaggtctgctgggctccatggccagtgtgcaccccactgttgcccagaagctcccttgcatgccagactgtactgagggccacagtgaagtcactgcaggacacggtgaggttaggaggaaacaggactatgtgagtaacaacagaaggaacaggagcagaggctcaggggagaactgaatgccttgtgcattcgtagacctgcaagcactcagtgtggctagaaggtgcactatggggtgcggagcaaggggcaacaaggcaggaaggacaggcaggggccggggcagggtcctaaatgcaggggaaagaccctggacttcctatccgctgcaccctccccagtacctcacaaagcacccagtacatagcaggtcagtacatgttgatgaatggagggacagccatgctaaaggcatgataaccattgaaggatttaagcaggggagggacagtaccagagggctgtctggaagaatctctgggcggcttactctctgaacactgagattcaagggcaaagtcctcaccacagccctttgccccaatcgagaggtctgcgctaggctgtctagttgctcagtgttagaggtgcgattaaacccagatctttgtgtctgcaaaaacccagctctgtctccttcaccttgtgtcctgctagatagaagataatatactaaatggcttagaacagaaagacaagagtttcccaccatggctgctaggattctgaatgagaaactttcaggataggagcacaggtttctaaaacaccagagctgctcagacagaaccaagtccctctgaccagatttagacagattgttagatgaattgatgtaatatttaatagcatgtatggcatggctccgatgaccaggagacactaacccgtttgctacaagtcctaggagactaaaaatcatttttaaaaaaacacaaaaaaaactaagctgtgtctcaaacaaagaacaacaacccacaactgagtctctcttacacatctggccttggggcaggtactttatgtgaaatctgtctgtgcctcgcagcaactctgggaggtagatggaattatccccatcttacaaacgaactgacctgtgacttggggagctaaagacttccccacagtcacatggataatgagcgacagagccaggagtctcagcccagcctgtcccactgcagagccggagccaccccaggacacactgtccctcagaagctatccatcacaagacatcagtcaccacacatggaacccggaacagaccctggcagacttggtgtgtgcatgcgtctggtcagcccagagctggggaacccagcaagtgctaggcctgggaagcctgtgtgttctggatagagactgtctgcacacagaggctggcctgcaagacccaggctttgctctgcttgggatttgtctcctgagttcctggaggctgccatggtgggggtcatctggcagccaagggaggactggagcagcagcggcggcatggccccccagcatctctggaccaccatcggcatgccagcccctgctcttggggtagggattccaaggtactgaaaacatagtccctgcatggggcctctgctggactcttaggaaggaggagaccctggcgagtactacctggtcctacttgcctctccaaagcactcagtgtagtagggggaggtggtcagtcggctagatccatcaactcttgcatccaagtcaactcttgtctcctaaagcctctcttgaattcctccctttccattcctgcctggcagctgcctcagtggacacagtgcttccttggcagatcactggcctcactgagatcagaatgatcctcttgaagtgcaaatatctacactcccttcccccagccacccaaattttagggttccctgttgctttaggacaacatgacctaaaaagacctgcatgatccatgcccaggcttggttggagcccctccccctctgctgtcctgttccagcctctctcatttcccctggcactcctccatcccacagaggcctggggcttctgcccaccttcccctctgagcacacaggttactttcccaggaatgctttctgcagcctccaggtgtcttcttgggaccttgttctttgttctctgcacagcaggaacctctgcttcaaggccattgtcccagggggtaattgttcctttatggggctgcttgactatcctcaggtagctgactgtgwtagctccaggggctgatacccagtaggctctcaacaactactcactgaatcagtgaatgaaaggcaaaaacagccacccttcctcacaaatttgggaaaggcttcccataggcagagacctttgagttgggtcctgagtccatgtttgccaggccaagggaatgataggcaagaggtatttgatttgaccatgtgtgtgtttgtgttaaaaaataaagataatgggccgggtgcggtggttcacgcctgtaatcccaacactttgggaggctgaggtaggcagatcacttgagactaggagttcaagaccagcctggccaacatcacaaaaccctgactctactaaaaatacaaaagttagccattcatggtggtgcacacctgtaatcctagctacttgggaggctgaggcacaagaatcacttgaacctgggaggcagaggttgcagtgaaccaagatcgcgccactgcgctccagcctgggcaacagagcgagactctgtctgaaaaagaataaaggccgagcactgccactcatgcctgtaatcccagcyctttgagaggccgaggcaggtggatcacttggtgccaggagttcgagaccagcctgaccaacatggccaaatcccatctctactaaaaatacaaaagaaaaaaaaatagccagacatggtggcacacatctgtaatcccagctactcaggtagctgaggcatgagaattgcctgaacctggaaggcagaggttgcagtgagcagagatcacgccactgcactccagcctgggcaacagagcaagtctctgtctcaaaaaaaaaaaaaaaagaaagaaagaaaaaagacaatatgcatattgaattacagctttcctaaaagctgacaccccttttctgaataggcataaagaagcataatcaaattcagctcaagtgttccccctccaggaagtcttccctgatcaccccacctgtaaatagcaggggcaatgatgcctactgcagacctctacttagtgactagctgatggcaggtggctggtaggacctgaccccaccactccttatttgggtttcttaatctctcagaacctcagtttcctcacctttaaaataggaataatgatagctgctgggcaaaggctgagtgaaggacggcctcttcggcagcacctggcacaggagggccgtctgtaaatgcacgcgtccttcctggtgcctgggcttccctcactgtttcttcctcccgctcccgcttccttgtttccacgtgttgctatgcagcctcactgtcctggtaggtttctaggtagttgccatccccaccattgccacctccaccaactaatagctgctgtttagctcacacatgcatattttagcctcataatttttcttcctgagtcggcctctgcagattctaatcacctcactttctcttccctgaattccctccaatttggagattcaaaagaggcgcttctctgcatgaacatgctgtgattcaagttgaaaataaatttctgctggcagcagccagctttctgaaaagtgacatttaagactgacagtggacaagattgtaaacaggtttccaataagaaaaaaaaagtcagtgtgaagtgcattctatgaatttttttaaacaatgtgtgcgcatgtctataattgcagccttgctgtgacgccgtctgcttcaggaagaattctgggacagtgtatgtctgtttgaaactatcttggtatccttttacttttcggaaagcagcttcatttcatgggactcactcccatacaagagtgtagcgtattcattcattcgacacacgtgtgttcagtgtgccattgtgtgccaggctgtatgcttggtaaggtcatgaagacagttccctccctatctgtagagagttcacatcctcaagggggaggctggcggataagcaggtgacttttatttaataggatagaggtaagcttagagtgctatgggaccccagaggaagaccccaagagggatggctatgggggcagggacagcttcctggaactatggcacctgagcatggcttgtaagatgagatgttagcctaacaaagaatggaggaagaggcattctattctaagcagagggaataccgtgagcaaaagcaaagaggtttgaaagcacagcgtatgggaagctccaggcctgtagcaatgattgagacttctggtttgcagggctaatgtcaagaggtgtggctggaggggccttggggggctggcacgctaagctaagaagagccttgaagcctctcacaagggcagtgccgggcttccgcaggtgtggcgtgagcacatgtccagagtggtgccttgaggaggtctctcgggagtgtcgagacacagggttgggtggagagagtctggaagcaggggccctgggaggaggcaattgccgctgtccaggcagaagatggggaggcctgggaaccctcacagagtcagatggagggctcaggggataagaacatttagaaagtaaaatagcccattggcagaaggtctgttattttgtatttctcccaaaacaaccttgttcatgagtacctcagattatcagctcctacttcggtaggggagtctgccctgacactagggaatatgttgctagttaaatgaattcagctgacatttgccttccccattcatcatgactaaatgaaagctcttttctgagtttcttggaatggtcttttgacagtcccctggccagaaccacaaatcaccctgcagttagcgtctaaaggaagcaagaagcaagaggctcccaatgtgtaataccaccaaagcaagtggaagattcgtttgatccttgtagggggtttttgccaaaaggcgtttggggtcctgcaggggcagacaggccaagtgggcagacagggaaaggcatggcactatctagtcaaaactctggcatccagatgctctcttggggccacttctctttccgcccaactaaccagtccctacgtgtttcagtagccgtgggacagaggggagcagagggctgggcaaacaacctgtcacttcagacctcacaggtcaaacgggctgaaaactacaggaattccaggctatctttcagggctgtgtgcaggttaaatgaggtagtgattgggaagccacctgaaaagccgaaaggtttcccaaatgaaaagaatttcaacagcagccatccatttcccagctttctaagacagtctgatgagaagcagggctgaaaagcatggctataatggagttcaggagtgatcctgggatgtcagtttccttgtagctcctctcatcaagagcaaatgagaggcgatcatgttggtgaccttttgaaaggtggcaggtgacagaggaaagaacccagactttagactcagacatgtctcacgtgaacctggccccaactgcttgtcatgaggacttgggcaagttgcctggcttttcagagcattatttccagatctgtgaaaagatggtagatgccttaccatgcctgtcacatatttatttccttgtttatgtgacctccccaccctctctgagaggagagaccttggctggtttattcattaccattctggtgcttaagcagtgcctagcctgtaataggtgtacaataaatagtttggttttcatttatcactcacttttaatacctccctgtcastgcatcagcagtaaactggattaacacgaagtctcatttggtgtcagttgtggaataacacagtcagctaccactcgcatcccttgaggttctggctcttcatgtccccttgtggatcttccccaacattttattataaaaatttacaaacataccgaaaagtggaaagaattttatggtgaatacctgcatacctaccatctaggttgtaccattaacattttactagacttcctttatcccatatctgtccatctgtgcatctatcaatgcatctcatttttcttgcatttctgagtaagtcacagacatcagtacactttaccgtaaaccattcagcatgtctatcagtaactagagtaaatactgtttgaacgtgagtagcaggcactcagtaaatgttcactgctattttggttattggaaaggagggagggaaactcatggcaattcagtcttcccaaaatgagacacctgctagccagtgttgggaatggccaccatttcccaggaaccagactgctgttatttcacaggctagcctcgggcagggaaatggctgggagtgacagctaccatggtgcccccaggcacagacttcggccctatgccctggacgcttattcccctaacaaccgccaaaagccttttgaagacttaataatgtgactggaacaagggaggttgggattctcatggtggatttctgcagagcacagttgagtttggttatctgggttcagtccgtgtcaggtcctacttgtccagatgcagtcccaaccctcttttctcggcattgcctatctcagaagggacacggggattaggagatcataaatccaggttctagaaactcagaatctgggaccctgaccagcaaatgccttggccttgcctaggactggtattttccacatgtcccagtgaagagcccagggatgaacagacccctctgagaacttgcacttttccaagaaccacgtggagccatcatctcaattcatgtgttcacgttctatcaacaaataccattgagcacccttgcctttgaagttaacaaccttgggagaaactgaggcagtccccgagcaggatttggaaagcaatttcatttaaaaggggctggagggaggggggaggcactcgtgtkcatttaatctttttttttttaattatttttttttaagttccacggtacatgtacaggatgtgtttgttacataggtaaacgtgtgccatggtggtttgctgcacctttcaacacatcacctaggtattaagcccagcatgcattggctcttttccctaatgctatcccccagccaccaccctcccccgacaggccccagagtgtgttgttcccctcactgtgtccatgttacgtcacccaggctggtggagtgcagtggcatgatcacagctcactgcagccttaacctcacgggctcaagtgataccctgcctcagcctcccaagtagctggaactacaggggcatgctatcacacccagctaattaaaaaaaaaaaaaaaatttatagagatgggatctcactctgttgcccaggttggtctcaaactcctggcttaaagcaattctcccgccttggcccaaagcaatcttgccttggcctcccaacgcactgggatcacaggcgtgagccactgtacctggcatatttaatctacacccatcttctggagcaggaatttgctctcacgtcccattaggttgcagcaggagataaaggagcaagccaggcttggcctcaaattccagtctcttcactcactattgaaatgaccttcagctgctcatggaataccctgccctcagtttcttcatctgaaaatggagagtagtgagaccagcttccttgggatgtagtaagatagagcctgtgccaaggggcctaatggtttcattgacatattgaccacctaccctggaaggttctatctggggcattggggatgcagccatgaggaagagaagtagagccaccgccctcttatgctaccgtctgggtcaggcacggaaccaagcatgaccacctcggtttaaatcctgcccatgtgaatctagagaagttatgtggctcagtttcccaattgtaaagtggacacagcaacaatatctaactcatgggtggttacgagaattaaatgagtgaatacatgtaaaacacctagaagggtacctggcacatggtaagagcatacaagtgtctgttacccttgtactactagaccaccaccactaccgcctcccacacctcgttcccaaatgcgttagaatcatctgagcaactttgtgaaggtctaacccatggcccaggaacgggcattgaaaagaacctcctaggggaatctctatgtgctgctggctgtaggaaccactgatcaggtgaccaacaaatgttgggttccaaaacacaggtacagaagctgaaactcacagggaaggagcatgctcaggaagacacagctaggaagtgctagaactagaacaccatggaaggctggagactcccacatccaggctcttgggtagacacttgcccaagatcagtcagcccagcctgctgggccttaaaccaaatctgggttctccacaccrtcgtgacccctttwtcagctggaggagatcatctctcatatacggaaatccctgtatctcaatattaagacacttaccaaatattgtaaccaggaatctcccgaacattttttttttttttgagatgtggtccctctctgtcacccaggctgtagtgcaatcgtgcgatctcagctcactgtagcctccacctcccaagttcaagcattcttctgcctcagcctccaaagtagctgggattacaggagtacaccaccacgcccagctaatttttgtacttctggtaggggacagggtttcaccatattggccaggctggtcttgaactcctgacctcaagtgatctgcccgccttggcctcccaaagtgctgggattccaggcatgagccaccatgcccagcccacccaaacatttaaactccctgaaggaggcgtataagaagctgtccccccagatgatcacctcacctacatacgtatatggaggagtatgcatgccactctggcattctatctgggcaactcttataattaatatttacttaaaacaatcattagtctctgttgggcgacacgaagcccacgttagcaatatttttagccaggccttccccacacctgcgatggcaggcgagtgtgcagcagcgggaacccccacagtgctttataaataagcctctgcctgcacctggaccactcaggcagcaggccaggggggcctcggatggggtcccaatgtgcactcagagcagcccgcgcttcagtgggtgtccacactttgcttttctttccaaacactaaaaatgcaactctgtccctcgacacagtgtggcatctaccccaggctagacctgccgaaaaggtatgatttttcctgaagtggttgaggatttcttcagtaagggagagggggatcataataaccgtttatcggatgctattaataacttatttatgttcgttgtttcttttaaaccacgcaacaggccagatgcggtggttcatgcctgtaaccccagcactttgggaggccgaggtgggcggatcacttgaggccaggagttsgaggccrgcttggccaacatgacaaaaccctgtctctactaaaaatacaaaaattagccgggcgtgttggcgggcgcctgtaattccagctactcaggagactgaggcaggagaaccacttgaacccaggaggcagaggctgcagtgagctgagatcgggccactgcactccacctgggcaacagagcaagactctgtctcaaaaaaaaataaattaattaaaaaacccacacagcggtgtgacaaagtaggtcctatttttatcctgctttcccagaaaaggaaactgaggctcggaaaagatgagtgcctccccaaggtcatgcagtgagcaagtgagattctaacctaggctggctgaacccatgcttttcactgtcctcttcctcagcctcagcctttttttattccattaaaggaacagggtgaaggtatatgctaggcagtttacatacattgccccagttacttctcacaactggaataagctcatgggagctaagaacaatgattcccattttacagaggaagaaaccaaggctctagagagtttgaagtcacttgctcaccatcacactgctattaagcttaacagccagaattcaaaaccagcctgatcctccaacaccagacagtttcccaccttatcaaaggcattaatgagagacatttgccatacatgtgggtaacaaagcatcactttatatagaccctaggattttctcattttcctactgcgctgcatgagctttttgcttaaaatatttgagctttttgcttaaaaatttttgcttaaaattttaaactttttgcttaaaaatttttatcccagtcaaaaactgccacggtaataacagctgatgtttatagagagttttataattgtcagggttcttctgtaattatttgatccttaaaataatgctgtgaaagtaaatgttacaggctgggcaaggtggctcacgcctgtaatcccaacactttgggaggccgaggcgggtggatcacttgatgtcaggaattcgagaccagcctgactaacattgtgaaaccccatctctactaaaaatacaaaaattagctcggcatggtggtgcatgcctgtaatcccagctactcaggaggctgaggcaggagaattacttgaacccaggaggcagaggttgcggtcagccaagattacaccattgcactccagcctgggagacagagcgasactccatctcaaaaaaaaaaaaaaaaaaaaaaaggaaagaaagtaaacgttaccccattttacagagcggaaccctgagcttggagaggctgagtgcaaacccatggccaataccagcagagcagaagctcagccaccgaagcctgcgtcctccccatactgggcgcagtgttgctccaaggcctggatctcttagatggggcctaaacggagatttagggacttttagtggagaaagagactgggatgggaagccagcaggggagcctggccctggaggaccccctcattataggtggtgacatctcaccagaggaacaggccgaaagttgtggtggtcagagaactacaaaaatagcagccctcatactgcttcctacacaagaggaacgggtggttccagggcagataagaatgactttacaagatgaaaatgatcagtgagggcacacaggtctggagaggagcggagttggcattttttggccctgcaaatagctgcccatctgctctctgtcagaatatgttaggggtgcatctggattgctgcccctgagtctcggctccaggctggtcatgtggttgtctccacgacaactccaggagcggtgtaaacggctgcgcttggagccagatgctgctctgcacatgtggtctaattaaacggtgttccctgtctccctccgccctcccctgcccctcccagcacacacatacattctctcttttccatccctccctgcacccctcctccttacatcctcagtcagcctgtctggctctccaccctgtgtgcctcttcttcagaaatgttcctgttgcctgatttgcagtagaataattcatgcaacaagcatcagagcgcttgctctgacccaggcatggggctagaagctggaggtgcagaggcgagtcagacacggcctgcccctgaggaggtcaccatctagtaaggatctgaccggcagccaggcaatgtaatgcatggcaataaatgctacagcagaggtgagcgtagggctgcagagcccagaggagggacactgacccagccccgggcaaggaggaagcatcccagggcagcttgccctgggttaatcctccaagggtgaagggcaagggggactccccagcctgagtggcctccccacagagggcccagcacacacaaaggcaggagacttacagacctacctggagaaccgtggctggccccgtgttatgggaatgcaggaagtttggggaatgaggagccgcggtgggcggggtgggcagggtcacaccttggggggcttctccccaactccatactctgcttgcttctgcaggcactgaaagccaaggaaatgggagcaactcagtggctgcctgagggggacaaggggccctgagtgaatgaagcctcctgggcatgtttccctcgatgcagtcctgccctggacactcgaggcactgttcagggctgggcggggtgtaccggacatgctgaggagctatatttttgtgtgtattttgagggtctggcacccaccacatctcagatctctggctctcaagaaagatgcccccaaatgaggaagaggggaaccagcaactcccttgctcaccctgtccatgacgtgcccgccagccccagtgacacagctcctcgctgtgaaccgccggctggctgccccaccaggccctccacctgcttcccagttagggagcacttgcttcttcctggtccttggtttttatgcctccccctcccccagtggcctttcttggaccccaccccacctggacagagtcacctcagtcacccatatttgtggaatgacaggtacagaaggccccatccaagacatgatgcccagctcacaaagggcatctcaaaagagccrcaaaggacgttgatctcccctgagcacctgctgtgtgctccaaagtacgggcagcttgacacacaccatatcaccttaaacctcacaataggaagtaggtagtttccccaatttatagctgaggcaactgagctcagggaaattcacttgcttccccatttcttcagagcccctgggcggtacagaatccccatccagagattctggattcctcggtctgggactgcagctgcagaacatggaaaaggacatttttgtgtagaaaatcgtctgacatatcttggatttcctagaagcccaggggaaaactgtgtttgggtaactgagcgtgctcagagctcgggggtgtcgtgggaggagcctggactttggggtcagagaactgacttcaagtgcgactatggttcttcagctctgtggccttggtcaagtcacagctccttcctctctaagatgaggctcaagagcctgtctttgtagggttcttacgagaagtcaacgtgcagccacagagagttgccatgtcctgcggcgtcccagccctagcaggcagcttcgtggaggttccttttcttcttgctgtacgttgcggtctcgcctccactgccctgtcacatgtcctgcacaggtagcgcgtgtcacatgcactgaaatggggctgcttgagtacaatcacttgccatctgctttgggcaggaaaccatcctaatttggggtggaaaacagatcctttcttagcccctccgctaagagtcaagccccccactaggcactttccatgcctcgattgtcaatccccacacagccctgtgaagtaggaagtagctcccccattcggcagatgagaaggtggtctctgaggggttagggacttgccccacgttccagacatgttaagtggcagagcctgcattcccacgcagtgtctttcactgttcccgactctcccatcatgcactgtgcatcgtgacacatttctctatgagaggttgtggcagacctcgtaaagaaaagccttttctatatctagaaacaacacattcacattagaaagcaccttggagactttccaagcttcccattttacggaggaagaaaccgaggcctaggcaaggaaaaggaatccagaccaagtcaggcatttgactcccctggcgctctttccagttcctgatgctgccacgtgctcacgactagaaacttcctaccgaagtctcctgtgtaccaggcccgtttcaacaccagagactcagccctgcatgagtgacgttcggaggaggagtgataataaataagggagtcatggggctaataaataattctgacaattaatcatgtggacagtgccacagagcaccccccagaggactgtgtcaccaagcgatgggtgggcagcacaccttcaggggggcctgtctcctcagttagggggttagggcttttcatttgtggagacgaatttgtgcctcttctgttttatcaccatgtccttttttaccttgagatccatgagtctcatattcccattgctgcagctacgtgggttctgcggctgattgcgtttcagatagattctgttgctctaggggcctatcaggtccctgacacgtgtcctctctccagtgcacttcctcaaaccgtgttctcctcaytagggaaacagaaatctctaatcagcttggcgcttcctttcttgggactttggatgcaagtgtcattgtgttgaaaccgggaatctggcccctggtgagagtgaggcaacccctggcgtgagtgaggcaacccctggcgctggccacgtggttgagccagcaggtgtttgaggttgagatttcagtgggcccccatttggtttctgtgctagggagagagctgtagctctgcggcagcacaggggtcgtcaccgtctcactcatgtcagctctcaccttgcgccaccgctgcactgtggactcaccctatgtaatggggttgaatgcctagagcatgacatagctattacctccattgtatctgtaagaaacagaggctccaagagccgagatggctacagcaggcatagagtgcagccaaaacccacttcatttctccaaagccctttctgttcaacatcaccttagaatccctgtctgaattgctactagggcagccctgagtggccattgatatgtcaaatacaatcttgtgattacctctcttaatcaaacataaataatattgtgctgcatgagccccagggccagacagacttcgtttcaaactctggccctgtcattgcccagttcttcaccctcaggcaagtgacgtcccctttcagagccttgatttccttatctgtaaaatggagatcatcatcctacctacctcacgcgatgctgtgaggagtaagtgagctaatgcatgtaaaaccacccagtgctggtttagggctcagcaagcggtagctgtttttaatcactgcacctgctttcctcttagagccgattcccatctgcatttcttatgggaagaaaatcttacgctagtatgcatgaakaccaccttcattgtgtctccttagcttccacaggcctcccagctcatctgccgttcctgcactaatcagaatttcctgacttctccctgtttgtctcggttaatgcagaaggaaggggctgctggcacagaggagccgaggcgtgggccgacacgcctgtgatttgaatgtctttactgtaatctagcaagcgcgtgtgggggcttctgtcaataccagagcggccggccagaatgggcaaatactggcagcccggccatgcctgcccctgcaaatcatcagagtagctctgggctgacacccacatttcccctaacttaaatcatctgaacagtgagctggcttcacgatgagacattgattctttgtttagggcttgttatagtgacaggggcccagactgggagtctatttctgacatgcctcggccaccgtgcaaatggttcagaaagctgccttggtcctgtcaccccaaaatgtggcatgtccccacccagcccagccagagtcatctgactatagccatgcagtgacccaccttcccaagtccacctgatggtcctgggatccctggtaacccaggccctctgagggcagggaaggagtgtgtgtgggctcaggggtcattagaccatgagccctgggaccttaggcaatgtgcttcacctgtatgggcatcccttccttatccatgaagtggaaatcatttcagaagatctcccttctggcgaggatttggtgagtgaaggatgcaggtcatctggtcccaaacaggagctcagcagaccttggctgccttctcctcacactcacgccagtgtctggctaacctgaagtcattgtcatctaagcctgctgtccccactctctcagctttctggtaaacaaggtcttggcattctttaggccagacaccacactagctttttccatgttggccgggacctcaccctggctccttggcagctgccacagctgaccctgtaagaagaagccgtcagaccagcacagcgttctcctcccagctctgggagggatgctgaggccccagcagggaatttggaggcatttaaacaaaatgcaactgagatgggactgctggtgagaaatagggccaaattccccagcttgctttattcttaagtttttaaaaaggactgtcaagtgggtccaggctctgtgctggtcactttcacctgtaccaggggttgtccgccttagctgcactggagtcagttggggaatttcaaaatctgtgactctggcattggggattaaaataacccaggtaattctggtgaatagccaaggatgagatctgtgaacctccaccatctcattcatccctgcttaatcccccagcagtccccggaggcaggtagctctacccacattacatgtgacaagaatgaggatctaagaggtgtagtcacttccccagggtggcaccaagagcagcaaggagcagagctgagagtggaaccccccaatctgccacttctcagagtgaccatgaatcagagcctgccttctaggaacttgcagtgtgctggggacagtccacctgggtacaggtggtggttggtggagacatttagkgggaaatgaggtcctcttcatctgaatgattcaagtaaggtttccccaaggaagtaccatgaagaaggcagccaggagtgagagtgcacaaaatgctcagggtgtggtggacagcccagaacctctgcaggaggagatgtgtgtgtgagtgaggtggacagggtgtcataagcaagaaaggcagctggagaaggtcacttagagccttgagtgtcatgctcaggaaccaggctggccccacctgcatggacctgtgcagtcacacagggccccaggcttggcttaatgctctgctgtcaccgtcctgaaattcctaacatttttacctttgaactggtgtggggatgttttgtttgttttgtttcragacggagtttctctcttgttgcccacgctggagtgcagtggcgcgatctcggctcactgcaacctctgccttctgatttcaagcgattctcctgcctcagcctcctgagtagctgggattacaggcgcccgccaatatgcctggctaattttttgtrtttttagtagagatggggcttcaccatgttggccaggatggtctccatctcttgacctcgtgagccacccacctcagcctcccaaagtgctgggattacaggcgtgagccaccacaccaggcctgaactggtgttttataaatgggacagtagagtaaggacattggcaaaggagacacgcacagaacatgtgtctccatggggcctcgccatcccaaccccatacaattttctagtgcctgcagcaccaaattccagtggacccaggatgtggggacattcagcaggactctacgtgctcacaaagtaaacatgtccatgtctgacagccccaagaggccacactttccattagaaccagaacttgcttcaaatacagaaagaaggcaataatgtttttttgttttgttttgttttgttttgtttttgtttttttgggtttttttcctgagacgtcttgctctgtcacccaggctgaagtgcagtggtgtgatcacggctcactgcaggcttgacgccctgggctcgagacttcttcctgcctcagcgtcctgagtagctggcatgacagacttgagccactagccaagcccggctagtttttttttttttaagagatggggtctagacggggtctctctgtgttgcccaggctggtctcaaactcctgggctcaagagatcctccccactcagcctgtgatgttctaagaaacatgaatgaccaaggaaacctatcatatttcttatttatgttactttgtacttagccaaccatttatcctgaaaatgatgacatagaaggaaaggcaaagataaaacaaccatggttcctttacctttctcatcagtaagctggagatagatagagaatgtgcagatagcaagaagtgaaataggccaggtgcagtggctcacgcctgtcatcccagcactttgggaggccgaggcaggtggatcacttgaggtcagttygagaccagcctgaccaacatggtgaaaacctatctctatgaaaaatgcaaaaattagctgggtgtggtggcaggtgcctgtaatcccagctactcaggaggctgaggcaggataatcacttgaacccaggaggcagaggttgcagtgagcagagatcacatcgctgctctcttgcctgggagaaagaggtagactctgtctcaaaaaaaataaataaataaaaaggcaggcacggtggctcatgcttgtaatcccagcattttgggaggctgaggcaagaggatcatgaggttaggagatggagaccatcctggctaacatggtgaaacctcacctctactgaaaatacaaaaattagccgggtgtggtggctggcgcctgtagtcccagctactcaggaggctgaggcaggagaatggtgtgaacctgaggtggagcttgtagtgagccgagatcgcgccactgcactccagcctgggtgacagagcgagactccatctctaaaaaaattaaaaaagaaaaaaagaaataaaaacaatggcgttagttttgtgcagtgtttccactgtctgatgagaacaaaatacaaatgtataaatgcatgtacaagctataaaatacaattgtacatatgagttakcatttaaaactggcattgcacaaggccaagctaaatgacaaagttcatgccaatataatttacatttttattttttcttataatgacattaaatagtacatttaaaagcatcatgataggtctaaaaagacaccataaaagaaaaaaggtttatattttagttcggcacttctatattttaacagcacttttttcctgcatatttattttatatttggtcttgcatattatgttgccagccctggtaagacccaatctccaccctcaggggaaacagttatttgttgaaagtctatkgtgaaagaatctatttgtttatcatctgttttactcttcaaagcaaccctgtgaggtaggttggcattgtataattgtcacagacgaggagggacaagttagtcacctaagagcacatagctagtacagtcagggtcaaggttcaaatgcaggtctttccacccaagccacattctcactccaccatgttgtgtcatctaaattgatcaaatagaaacagagttttaagtttccatacagatgcctctaccaaaaaaaaaaaaaaaaaaaaaatcaaagacaaaaaccagccctctggtgtgctagctgtcacactgtactgttgttatttgctccctgaactagacaggattctttgatacaggagcttttctttttaatgttttttttttcttttttttgagacgtagtcttgctctgttgcccaggctggagtgcagtgccacaatgttggctcactgcaacctccacctcccgggttcaagcgattctcctgcctcagcctctcgagtagctggctgagtagctgggactacaggtttgcaccaccacgcctggctaatttttttttttttttttttttttttgtatttttagtagaaatgggtttttgtcatgttggccaggctggtctcaaactcctgacctcagacaattcgcctgcctcggcctcccacagtgctgggattacaggcatgagccattgtgcccggcctttttaactttttattatggaaaatttcaaacttatacaaagtcagtgaacccatctcccagcttccactgctataaatattccattattctattttttaagttaaaaaaaaagttttaattaaaaattttgattgtccttaaatatacataaaatttgccatcttaactatttttaagtgcacagtttagtggcattaagtatattcacattgttccatctccagaagtttttttgtctggcgaaaccgaaactcagtacccattaaaaaactcacccttccccctgccccagctactggcaagcaccattctttctgtctctgtgagtttgactaccctaggtacctcatacaagtggaaccatgcagcgttgatctatttgcgactggcttatttcacttcacgtaatgtcttcaagattcctttatgttacagcatgtatcagatctcttactttttagggctgaataatattcccttgtgtgtatatgccacactttgtttatccgctcctccacagatgaacccttgggttgcttccatcttttggctgatgtgagtagagctgctatgaacataatgttctgccattcttacattatctatattttcatccacttctcatccctcatttagttattactgtttgtaccaactctattttattcgtgtttgcattcccctaacacagagcctagaccatagtaagtgctttaaaaatgtttgggtgtgtggatggatcttccaaaagtatgtgttttcttaattttaatttgtattttattgtttttaagttatggggtacatgtgcaagatgtacaggtttattacacaggtaaacatgtgccatggtggtttgctatacctatcaacccatcacctaggtatgaagcccagcaggcatcagctctttttattattatttgtttttttatttttaatttttttttttttttttgagctggagtctcgctctgtctcccaggctggagtgcaatggtgtgatctgggctcactgcaacctctgcctcccgagttcaagtgattctcctgcctcagcctcccaagtatttgggattacaggcacctgccattatgcctggctaatttttgtatttttgtagagatggggtttcaccatgttggccaggctggtcttgaactcctgacatcagttgatccgcccacctcagcctcccaaagtgccaggattacaggcgtgaaccactactcctggccgacattaactcttttaaatgttaagcaaggtccataaagaggtctgagattctttccatttctcataagaatctcataaatgtgcacatagaattttgataaaaattaaatcagtaaaagaagaatgtaatactctatgggtcttcagaacaaggaaacttgctgaaaaatctgatgagagattttatttttatgccaataaaaatatcagcaatgctgtggatagagtcatttatttctggaagtatcaaaaacctttgaaatcaccaattttacctgttaacaaggattcaacttattaatgatagtgtttccgatggattccatatgtcaagaagataatccaggagtaaaacttgtctttttgtaacaaagttctcgacagggttaagcagctgtgttttactgtccttcaggtcatacttggaaaactctgctaatgtgatctaagcttgaacactcacggcctgaattccctgaattaacactgctatcagccagtagccccagcacctagaatgtcacctaagaagacaaagggcttaatcagcctcgtagaactaaatcagcacttcaggggagaataatgagacaccttgccttactcttctccatgcacaatggagtgggggccgccatttttacttgcaggacgcaggtggacgagctggtgggagtggcttggcacctcaccttgggcctgtggcagaaagagccttgacagcggtttgtttactcccaggagctgtttgtcactgaagggctggtgctttgtgggcaggagaacctaaagggttccaattttattttttttgttgtttttattttttgagatggagtttcactcttgttgcccaggctggagtgcaatggtgtgatcttggctgactgcaacctccgcctcccgggttcaagtgattctcctgcctcagcctcccaagtagctggggttacaggcgtgcgccaacacgcccagctaatttttgtatttttagtagagacagggtttcaccatgttgatcaagctggtctcgaactcctgaccacaggtgatccgcccacctcagcctcccaaattgctgagattacagacgtgagccaccgtgcctggccagggttccaattttaaagagaactctcctgtccagggaggtctgagggcaagcatttaggactgaggccgcagggagaagccaggcctgcagtagaccacatgcatgctgcacacctgggtttgggaagccaccagctgttaaccctgactctgcaatgtctgaatcctgtcacctgggcagatgtctttacctcagttattcctctgtaaaatttgagtgtaatttcgacttcatgaaagtttccagaatgttaaaaagagttgtgaagtgcgtagcactgtgcctcacagagagttaaactatgattattgcctttgtcttacaaggtgagttgctccagggaaaagagccctctgtgcctggtgccattcagacctttatgcatggttctgggtgacaacgtcactgccttgcagcaggattaagatagaagagttgggccctgaacagacaggatttgctcacctaagtcctattcacccttccaggcgcagccgaagtgtccacttatcatgttttctgacctgccgccctggagaatttgccgtttcctctttggactcctgtggacactttaccccccaccccaccccaccctggtaacactacaccatgtgatagactttcttcccatgtctaattcacacatctgatgctgttctttaagctcttttcagaaaaagccccttgtcacatttcccctgactctttcccttccatgcccatgtcctgttgcatttttagggcgcagacatcttgtccgggggatatcacctcccgtgagcacacaacaggcccaaaatgtttatgtctccccaaaggcgagattctttctgctctcctgcagctaaattctgcctcagactacctcatctacgaatctggttgcaaactctcttgaatgtatcgggccctcagcagacttcttcctggcaaccctgagccaaagctccaggagtgactgccagccacttcagtgagcatttccttggagcagctcaactccctgtgcatgggtgccacttgcctggcatcgagctctgagacctctttaccatcaggccaaacagtgtcagagacacactgagaccacacaaggctcctgtggctggaagcagggttcarctcatttcgtggttctttaaccagcatccctgagcttctgattaggggctgggctcttcctggggcgtacagagatgagttcagcctctggccccttgagctcctggtgagaggggataccagygaagactatcccagcacccaggagtgcacacggcactgggatgagtgactgccactcagaggcctgcatgtgtcaggaggacagtccaggcagaaggaatagaactggcaaaagcaatgaagaaggtgaggaaggaaggatgtggtgtgtgatcatgggatgcgtttggagcatgaggtatgtggaagagcagaggcaaagtgacacagaaggactctaggaaaggaagccagggtcagctttgggagggtgcgttwgctggttaaggagctctccctttcctcacccctattgggcccttgtgtgtgccacatatgttgccaggtgcacaatgttgaacaaaacagacaccattccggcctgcgtgaagcatatagtctagtgggaaaaagagacattagtcaaataatcgcacaaaggtaacatctatgcagagttcctgagtaggatagtgatgtggtctaatttgcattttagaaagcactctagccagaagagctggagtagaagagggacgaaacaggagaggagtgtggagttaaacctccaccgtggtttaagcctgtccaggcctacgccaaggtaggcgtagatggagagccgggggtgagcgtgagacaattcacaggtaaaataggaaggagttagaaagtctgataggtccactgtgggtaactgtggataatgacagttaagaaaaaaatagatttggggcgcagtcttgatgggatagtaattggaagtttcaggctattttgagtttgagacgccagcaggccatcaggtggaggttgagatggatgggtatagagcttcggaaaggtgtctgagctgccaggatttgtcaggagtcatcagtggatgagtgatgctgtgtgcatggatgagatcacctggagagagaattaattgccctgctctggtcccaagagtgagaacaaaacttccaagccacaggaatggaattctagctgagcttgtgttagttatcactagctggtttctcagctgttgagcaaggaagatgtaaacccatgccaaagtaataaatggcacataaagctatttttcccaaggaactagtgtggggtttttttctcgtacacaaaataaagtttgcattgttttccttcttgctccagcagccaggaagctcagagctaattttgtaacttaacttagatgccacataggacmtacatacccagctacttttttcccaaacaaatactttttatatatctatgtatttggcagccctgatgtttttctttgttgttttagatgctcatataagctgcctcagatcctttgtaaaattaggtagggtgtaactgtataaaaataaatattctccttaccctaatatttttgggtcatcctcacagcccttgtgcaataagtctgcccagcttctgagttaatattggctagatttaagcaggaagaactcttagaacttacggaagctcgacagtaaatttaacactcatgcaactcattaaaatagkataaaagtggagcttcaaacatctctgtgtttgctaccagggctggggggtggggtgttacccttaattcagctcaagatctgaaagtctgatctttcagaattgagaatacaccgctgaaattaaagacttgtctgtgtagataagcactccaaacatgttcaaagaaaaagtgaggtgttagctctatacggataggatttttttttttttaactcagggtatcgtcttcttgactcataaaacatggtttggtaaaagcaaacttgcttatcaaacarcataagcataaaatcgattggatagtatattttatttttgatcatccccgttctttaattattttaaaatttcagtttgctattgtttaaggtcactgtgtaaatggttttcaaagtatgtcccacagccagtggcctagggactgcaaagatgcctgggatgttgggggatgaggaggtggccaagcctggagaacccagccagcacccctgctctacccccaggtcctccagagcagctgatctctgcattatggaactcaggtaacagggttccttctgtataaaatcttatttttttctgagatggagtctcactctgttgcccaggctggagtgcaatggcaccatctcagttcactgcaacctctgcctcccaggttcaagcaattctctcctcagcctcccaagtagctgggcttacaggcacctgccaacacacttggctcagctcatttttgggtttttgtttttttgttttgtttttttgtttgtttgtttgtttgttttgagacggagttttgctcttattgcctaggctggagtgcagtggcatgatcttggctcaccgcaacctctgcctccaggttcaagcgattctcctgcctcagctttcctaagtaactgggattacagacatgcaccaccacacccggctaattttgtattttcagtagagacggggtttctgcaggttggtcagcctggtcttatactcccaacctcaggtgatccacctgccttggcctcccaaaatgctgggattacaggcatgagccaccgcgcctggcctagcagggctgcttctgcataaaatcctatctgaataaagggttccgctgctaaaagtgaaaaaagtgaaaagtttagaaatcttcacattggagggcatgtctccctaaatagcccttggggtacggaaggggatgtggggtgtagaatctgactgttggttcctgctctgccttctaccctctctgtgactttgcgggatgactcttcctctctgaaacagcttcctcatccataaaagaaaatgaatttcttgataatagctacttcactattagctagttagaaatagttagatatttctattattagataatagatagttagaaatagttagctatttctaactatcagagggttagaaaagttagcagatgggggccaggcacggtggctcacacctgtaatcccagcactttggaaggccaagatgggtggatcacttgagttcaggagttcgagaccagcctgaccaacatggtgaaacctcatctctactaaaactacaaaaattagccacttgtggtggggggcagctgtaatcccagctacccgggaggctgaggcaggagaatcgcttgaactcgggaggcagaggttgcactgagccaagatggcaccactgtactccagcctgggtgacagagtgagactccatctcaaaaaaaaaaaaaaggaaaagaaaaaaaatagcagatggagaaactctgcaaataggaatttcaaaactgatggctcttgctccgtgccactgacccacctctcccctctgcacttcccaggaggagccgatcactttctgtgaggaagccttcgtgtcccactaccgctccggagccatgagrcagttcctgcagaacgccacacagctgcagctcttcaagcaggtgcctccmtccctggtctggcctgggtctggctccctggcggggatttctgcagctgtctccactctaagtactgaggccgcaggcatggatgggactcaggccccaggcaaaagaggctcaggggagggggattggatgaagagagcagtcactgaccagacagaccctttgcaaatctgccgtgtggttttccaagttatcataaatatgcagccggtattttagaaagaaacttgcctgttgaaccttactttttgaaaactcctaccttggatacagtaaggtgcccagctgaatggtttttcccccttttctttgtacgagctgttgtgcttttgttccttctttctatagtttattgayggtcgattagatcttctcaattccggcgaaggtttcagtgatgtttttgaagaggaaatcaacatgggcgagtacgctggtgagaagcaactcattttccttccggggctgcaggctgctatcatttagggcatatttgacaaggagtggcagtgacttgcttttcctttattggggcttaggaagagactgctttcaagcttggccttgaaatgtttgaagaattcctctttgttttctgacaaaatgcacactggcccatatgaagtcgcccagcctaggatcagttgcttcccctgtgtagacaaagtctagttaaagtagtagccagcgtggtccactgggaagcacatgcagtattcagttaggaggcctggattcaagttaggactctgcctcctcacaagctgcaagaccctggttgagtcatttccccttctgtagctaaagttcctatccatgtcctgagagtacgtaccgtgtcccacctcacaggattcctgttgagattaaatcagagtacatgaggaaaggtttgtgcagtcatccaggacagttcctggcatggggactgtgtgcagtaagttttttttgttgttattgttgttgtttttgagacagagtcttgttctgttgtccaggctggggtgcagtggcacgatctcggctcactgctgcaacctctgcctctcaggttcaagtgattctcccacctcagactcctgagtagctgggattacaggcacgtgtcaccacgcccagctaatttttgtattttagtagagacagggtttcgccatgttggtcaggctggtctcaaactcctgacctcaggtgatccacctgcctcagcctctcaaagtgctgggattacaggtgtgtgagccaccatacccagccctgtttctttaaaatatgacaaattattgttgagtgcctggtccctgcagatctgaagaactgaaggtcttgtcttctcatttttcagaggaggcatctaaggcccagagaggtgttggtggctgagtctacctcctgaatcccagtctgaccttctttccaaatcccatcgcctcagtctttggcagcgaaggcaaaaccagatgcaaaataatacccatgctgctggcccccttttattgctgggtgtgtgcccatgctgctggcccccttttattgctgggtgtgtgtctattctggactactgtgataatccaattggcagtttgtaagctcacagagcaaggcacagtatacacctataaacattgcaggccctcccagcctgtgctgcatggagagcacagttaagaaaatcaccatgaagtctacaaacagcaatagccagtcactgataagcatttcctgaacacctgctaggtccagagccccatagagtaaaaagcggaggacccagttctgccctcaaggagtgttaggtaggagagagaaatgcatgactaaagacaatcagaaattaaaccaattcaggaaaaggagtagaaacgcatttcgstgcggttagactagggctgtgttaatcctcgctgtgtaatgtgagggcttgacaaaggaggctgggctggagttgtgttctaacggttgcatgtgagttccaggaagaaaggctttaggtgttgttaaactgagytcacttattcagtaggttaagacccaccatttaaaatgaacagagtttaccaacagcacatccattttctttctgtctcactctccgagggttcaatgtgtgtccagcagggtcctttcaatgggacacacagccctgggggttcctgttctggtgcccctcacagtacttcccagagtacggatgtctcagtggctgttacctattcccgagggctgttcagaggaaggagaagcctccagaggacatcacatctgagctgtcaagtttactaagcagagagagtagggcgtggtgactaggcaagggagcggcatttgcaagggcctgcaggcctgcgaggatgctggtttatggaccccgtggtcccttaagtagttccccgtggtgggacataaggtggtgcagcatcacagcagcacaggatggagaggccgtgaggcgcgactggaggagagtggcacggctgcctcggagcctgacctccagccagcaggcagtgaggtggctgctgagtttgcagtcagggtactgcatgatcagctctgtttgagaaggaaaccctctggcagtgactcgctgccgcctcctttaagaacaggacatgggaccctccaccgggttctccaagtcctgaatgctgaaagcaatttcggccaagcgtggtggctcacgactgtaatcccagcactttgggaggccaaggcgggtggatcacttgaggtcaggagttcgagaccagcctggccaacatggtgaaaccccgtctctagtaaaaatacaaaaattagccaggtgtggtggcgggcacctgtaatccgggagactgaggcaggagaattgcttgaacccaggagctgagatcgcaccactgcactccagtctgggagacagcgtgagactccatctcaaaaaaaaaaaaaaaagcaattttaaggactcccaaggacaaatcacctctttaagtgacagcttctctgaattctctttccccaggcagtgacaaactgtaccatcagtggctctccactgtccgggtaagcatgcacccaattcagagccccctggactccctccttagcttcctggcagccttccgcttccctgtgcttccccttccatcctggagcactccattctctctgctggagatgcctttgtttgtaaagccaggctcttctcatgccasatggagactagaagggtgggattgtccaaagccatcacttggtgggggctgaaaaaggcatgagaggcttcctcctctgcaggaaaccagccaaggagagctgaatggaatgttgctgtcttagagcattcggggggttctccttctagggccagagcaattgtcatgatcatgggcaaaccaaaaattgctgctgtgtaacctctttcacagcaaagctcctgggaagatggggaacacatcactgggaggttgactgttgttgtgaggtgtcttgatgtgtcaggagccaggggcatagggcttccaacgtctctaaagaattcgaaatcttgcctttcccttccatcagtttataattgaggtgtcctgaaggcctactgtgtgccaggcaccctgctgggtactggggatgcagcagggagcagggtacaggccctgccctgggggagctccctgtcttgctggggaggcgggcacgaagcaggcaactccagcatcaagtgataagtgttccctcctgctaatgcgtcagtgcactgctgccaggcgagtcccttggaagtggctgcagttggcggagagtaagcaattccttcatgaaagacttcctttgttcctcttgtatggccaaacacagcacttggcaaatcagagaggagtaataaggacttgttgattgattgataaagggagtttcaatactccaaaggaccatttaaatgggatactgagtaattttggaaagcagtatggaataaatgagtgggtgaaaatttcccattgtcctacaacatagaatgctttctaggtcaaattgtaatgtttttaattaaagctcaaaatttctaatgtgggcagttaccaaaaattgtgctaaaagttaagaccgataattacattactgtatcttattctcttaggtacccactggttccagcctctctccatccgaatcagtttttttaaaccaccacagacctgattctgtgatgaatttgattaaaaacgctctgtagtgtagaccccttagcctggcattccgggcccttcacgagctggccccatctggcctcccagcctcagttaatgcttctctgatgatacactcatgggagtgtgtcatggcgcagtacagcagccacttgttacagcatacgccatggcttttcagcttctgcactttcttttttgtgctatttcctgtccctagaatgttctcctcccgtctcctacatcaactcctatttatccttcatggaccaggtccagtgtttcatcctccaaggccttccctgatcttccaagtctccacgctccctgtgcacacagccattacagccgtcatcacacgctgttgtaattatttactgtgctgtcctgcctctccarctggaggttttggaaggcagagatcaggcctcccttggcctggtgtcttcagaaccctcacgacgtgtctgcagggatgagactgagaaatggattcacggacagctatgaaaacgtgccctgtgcacttcaggtccctccactgcctcttttaggagcgggaaggccttccctcctccttcctcccacttttgctcctaaagaaagtgagcgagaaattgctgtgttggatttaactaaagccatggtgaacatttgtggctattcattctttccttttttcaagatttagatgttaaggaaggcagcctaccagagagatttaaaaaaacaccacagaaaaccaaggaaagaaaaggaagttgcacggtgagggcaatgtatttcccaacgatcctggctgatcagggccccactttctgccccggcttggtgtcagctatggagtccacggttattaaacttacctgagtgtcatccgtggtaactagaatatcttgaaaagccacagatgcccatagggaagcccttgccttaggcagcctgtgatgcagttccctccagccagggaacaggtgccaagcagagcactgagtctagagtctccttccatcaattcacactcctcatccccagtccrtacacacccacccasagctcccaccgagagtccttctgtcatgaccataactgactggcagggaccagttatcatccaggcctatttctcgatgtgcatttacatacctttgaaatgttgcttaactcgattgaagagaagcagtctttgttggtgttggatgactctgtcttcagcccaaattgctaattgacatttttattatagaaaggaagtggagcaattctgaatactgtaaagaccaaagcaaatccggccatgaagactgtctacaagttcgtaagtactggtcttgctgtcaggagccaaaacagatcagtcccttagcatgatgagactctttatttatttacttacttttgaaactgggtcttgctctgttgcccaggctggagtgcagtggtgcaatcacagctcactgaggccttgacctccagggctcaagcaatcctcccacctcagcctccccagtagctaggactacaggtgtgcaccaccacgcstggcttttttttttttttttggagagacaggtctcagtatgttacccaggctggtcttgaactcctgggctcaagcaatcctcctgcctcggcctcccaaagtgctgggattaccagcatgagctgctgcacccagccaagcgatgagactcttaagtataccttgtcctctattgcagagatgactcaggctgctgagctctttcctgaaggtctcaatgttcttcaaattatttagcagattattataactggttcagtgacatttttaatttatagtgttggtgctcacatttgccacagtagagaaatgggaggctactggttttagcttttaaaatgtagactaggtggctgcaccctgcctctgtttctgagacccggaagcatggtctatctggtgtctggcaaagccttcctgcaggaatccccattattgggtcaaaataaagcagctcctttgcagtttcctgaagcgtgttcgtggtggcatacaccacttaatttttgtcccaaattcttcatcatctctctgatcactgccctataggaaatgcattatttgtaagactcgtgtccacagcggagtgaaaataggagagcacatctgttcccggtgcttcatctttcacaagcatcaagtattttttcttgtgacttctcttgcttgctaatttgaccgtgagccactgaagcggggtggttttattttatttccatttttaattttgttagtcctctctgtgcttaagctgtagttattttagcaggatgggtggctgccagcagaaccacacaggtctaaaatgacctgaaatcaaagccagggtgtctgccaaaatgagatttaggaaatggcactgtagaaacccagcaatgtgtctgttccggccattcagcctgggcagaaaattggtcctggggccctgccctggtgaaatagaatggatattctgaatcttccagccagaaatacggctgccgtactcttactggtagctgtcaccaggctgctgagataaataattatagagagcagaagaagggctttggaacggaaagaaaaaaaaaatctgtgccatcaaaatgcagaaaataaaatctctgcagcctctttaagggtttttttttaaccttttaccgttgtatttgttttcatagccattatgttttygacttgatgwtcccatttttccttcctttttctagtaatcagagaaggtgattctcgatggactgaaatcaagcatagtccctgctggaaacagaaagggaatcttaacttaaattaatttttcatgcaggcaaaagatcatgcaaaaatgggaataaaagaggtgaaaaaccgcttgaagcaaaaggtacttgaagttcttattcaaaatgtataagcaccatgtatgaaatgcatggccacaaaaaagtatgaggggatcaatagagggctgtttgatacagtgttgttaacacacttcaaaatgcattaccagctgtccgggagttttcacactgttataaatattcacagacaaaaaactgtcttcaaataacattaagactctggcttaaacccacaaaggcaagcaagttcagagttgccactgtcgggctgtcccttgcccaccccaccaggcctgagttcacaggcgtctgtagaaattggcttggtgttcccatctggcacctgcccacccgctatggctgacctctgccccagggccggttgtaaccaaaaccaaggagcatctctagggaatgattgccatggtccagcatgcacgtggccaccgcccagacacagcatagggggtggggctgagcagaatgccgtgggcttacctcgccctgggggaccaagtgagcagaacccagtgggcgctgttgagactctgagtggggaggggagggctctgattgtcttcaccagccgtcagtaaaagtgggatatcatcccagctatgtcctggctaagattcccccagcctgaatctcccttttttttttttttttctttttttatctgacttcttttgtattttattttattttaatttttttattgccatagcctttgggggaaacaggtggtatttggatacatgagtaagttctttagctgtgatttgtgagattttggtgcacccatcacctgagcagcgtacactgaacccaatttgtagtcttttatccctcacccccttcccagcctttccccgagtccgcaaagtctattgtctcattcttatgcctttgcatcctcatagcttggttcccacttgtgagtgataacatacaatgtttggttttccattcctgagttatttcacttagaataagagtctccaatcccatccaggctgctgcaagtgccattgattcattcctttttatgcccccagattgaatttctggacttagacagtgaggttactgtaagagggagggcttttttatattattatgaatgccatcatcataattacatcataattattgttgccaccttttttttttttttttgagacggagtctcactgtgttgccatgctggagtgcaatggcgcgatctcggctcactgcaacctccacctcccgggttcaagtgattctcctgcctcagcctcccaagtagctgggactacaggcatgtgctaccacatctggctaatttttgtatttttattagagacggggtttcgccatgttggccaggatggtctcgatctcctgacctcgtgatccgcctgccttggcctcccaaaatgctgggattacaggtgtgagccaccgcgtctggcctgttgccacccttctttaagctcctcttaagggtggtccagactaggagctttcacacttaatcctcagaacagccctgtggagtattgttcccatttcatgagtaaacagaccacagttcagaggtgaagtcatttgcccagggccaccttgagcctagcagagccagaattggatcccagctccatcgacttctggtggctgtgtgttcttaccactactgcattgcacactgccttcctcaaacaagtgttttgttttccaaaagatgtttgggatcacctacttcattatccctatgcccccaaacgtaccactctaataaggccctttgtctagctctgcagtttttaaaaaattgaaagcagttttaattttctgaagtcagaaaggacctctaattaacttgaaagggtcgaaggaattgattcctttcttttaattggaaaataatttgctctgactaagcatttaaattcttagtttcagctgagagtggatttttaacagctgagattcacatcctgaaataaaagctctgtaatgtaaatccagatagaccttaaactgtagtctgtttgcaccctgccagagactggcaggtggcattctttacttggatgttatttaagtccctaaatatacctttttatctcccatcccagttgcatgtagctgaaatggattgcagatataaaatggagtggcagggagcggagagttttccctccttgatgcctggatcgtaggctcgttggtatcagaatatcccctgaagtaagcaaagaaaggggtccctcctcaggcaaaggccccatgcgccctcattggtcagatccactctctgcagaccgttaagctacagacatcaccttacctccctacttgtatgtgcaagcctctggccttaggaaaatccccttcttatgataagtaacatttctgcaaataaccagttaagctcagattttttaatgtggttgttcaaagatttgtttaaacaatctagatcactttccttccactctctctccctttctgttccttgatagtatctaaagcagatgtctccctccccttcccttccccctgccagtcttttcaagaatagcttcaggagataatgttctatagagagcgtcagtacatttcaggtgacacaaatggtgaaggcattttatagaaatgtggcttgtcaccatcggactgttgacagatctattagtgcacccttttcaattttcacttttccccccttcggtcgtacagatttccacagacttgatattttgcagttgttcttggaagagagctattttgtaattgaaactctagcattgttcgcatctacgggacttggggctccagcactctccagcgccctttcttgagctaatttaggatttggctgcacctgacctctcacatagcagtagaaaatatttccttgktttttttttttttgtccttctcccctttccctcctcccctttatctggcaacgaatgtacctcgtgactccccagawgcctctaatatagacatctcaagtttggtttctgccatgaaatcgaggcagtttccaacaaagatccaattttcaaatgtgctgggttgccacctggcctcctctaactctgcatagcaatggtgaccttgcagatataatcaagaacccaagcttgccctcttcaccctcgccttgggtttgaattgcaaatagaaaatgtggggccgacctgtggagaggtcaccatgatgtatggagggtccatctctaatatgactgagctgggccccttctccaacccttgttcatttgtgctgcagattttcaaagcatttgaaatcggagctttcaggatatctgtgtgaccattggcaaataattgttaatagatccgatggtgtgactttattccatacctgctctgcttcaacccaacaacaaaaaaagaaggatggataacatatttctctagataaatggagcaaggtggtcaggttcttctgtagcttggcctcctttgaagtctgacttgctcaaaattgggaaaaagaagaaatggcaaagatgctacccagccattgctttctaaggaagagtgtagtgctttcatctggagtgtctccctgccagaagaatgcctcctggatgggctcatgactgtcaacaaattgcatcccactgcagcaccatgcagggctggcatgagaatgccctgctttaaaagcagtggccacaaatccatttctcctcacctgcaggcaacgttaagataggcacgtagggatgtcctcttttgcctattgaggaacccctgaaatttttctcttttttcttcggtatcaaaatgatttagccaaatgggcccatttcacagccctttgtaaagtttctgaatctttgatcttcttcttttcttttttttattttgtttttctttgttttgaaacagggtctcactctgtctcccagtgcagtggcacaatcactgcagccttgacttcccaggctcaagggatcctcccgcctcaacctccagagtagctaggacaacaggcatgcaccaccatgcctggctaattttttttagggacagagttttgctgtgttgcccatactggtctcaaactcctgggctcaagtgatcctccctcctaggcctctcaaagtgctgggattacaaatctttgatctttaaaagacaaatcgagcttgttgatttagagtctctgtgattgaaaggagcaaattcacagttggtttcacagaggcttgaatttctggccaaactgttcccattgaagggagtgagtaagcatgcgtggggccgggagagctaggtagacttgtagaacagacattttcacaccttatcacacaactgtcagctccctgtctcccgacacattaaaatacgctgcagcctcaatcacagaaattccaactttggttactattttgatatcaatattcatattttaatttgcatttgctgtgctgtgaggtggcctgggaaaagaagggtgcggcacgagtctgtaaatggagacgggagttctcacacccgcagcatgagtcagacgggaaggcctctgcccataggggcctttcaactcccccacatggtgatgtggtgtttgggcttctgaggcaggcaagtgggactcagtgctggttgtgtaggatattaactatgtgaccttggataagttacgagacctcactgaacctagtttttctcatctgtaaactaggggaaatacaggtttttgctggatcgttggaaggagtagaagagataatgtgttgagacagcaacacttagtaggcactgaataattgagagtttcccttttgtctgtcttttgtttgtttgtttttgagatggcgtctcactctgttgcccaggctggagtgcagtggtgtgatctcagctcaccgcaaactccacctcccaggttcaagtgattctcctgcttcagccacccaagtagctgggattacaggcacccatcacacctggctaatttttgtatttttgtagagacggggttttgccatgttggccaggctggtctcgaactcctgaccttaggtgatctgcccgcctcggcctcccaacatgctgggattacaggcatgagccactgcatgtggccctctctgtcttcttatgtcccacatctggaacagccagtctgcccacatacccatgtgcacacacctggagaccatgtccagcgtgaatgaatcacctcccttgaggttgtccatacaaccaccaggggaatctttgtaggacccagcactgaccaagtcactcccttggttaaaacatttcagacctttcaaaccttccacctccttgcctgggggcagcccaggggtggaatgccctggccgctgggccgcagcaggccctgctgtctgcctccctgggcctggggctctactctttcatcactggctcataagtcctttcctcagctcccaccccaacccctacccaaggccacccagaaccctctttgtcctctagtctcccgagaccctgggtccttacctccccgatttctcatggagactcatgtccagagacttaccgtatgccgtgcctgccttcttctcagagggctggaggttagagcatagtcatggcttctgattccagtaaacactcaaggaaaataataggaatacaatgactttctgactgccttgctttaccgagggacgggaactggcaggacccccgtaactctctgagctgagcctcggggctccaggaagagatttgccaccctgtggtggcccctgatatgtagctctgtctggcgtcttcctcctgtgtgacccttcgggaagaagcaggtttaaccctcctgctagcttcttgtttctgctttttaaaaatgacatttagaaggtcaggttttttcctgtttcaaacaaaattcatgtttattgaggaaaactcagcaaatcagaggaacaaaaaataatctcattttataacctgcattttcatgtactatatcctgggcatttcccagaccactaaatacttcttccccatgtctttattttattttgttttgttttattttttgagatggagtcttactctgttgcctggcgcagtctcggctcactgcaacctctgcctccctggttcatgcaattttcttgcctcagcctcccaaatagctgggattacaggcgtccgccaccatgcctggctaatttttgtatttttggtagagacggggtttcaccacgttggccaggctggtctcaaactcctgacctcaagcgatctgcccaccttggcctcccaaagtgctaggattactgcaccaggcccacatgtcattattttaaatgactacatcagattttatctgatggacatatatacattatttaatattcccattgttggacccttacatgagttccaattttttctagacaaatatccacataggtaagacttagaagaaattcatattatttcattaggataaatttctaaaaatgggagcagtgggccaaagggcatatacatcttttaggtttttcatataaattgccaatttatattcccatgagaagggtatgagagtacctgttttctcaagccctttgctgacagctacgttagtgcttaggccacagtttctttaatcatgggtatcaaaagttgctgttattagctccctactacgtataagatctctaccaggagatagaacagagaatttgaatgccccccaccttwtttttttcttgagacagggtctcactctgttgcccaggctggagtgcagtggcctgatcacggctcactacagcctcaacctccccaagctctggtgatcctcccatttcagcctcccaagcagctgggaattcaggcatacactgccgcatccagctaatttttatatttttttgtagatatggggtttccccatgttgctcaagctggtctcaaactcctgggctcaagtgatccttccacctcgaccccctaaagtgctgggattaccggcgtgagcctccacacccagcctcttatttcttccttgacgtgggctcctcctcttgtgctgcctgtggcatcctgagaggaagctgttgtccttcttcaggtggagggaatagtaaagaggctaataaattggtggcctgcaccacaggactttataagaaaccttttgcatctttggatcttctaataaatgaaggtgcagcactgctttttgacacgcaggtacatctgtgtattggacacatttcccttccaaatgtttaactccactttacaaaggtttatttgacagcatgtgctagattcaaggctctaggttagagaacccagaccccaacgaacttacagttgatagagatacaaaaataagatagtgctaagcatggcagcctatgatcagtgtagccaggagcttccgaggagaagattacatctgagcactttttgagcagctccttaattcagaataccttcacttgtgctgtcgttatgggatgatatggcataaaagcaccaggactcccatagctctgggttattccaccttctaactatgtggctttgggtaagttaccccttctgagccctatttcctcacctataaaagcaggataatcccatttaccttgtgatcattgtgggaactaagtgtgagaatgaaggtcaagggtctggaaaagcacaggggtaggccgtccacacagggaaactcttctttttagcaggtgctctctccgttttgcaaattgaggttcaatttgcacagtgctgtgacatttttcaaagcttcctcctatctcatttcacccattctcccagtagctttgatgtttgccaagcaggtggtagtctcccattgcaaaaataaggcaataggtgcagagaggttgagtgatttggaaagattagacaactagttaatgggaaaaacaaaactagacgatagtatttttacttataagcgtgaactaagatgctttttccaaaactactacatgaattgttctttttttctaaataactattaccttagagttttctattaatacccagattttcttaccatattaccttgcagcttcatttttttttcagccaaacacaaacaggcacacacacccacgcacaaaattttacctgaaccaaaagtgaatttgttcatgtttgaccttattcattctctcatatctatcttgtaggatcttcacctggatccaaaatgccccttttgcccattgttgttttctagcacagatggaacccctccccatctttttccacttgacctgagcacctttggacagcccctttccaaaagagctgtttctgtttggccatcgacagcctctttcatcactgagcctcagcctggctgagactggttgatcaaacgtgggccacctgatccaagccctcccagtaaagccaggaggtcatcatctccctttgttgtttaccaagcagtacagacttctcaggtctggcctctacaggcagccttgattccttaggaaaggaggccagctggtaggcagctggatgtgtgaggtcaaatattggtagtaatggtagtaattggtagtaatatggtaattcctataatttactgaatagctaataatattcttgacactcagttgtattatctgtctcctttaatcttcatgctaccatatgcccatttcacagatgaggaaactgagtcttagagatgtatatatgtttcttccttaatgcataatttttcaataaggaattactttcctccatgtcccaccattctctcttagctgagaagttaggagcaaccaagtatcaagtttctcatgtgcagaatttaatgagtactaaggggatatrttttgttgatcaaagtgtatatttgttttgcaatgaaaataattggaacttgtgttcattatataattctggctgagttatttttatttggtaagaaacatgattatttaaatatttatttgtacatgtattctctgccttgttccaatgaaggtttaagcaacttccttgacttgaataaaacacgggacccttattgcatgagtggccccatccatgttccaaatgacccacgtgtatagtcagctgccagcttcagcyaccggagccatggcctgccttttgcacattgtggtttttcttttcctgataatttgacttcagtcatcagaagcacaaattaaatgtaaatttctggatttaaaaagatttctttggtccctaaatgtttcccaagtcatagagtcctgagtcagacttcaatctttttattttctgccagaaagatgaggkgtaagaaggggtaggaacaaacacatcttattcacaaacaacaacatcatcagtaaacaaatgtggaaaaactgtccatactcataattaaagtaatgcaaattaaagcaacaagtcaaatttttcacctattaaattagcgatacatttttaaaatgatacagctcacaagtatcgtgaaactggtaatgcatccattgttggtagttggtgtaaattggaaagcaattggataggatgaataaaaacccttgaaaatgtttatatctgttgtcctagtaatttcattcctggggatttccataaaaagagataatatgaaagaaagaaaaactgcagtatatatcactggcattttgaatgtttaaaaaaaaattagaatcctaaatgcccaatagtagtagaatattgaatcgtggtatattaaattattgtatatccgctcaatgaaatatgcattcagtaaaattatttttgtaatgactttgtaacaacatgaaaatgcttataatatagtggggaaaagcaggatataaaattatgcatgagctgtgattgcaagtaatttttaaacgtctgcatgtggacaaagtaaatacataaaaatgaaaatggctgtgtaagagagtaggatgaacaataataattgttttccccactgttgtgaattatgatgttatctttataacttcacatggatggtttgggtttctctagttcttaaaagtcaaagagccaagttagccctccattccctccatcttcatcaagaggtcaggctcagaatgtcacggagagagtcgcctggcaggcctcttcgttgtggggtgagagggaacatgggtgccagaaccccagtgccaaccgctgactatccttctccctacaggacattgccgagaatggctgcgcccccaccccagaagagcagctgccaaagactgcaccgtccccactggtggaggccaaggaccccaagctccgagaagaccggcggccaatcacagtccactttggacaggtgtgtaccctggccctcctacctgtctgttttgttttttttttatttttgtttttagcagcagtagcacatgcagcagacggttttkcatttcagttctctttggcagtgcagctccatggaggttttcacatctttaaatgtttatttggtgcaaacatgttttgcaggcaaattttcaaaaattttgaggagacagcacggctgaggtcataaatgagcgggactgttgaatgaagtcattaaatgcactgctgcctcccgtactccaaggcactctgcttaaggtgcctctgttagctaagcatctcattagaacactttagcatcccgggcccttctttgcaccttcaaataaaaggcaacaagcgaagtcttaaaaaaaaaatcaattaggagttctttattaatgtacttcctgaaaatcaatatcaggagtcgtgcttctgagagtaaacacccgtgctacaattctagagattcaattttttaagcaactgttttcaactacctgagcattagaaaaattgtctatttaattttttttcccttaagtaaaacattccactctgtatagaaactaaaattttgtatccccttcctacttgtaattatatttttggttaaaaaagattatgtaccctttcctacctgtcctgaattgacttttggttagcgaaagtcatcatttggagagatttatgagaaatggctcttttagcaagatatggctgtaacaagaatttgcaaggttatttatttttaaatcacctgattctgtagccatttattagatgatgcatgattaagagtcttcatgatttttatcttaaatgtgattgctatttcaccacatgtaaaggacctagaagcctacattcctgttttaaacagacctttatcaggtgcctactatgcaccaggcattgagctattcagaaatgaacgaaactcacaaaattcttgctccaggttactactgtaaggggtgagttggttggaacataaaagtcactcttctctaatcaatattttcagataatatatgtttatacatctttaacttggggaggttcatccccttttctgattttatacttaaaaggatgttataaaaattgaaacgcaagaaagaagaatccacagggtgatactcatttagttaataagtattttcaaattgcactggtgtctgctcccctgaagagctgcctccccccagctccaggctcaggccctgttggagcaatctgcaccccagttccctggctgtgtttgctgaaagcacagcccctggttgtcgccagcgtggcattccagagtcagcttcctgctttcctttgtcctcattcctgcacacactaaccttcccatgaaaggagcccctcactggagtttggagcccattacagagaaagagggggcgggggagagggatttcatggtgttaaacattccattttcgaaacacaaaaaaaggaggccctatttgaaatggagaaagaccttctttccatttcagccagaagtagagattctttaatgtcattcccagctaaatgcagaataagagtatgtgtgtgtgcacgggtgggggataaacaattaaaaaagccaccccaaactctgttgaaataagagctgtctgtgccttcacaggtctgcaaactggagaggatgaaagtggctttttttccctgtttgtcacttccctcacgtggctgccagcattatgcaagtgtacaggaaggcaggatttttttttttaatgcatgcatgcggattaaggtcaagcccctagtatcagccatgcagcgggctctcccttccagctgcagccgcagagcctacccacagccgcgagatgccttaattgagacgtgctgtcaaagtgacaaacacatttgcatacagtctacactctatttattttctctggaaaggtctacagtctgctgttggttgaacattcttaatcagtttgctgtaagtgaactgccagctagctcacttatgccggccccttcttcattaggtgacagattagctgcagagggaggggggcttgagccagggaaaccacagacccctttcttttaactctttccagctttgcccttatggtaggttgtccttgagtcttttcccgggtccctggtttgatgggctsttgaccgtaagaagtacggtttctagagcacctactaccggcaggcatgagttttaaggacttgatattcttcccaaagaacagtctcttgagtttcatttcagaagtttttaccacactctcttaccatctatactattttctttacttgatagttttctttaaataagactcagacctgacatctatagcatcttagcctcatcttcagagatgccattggtaaaattataggcttgatatactagtcccagttttttctaacatataaaacaattttaagtgttcatctatgaatcacctaatgcactcacgtagccctaatggtatatattctctttttttggaaaccaacagactccttggtatcttttttgttgtctccaccacatccctttgaggaagggaccattagccccattttattgacccagagctggagctcagagacgtgagagaacctgcccagggccgcttcaccagcttggaaacccaagcccagacacctcctctcgagcccacaccagctctcaaaacaagcagggactgcagccatgtgatatgtctgttaaagctactgtaccctgccctggcaaaatcatcttaaccagccagagagagcacctattttaacctcaaaaaaatcctcgccttgggtctgtgtttctgtggatttcgttatttaagaagatttagcttgccagtggggatggagaccgttgagacggttgccttcatctcaccacctggcaaagccggtgcctgtgcagctagccagggcagctccatggagacctctgacggcagctctgcagcgggggctggcaagaggggagcttagtgtcgaggcaagagctgctactgccaggggagagaaggtgctgccttgccctctgcctcagtggagttcctctttccaagctgtgatcattcctccatttaagtatcatctattcatctgtctgttgagacctaccatgtgtaagataaataagttctcagtccctaccattgtggggcataatgatgagacagaccagcagatggacaggcccaatcagagggataaagacaatgagggaagtaggctccaagcactcccagggccccccagaggctccctcttcatctccaggcccacttcatagtcatagtcacttcatagtcagtcatagtccacctcatagtcccaagttggacactttaattaaaagatgcttttgtcagtagcctgaccaacatggtgaaaccctgtctctactaaaaatacaaaaattggccgggtgtcatggcaggcacctgtaatcccagctgctcggaagggtgaggcatgagaattgcttgaacccaggatgcagaggctgcagtgagctgagatcgcaccactgcactccagcctgagtgacagagcgagaccctgtctcaaaaaaaaaaaaaagatattttgtcaacaaactgaactcgctaataatttgttttctaaagcagacatatgttaggccactcagcttataagagcaaagtaaataggtttctagttagcctctgcctcctgatcacgtagtttctttaagaattcaaaagtgtcaacttgagaatgcctattcctgccttggaagatgtcgcagtttagagaggctttaaattactgttttccccttctcaagtttagtatcatttgggaaacaaagcccaggggacagtcaaatgagataaaagtgccagctgtgtttattgataagcctgaaaggagaatattgcattagacctgaaggcaaatgttgcaaacacttcacctgagaatgtgaagaccgcgtttctccactcgagataagtggacaatggcaggtctctccaggttggagctgcccatagactcctagcaaggaggagctgcgggagggcgttgccctggctgctccccaggagggagctggaaggggtgatggagctcagttccttctcccagactccccgggaaggcattcttcctcttcctctgggaggggttgaacaagagggtgcctggccaagccaaggattcccccctggttttctctcctagggtaggaaatggaagctcctccttcccacagctatagaaggagtgagtgagcggtgtcctccccggcagccctgggcaccccttggttagaatggctggccttgactggcttccctcccgaggacccctgtggaaactgctctgctccctacatttaataagatgggtgagccatagatgctttcacatccgtgagcactgacttgagactttgccatcagcgggtgaggaagaaatcattttacccatcgtacacgtgaggaggcacactggaacggcgttgctggaatgagtagctaattcctactccaaatccagcagcagcagcacctctgcttctcttggctgtgtgcagctctccctccttgccaggagaatggcctgattgtgtgagttcagtgacactggaccctagtcctaggtgcagatagccaaggctagagactgaggcttccctgagaatatcacagcaaaccccttccagggcccccttctttgtatttcctccaaatgactgatctgcaaacaaagtagttgcctgccttccaatctgatagattgcaaaaagcatgtattgaaaggtgctgcctctgttcttctcccatctgaacaaaggtttctaaacctctttaatgtaaagtttgaaaagctggttaaaccaaaaccaaaaccaagcaccaccgtggcttccagagaactgtggcagggaggtctggatagcagccccaggaacagctcttgggatgtggttgccggcttgtctctgcgtatggagaattctggcatcagggtcatcagccaggtcatttagtgccaatcccatgctaggctggagaagatgccgagctagcaaatgccttctcagcacccttggctctgagtgccctgagagagtcctcttgccccactgagcttggaagccacatgcaattcccttcacttcagccattgcctcctcaccacctccagcaggtgctcccatgttctcaggatactgcacaccccaggcctctggtctgaacatacactccccaccaaactcactcctccatcttccaccccagtgaatgacacaggctggccatccagagccaggctccgccctccttctccccagatcctctccttccacccctgaacactacttcatcctctcctctccatcacctttgccacagctgtggtgcaggcagcataatcattcacctggactgtttcacaggctcctaactggtactccctgtagtccccatgtggccttgccgggtccactgtaagccgggtccactgtaagcatgcacttactgtaagcatgcactagtggccgcctcacccccgctcccagcctctcctaaagactccatcttcctccttggcccctttgtgacctgcctgtccaatcccagagcaggcctcctggtaaattctcccaactcccctaggaagagtgagttgcttctgtcctcgtgctaccccaggactatgcacacgccgcttgtcacgcagccctgcaatttttctttaatgcttgccttcccaccagaaagtccactgcagggcctggcactgagctggcagtcagtgcacatcctggggttttattattggtgtggatgtttaaattaaggaataattgattgttgttgaagcacttgctgtgcattcagcaagttatttggtttcatttctgttgctatgcttgtaattctaattcatttgaagaagaaaaatgaacattcccttagtggtcacaaactatttccaaattcactttccataaagaaggattttgaagtgaggccgggcatggtggctcacgcctgtaatcccagcactgtgggaggccaaggcaggtggatcacctgaggtcaggagttcaagaccagcctggccaacatggtgaaaccctgtctctactaaaaatacaaaaattagccaggcatgatggcatgcgcctgtagtcccagcttctcaggaggctgaggcaggagaattgcttgaacccgggaggcagaggttgcagtgagccgagattgtgccaccgcacgccagcctgggtgacagagtgagactccatctcaaaaaaaaggattttgtttccaaatagaaacagctttgtgttatagcaatttagatcccgtctcattttattttgtgtgtttttcctagttcctaaggtcagtcataggtgtccccggaagggaatggagaggaatgaggcagggaactgggaccccccttctcctgtgcccaaggatgggcagagctgtgcaggagcagcacagtggggaaagcagtcaggggaagggaggggcccatcatcccttgagtcacatcaagcgaagcaagcaacaggataaattaggcgtaaaggttttatctgtgaaagagactaggatacatgaccaagtgcaaagtgtgaacctaacttggattatgtgttgttgtttttttaaaaaaaagaaaaaagaaaaaagctttaaagacattcttgggaaagttggaaaatttgaagatggactggaatgttagatgatgatgtgggattaatgttaatatgatagttttgtaggggtttatctttattcctaggagaggcaggctgaagtctgtggggtgaagtaacacaatgcttgcaacttactttcaaatggtatttgaaaaaacattacacatcatgtacacacacaggctcacacatatataagatccatgtgtagagaagagagagaaagcaaatataatctcctgtttccccaagatgtacctgctgaaaggcaaatgtggatcagttcctggagacaatgagttagagtggatgaagcacaggttttagaatcgggcagttctggacttaagtttcagctgtgccactcactagctggtgaccttcagtaagttacttagcctcagtgaaattccgtttccacatctctagaggggtccacgtcataggttgctataaggattaaatgagatattgcctttaagtaccgagctcagcgctggcacacaggcccctggtaaatatcagtctctttccccaatgtgcaagagtggagctggctgtcaatcatttgctgacactgcctcctacccaaccctgtcttcccagtgcttggccttcaccgaggctctcagagcgcgcagtccctcaggggcggccctatgcatgcacacatggcaactgacctgtgtccctacacctctgggtgggaaaggcaaaacccaagcccagaggaggcccagtgccaccaggcagagggagcaggccaggagctggtaccagcaagagtggataatgctgcccaagcctgagtcaaacatgtggaaagaaggggctatggggcaggttggggcagaaggtacctagtggtgggcattgcggtctacaatccagtcattttttctgcccatcccagtcacgcgcccacagtccatgaggcggtataccctgcacacctctctttcaacccctgttgtttccaaagcatatttctccttttccgttgcccccgtttcttcccctctcatccatgtctttgtgtgagtgagcagaggtacggtggtgatctccccactccgctccctccagctcctcctgctctgatccggcctctgtgcccactgtagggtgaccgtgacagtgccctcccttcggtccccatggggtggctgtccagagttgtttggactcattcgctgccatgaccaagagcagcgtggcccctaattggtggtgcatttctcaggtctccctgatgagggtggctggctaggcctgtctttccacgtgcactcaccttttcagagcccaggctagcccagagacagctttctgatgaaaggttaacaaggctggggtttgctcctttgagcagacatatttgatttcgggaggaaaaacttgccaatcaaaaaagagaaatcagattctggacattcataacgattgagttgaacattcgggagctatgtgattaggcattcagcgtgkcctcctcgggtggtattcctctcgttatagagagctggagaaggccagagagctccacggtgaggccagggctcctgatgtaccatggaagaactgagaaatgtcagcagctgagtgaaaatccaggtgcaaaacagtagtttgctctctaagctgtaccacctctgttcagcccaagttcatgttggctgcagaagggctagggaccaagcttagtccacccctccagaccgtccagaccatccctccttctaggacttgagcactataaggtcaatttaagcatcccgtatgtgctaggtgttgggatggcctaagagtagtgtgggaggggcatggagatgaattgctcactgcccaccaagctccacactgagacctggagggaatgggtctctgttccagctccagggagcatgctaggccattccagtaggttagcctactgaatccctccagccaacctgtaaggggctcaggtggtatcctctcttggagaggaggagacaggctcacagagaatgggccttagtcaagattacacaagtcagaagcaacaggattcaaagctacattgtttattctaaagcttgggttcttgcccaactctgtgctgagaacatggcagtttcctgggttgtagtgagagggccagtgcagccacctgggcaggtggctcaggatcccaggagggtggaccacaagtgagactgttctggtattcttacagatcttaggccctccttaatgtttctgggcctcagttggaaccaagacaagtaagctggtatcctgtacctggtgtaggctcaaacttagccctagaccccaaaggcatgttggatgattttctggtgtgtgtgagagagtagaatgcagggtaaaaactgagcatgtgtgggagctagcactggaggtaccagagggcagtccaaccccatacccacaattactttggcatcaacctaatacatttagcagtgtctacatttagttagggtacatgagacataaaatccaaaagagaaattgttggcttatgctagcttcaggtatggcttggtatccagtcatgttcatcagaccccagttttttggtttttgttttttgcttttgttttgcttgagacagggcctcactctgtcacccaggctagagtgcagtggcatgatctcggctcaccgcagcctcaaccttccaggctcaagccatcctcctgcctcagcccccaagttgctgggactatataggtgcacaccaccgcacctggctaattttttcttcttcaatatttactttaagttccagggtacacatgcaggatgtgcgggcttgttacataggtaaacatgtgccatggtggtttgctgcacagatgaacccatcacctaggtattaagcccagcatcccttagctattcttcctgatgctctggctcgcctccccacccaccactgacaggctccagtatgtgttattcccccagtgtgtccatgtgttctcatcattcagctcccacttgtaagtgagaatgtgcggtgtttggttttgtattcctgcactagtttgctgaggataatggtttccaactccatccatgtccctgcgaaggacatgacctcatttctttttatggctgcatagtattccatggtgtacattttcttttttcagtctatcattgatgagcatttgggttgactccatgtctttgctattgtgaatagtgctacagtgacatgtgcatgtatctttatagtagaataattgatattcctttgggcatataaccagtaatggattgctgggtcaaatggtatttatgctttagatctttatggaatcaccacactgtcttccacaatggttgaactaatttacactcccaccaaccatataaaagtgttcctttttctctacaacctctccagcatctgttgtttcttgactttttaataatcgctattctgactggtgtgagatggtatctcattgtggttttgacttgcatttctctaatgactactgatgttgagctttttttcatatgttcattggccacgtgaatgtcttcttttgagaagtgtccatgtcctttgctcactttttaatggaatttttttttcttgtaaatttgttcaagtcccttgtagactctggatattaggcctttgtcaatggatcgattgcaaaaattttctcccattctgtaggttgtctgttcactctgatgataatttattttgctgtgcagaagctctttaatttaattagatcccatttgtcaatttttgcttttgttgcacattgcttttggcattttcgtcatgaaatttttgcccatacctatgtcctgaatggtattgcccagattttcttctaggatttttgtagttttgcattatacaattaggtctttaatccatcttgggttaatttttgtatatgtagtgtaaggaaggggtctactttcaattttctgcatatcgctagccacttctcccagcaccatttgttaaatagggaatcctttccccattgctttttgggtttttgtttgtttgtttttttgagacagagccttgctgtgtcacccaggctggggggcagtgatgcaatctcggctcactgcaacctccacatcccaggttcaagcgattctcatacctcagcctcccaagtatcggattataggtgtgtgccaccatactcagctaatttttgtattttttagtagagatggggtttcaccatgttagccaggctggtcttgaactcccagcctcaactggtccaccctccccggcctccaaaagtgctgggattacaggcacaagccactgcacctggcccctattgcttgtttgttgaagatcagatggttgtaggtgtgcagttttatttctgaggttatattctgttccattggtctatatctgtttttgtacaagtaccatgctgttttggttactgtagccttgtagtatagtttgaagtcaagtagcatgatgcctccagctttgtccttttgcttatgattgtcttggctattcgggctcttttttggttctatatgaattttaaaatagttttttctaatgctgtgaagaatgtcaatggtagtttaatgggattagcattgaatctataaagtactttgggtagtatggccattttcatgatattgattctttctatccatgagcatgagtgtttttccatgtgcttgtgtcctctcttatttccttgagcagtggtttgtggttctccttgaagaggtccttcacttcccttgatagctgtcttcctatatattttattcttttgtagcaattgtgaatgggagttcattcatgatttggctctctgctttgtgtataggaatgctagctatttttgcacattgattttgtatcctgagactttgctgaagttgcttatcagcttaagaagcttttgggctgagacgatggggttttctatatataggatcatgtcatctgcaaataaagataatttgacttcctgtctttctatttgaatgccctttatttctttctcttgcctgattgccctggccagaacttccaatactgtgttgaataggagtggtgagagagggcatccctgtcttgtgctggttttcaaggggaatgttaccagtgtttgcccattcagtatgatattggctgtgggtttgtcatatatggctcttactattttgaggtatattttttcaatacctagtttattgggagtttttaacatgaaggaatgttgaacttcatcaaagcccttttctgcatctattgagataatcatgtggtttttgtctttagttctgtttatgtgatgaattacatttattgatttgtgtatgttgaaccacccttgcttcctggggatgaagccaacttgatcatggtggataagtttttgatgtgctgctggattcgttttggcttgtttaatttttgtattttttgtagagacagggtttcatcatgttgcccaggctggtctcgaactcctgagctcaagcgatctacctgcctcagcctcccaaagtgttgggattacaggygtgagccactgcgcccaacctagaccccatttttttattttgcctcatttattggccttgcctcttctgctacggccattctcaggcaggctttcccctcctggtggcaagatgcctgcaatccttccaggtgcaagaccaacaggaaagtgactgtcacttcctagtaactcccacgcaaggcacggcattgactcgctggactgactgattatatgcccatcggaaccaattattgaggccaagggttttttgtgtgctgcaggtagggccccacctgaagcatatacctaaggggtcattcctgaaagggaaattggggccattatcaaaagaagggagagaagatcaagttgacaatgtgcacagaagccaaacaggagacactgtctcagctctttgtccacttgtctcacagcagagaacggttcataccagacctgtggggatcctaaaaccgagagagcatgcagggctgagagtcaaggtcagacattaaccagggcaccagatagaggagggacagaagagaaatggcaggttagcgcatggcagaccagggaggtaggaggcagggtgtagagatgggcacagctgtctgccgttgcctgcgatagcttctggagactcaagtgtgacaaagtccactgcagtcccggggctaggagaggagaagggtasaagctaagaacctaggtcattcgttcagcaaatcatcactgatgcctactctgtgccacatctgtgaaaacagagatggcaatgacacggttcctgacttcaggggtctaacattctcgtggtgagtggttcaacgtaatcctgatggacagaatccatctggtagttttgaaaggcccagatttgtgcttgtgtgatcatgccatagggcatctctaagtgccctttttgtttgttctaaaccccaacaagtttggtcctcagggtggtctccccaccagcattctcatgaggtgcccatcagctcctcacggccagcttgctagagatcactgtgaaatagatggaatgttttgttaacacccttgctttttatctgcttcaaggactaggcagagagcttgtctttctaagatgggagtgtgcatcttcttcaggctgtgtctgagatgcatggggagggttccaaaccagagaaactaaacacagtggctgttccaggctgttctgcgatgaggtggcaactgatttcatgttaagtatctgcccctggtccaggcgtccccacttgctttccacagccagttgcaatggacatttctcaccttttaaataatttctttggtgcaagttatggtctccagaaaagctcaactaaaatacacaaagaggaacagaaactaggctggctgcagaatggctgactgattgccctgtagagtccagccagagagggaggtctgagctgggctttgcacctaggacctgtgtttggtcctcccttcccttagatggagctcctccctggctccattctgcctctaactctactcccttagcagccacgaggagctctacctgtggtttctagcaccacctttgttctkggagctccagktttctgtttctagctcattcckgtttcacaagcttcagctactagaatgtcttagtcagacttcccaaaccagctgtaccccagttccaccaaggtgtcagcccctctgtacccatacattcctcatatccctggggtcctgtgtctctctcctcgactggtctgtgaggcacaatgggtatcagaaagcatcagcacaygttgagataggcagggcctgcagcctcccgaatgtggcacctctccaggattstctccctgaccactggtttgcctgcatggtcaagaggacgtacccagcctccaggaccctccctgccagaaatcaccaccacccctaccaagcccaccctgaccacagctaggccttctagtctggagctccctgccatcctccactcctggcagttcctgcccaccctccaggactctgtgaagtgcccctgccctgggcagagtcccttcttctctagtccctagcgcctcgtatttatttgttcaccagctcttcatgggcatctgcactgggggacccagggatgaatcagcccctaccatctctgctgccaggaatgattttcctcttctgttccacytgaacagaaaatcctcccaacccttcaaggccctgctcaggcatcgccttcccttgacaagcccccacctccaccgacttctccaagcccagtcattcccttgctgctctgagccggcactgtccctatgctggcttgctggggatgcatttataccctgtcccacagaaaaggacagaattggccttctctgtatccttggcaccctcacagggcctggcacagacgagctgccccatgagagtttggggaatgaccaagtggtgaatgagtgcgggcaggaaaggcagtgacgtggggaagaggcgaggccaggtccactcactccttgtgcccttgagtagtcagtcggttcagcagagcaagagaaatccagcaaaaggcagtgacttgttctgcggcgcctgcacgcgctttagaatccccgcacgcggcgccaggttgtgagrgacaggatcctgagtcccccaaggctccaccttcagcggtgtgacagcggggcttctctgccaaaggactggccagagcctacaaacggcatttctttaaaggtctgtgtcggagctgctcagaatccagctccctgccggggagatattgagcccaacaggacaagagcaggaaatctgattcagcgagaccagaggagacattttctcagattagaattctctgtgccagaggtggggagtttatcacagcagggaaggggaaataaaacataaaatattgaaaataaattatataccacatgcgagatcaccttagagagtcagctctgtatctgtggctgtgcagggagtccccgccccatggtcacaggagtgctgtgccagaggctgcttgtcgcacatccaccatcagtccctagccctggcagagccaggtagtgcctgcgggctaaggaaattattaacctggctgtgcccagaggaagggatggcaaggactaaccaagagatggagagtaaaaaggggttaggtggacctaggggttttcattacaatgtagacctcctgtgtctcagccaagccccttcacaaacttcgtctcacttaatgttctcaacagccctctaagactgatgcagttatgatgatccccagatagctgatgctcagagaggttaagcaccttgaccaaggtcacacagtaagtggcagagcaagaattaaaatccaggcctatctgatgctggaacctgggctctccccaccccaggtgggggagcttgaattttatcccataggtgcctaggagccaacgagggttgtattcagagaaatagcagctgggaatatgtatgctgggccactgtggaaggggatggaagtagttgaggcagagagaccactgatgatcccayggacattgctcaggccagggctggtgggagcctaatctaggacactgcttctgggggtaaagatgagaaaatcatcctagagacatttaggagacccaaaggacacaacttggcgggcagccggatgtcctgcgtgggaactgttgaagctgatcatagaatagcacagggctggacacaggctgtgttcctcttcatccagccagcatgccccagtgaggcttgaagtacagtccgtgaggaagggatgtcccttggggtgtgcaggattgatggacaccctccctcagcaacccagactagaagtttctgctcaggggcagaatagcctgcttggaggaaagagggtacagctcccccaaccctcactgtccctgcattttccccagggctgtctaccaaccaccttcctttttatactctcccagagtgctgtaagcaccaggatacccgtaacttactccaccccctctccccagcctagggtgtggaatgttatggctccttccctccaggttgccagctcttcagcccccaggccatttccaccaaggatgatgtacagtattatgctaaaccaactttacgggtagccccttaaaatgcaggcctgtacctgtgatggatggagaacatccagttgtttagccaaccacttacagtttgttgcaaacttgcaagaaccacacacgggcctcttgttaggcctgttatgccaaggaccccataaataaacagtagcgtgtatcttggtgcatcagggctggagtatggaaatagaagtactgtataaataatgcatatttacaaaataaatatatcccatacatgagcgtgtgcagccataaccaaagcacctagtttaacaaccacggaaagctttgagggcctgccaagtgatcagcttccatccatcagtgtgcaccagcattagaaatgaccgccgaagggagggggtcctcctgcacgctgaccttgaggcctttgcattgaggcaagtggtgagattgcaggtgggcaccctgacacacagcttctctgccaaggtgtgaaacctaccacagccatgtgttcctgcagatgtcttaaggtctaccgccaagcagaaggctgatgagcgccgagttgcaggacgtaatgggttgtacctacaggaagagggctggctgggggagggagagatttcctaattatgcagattcactttggcttgcaaaaggggccggtgagttgcctttccaggggactcttaccggagccctgtaactttcagccattcaccctgaaggcagggctgagctttcgggaagtcagtgtcccgtctctgccgccccattttgagctctgaaccccaccgggcatccggctctagcatctggagcttggaagaagcagctgacagaatggccgctggagtgggcgcccctccccttggttgtaatggcacaatgctggatttcagtattttaaatgaaaaatatatgcagttagctgtgcgctgacaatgtccttgaggatttgacagtgagattttccagcagttggtcttcgttaggatcctggcggtgtttaataaggcagtcgaactgctggcaccttgggttcctgtttgttctccgagggctcaggggctgctgcggtaagcacatcgaccagagctgatcattacaagggcgtacgccaccatgaataaaaatgtcacacgttttcccatctcacagcagtacaaaatgtcagtcctgtcaaacacacattgcagggagctgtgtgcagtccgtacaaattggagagccgcatattcccccagccttctgatattcttcatttgaagctgaagaaaaacagttgttaacctattagctaggattttaaactctgctgaggcggtggatgggtagactttgacacagatagaaatgtattccaaggtccaggaattttaaaaccaggttctccgtccatttgttctgagggaaggaaaaaaaaaaaaaaccttctgtctggtgaacctgactatctttctttaacagacacactagggaaattttgggatatttcatatctaagcttcccattgcttccacgtttgcattccactcaaaaagtctattgctttgggggatggccctggggctcaacctgttaggctaggaaacctgtaggtagagggtttttcctgatcagaagcatgccaggaatgttgccagtcttgcagacaaagtaactcaaatcatggggacaatgactggcgggtctggcattattcagatgctgggtgatggcttcactgataatttgatgctagttccccactcttgggcagccatttactttaacttgaccgcgtgccaggccttgtgccaggagccagatgtgaaccctcaaggactcaccttcttaggggaaggacagaggtaggagtgcccgacttttgtgggccaggaatagagagagaacttctgggggaagggaacagagtcgtgagggatgcagggatccatcaggtgggtgagtgagggaagggcttataggaccagcatgtgtgttgtgaagggccatggcccgtgagggggctggctggaaagaaggggcttcttgtggtggggtttatcgggggcagggccaggtcttgaatggcatgctggggacagggatgtgagcaactctcctgggctgccagtggcagggaaagcagttggaggctcgtggtggcctggccaaggagtcctggactccctttctagatagagggtgctatgcactcctctctggacctctgcaaaatgaggagaattcttctcatttcctagttgcatcctgttagggtggacatcattccagagatgataaatgagcctggttttgctgagctggccctggtccttaaatgtactgagcaaattctcactgagtagggacacgggcctggtgaaatgcaggcggctgcaaagacaaacctttctgtgtggtcagaacagacttagcaggacaaaagtctcaaaggatgtcagagggaggactttctggggagagagaggagcggacccgaggagatacgttttaacatcttcttctgctgttggtatgtcgggtctcctgggagcagcgtgggcttctttggagtcaggcgtacttgggcttggatcctggctctgccacccgttagctgtcaggccgggcctgggcaagtcactgagtgacatggcctcggtttcttcatctttcacattcttggagggttgctgagatgaatagagacctcgcatgtagatctcctagcacggggcctggtacctagcaagtgtcagaaaatagtagccccagagaggagatcatttcccccaacatctggaagcccctctaacctcacctcgtgtccccctcctcctgggaatgtcacccaggcaccctcgacagcatcctagatgcatcccagcagcaaggcgcctgcctcctgcttctgtctgggcaaagattggcatacgtcagcgaggtccctgcccctgcccaggcaccagccgcatctggtgcccgacctccggccaccaatgggatgccacctattcagactgtgcacctgcacccgactaaaaacaaagggctcccctccccctgccccactgctggccctcctccctcccccgcctctgtcccccaagcggctagggtcacccggcccccacgcagccttccctcacagctgcctcgctgcttttgttcagcatgtgaacttccccgtcagccgagctccttgcacgggaagtaatcagggatcttgacaaggcttcaaaccacaaatgccactacaaattaaccagcaccactacaaaatactactcctgtcaacatcggggaagaatgcactgctcttcaggaccagtctgagatgtctttcagctcagcactcactcacggcaaagagagtgcccggacccagccggagagagtcgttgacaggactggcgagcccctgaatcctgagcgcgctctctccggagatcatctctgtgagaccccgcggcaggtgctgcggcttttcttccmggacccccttcgatcctgagcaccccctcatccccctcgcaggtggcgcctctggagggcaagttgtggggcacccagaaacctcactgtggagtctgccgttcagagtgaagcccagcccgacctctctgcgtcctacctatgtgctgtgcctttgggcaaggggcttccctttccctgtctacagagcggcaatcataatagagcctctgtctcagagtcgccaggaccactgggatatcctgagtaatacctggcccctcccagcctcccttcctttccctgaagaaacaggtccttgttgccctgtgtgagtggactctcagcaagtggaaacctcttcctcagcgtgacgtggaagtccttcctgtacagcatcttgcaaggaatatccctctagagtgacagcttgttatctctgcaaatgcttcaggcctcaggatccccacatttcctctgggtgccccgctgagtggctcaggcaaggagcatgctgtacgctacgtgacaccagggcctggtcttctccagctgccctggctgaagctctgaagtggaggcaagtatttgatcctcccccgcaagcagcacagccctcatccagggcggacagagaggatcggagacagcgatgggcgctggggactaggtgagagctgtgcctgcaagagagcttcttgggcatctcaaaggagacactccacaaaaatatcgcttcaatgcactcctttttggaggcatatcaaaagcagccctcttttatttccatgccttgcataatagcagatttccagtcccaaagtgtagaggagccttgctctcggcgcagaggccctttgtaaaactacagaaggctttgtcttccctcccaaccgggtctgtttcatgcataggtcagagcattgatgtggctactagccaggaaaaattaaccaggtgaacactctcctcattaaacagcgacagagtttaattgtgaatttgctctcttccccatctccattcctggccacgtatttgactggggcatgtgcctgggacaaactgagaaatggcagggcctatccagcttccccctctggggccaggcctcctccatttgaggcaggtaggcacctggcagggaagggacaattcagagtacacagtgcacacagaggatctgagaccccctttggggccagcttcagaggctagctctgtcatgcgccagctgccatcaggcacaccccaccttcttggcctcccctcaccagccaccccaatctttgcatgcacagtcctcagcctttagtgaacctggttggtccctgtggcctccagcatctgtrctattctattttctcacctataccgctcctcggttggggtctggcctgtctcctgccaactttgacatttcaccttctgtgtggccctgctgtcccagcagtgaagtgcagatgctcattctgacggcacaaggatattgaagggatggtcccagatgtccccttcactggggactgagtgaatccacgggtccatccctaaacagctgtctgccctctgccccatgcacaaacatcatagcacccctgccccagcccataattaactcaggatgagctcactggccctcttctcagggcctgttacgcacttgctctgggcaaccctgggcaagtccttgcttgccctcatctgtgaaatgggtagcagccctcgttccctgcagaggagccttgcgctggtgagtgtgcagcggctgcttaggccctggaagcaccggcagcagaaagtgccttggctctgcccacagcacaggcaggctggctcccaggcagcagggacaccacctctcctcccctacacactgcgctctctgcccccaagtcaccacctggccgtcgagcgttttccaccctgcagccctgtgcggggtgcccactcatccatgccacccaggtaattaagttgctattccaacgcgccttcccctcctgaccttttggaaacaatgtgttttgctgcatcaacaaatgaactgcaaatcagatgctgtcctcataaatgccggtttcatatccaatgagcatactcacctggcccacacagctgacagatagagatgccgagggccaggcagagaccaacaaaggccaaagaggtcccctcttctcagggacttctgtgtcaatcatgccttcggtcttaccctctcttgtgttcacatctcccagcagtggtgtggccagggccggtgggttggcaatatggaggcctgggcaggctcctgtgattggaggggagtgtctgttcctaggagcataccccatcctcctccaatgcattttctataccaaggacgtcaaggttcctcttattgtgtctctgattatatccctcccactgagctcagaagaaaatccgcaaattctcagcctgacattcaaggccctctttttatctgacctcccccagcccctcccaggtcctggcctgccctgtcctcatattcagcctcactcttgtctgattggaccactgtgggtcccctgtccctgcactccctaccactgccccccccccaatctatggcagagaccttcctgtgtaccccatgcatgacagcgccctctaccagagtcttggtgagacatgtgcccctgtgcctgggatgccacgcactgtttgttgaatgaatggacaaatgaatcaggtgcctcctttggaaagcaccacaaaaagatgctcaaataaggaaagaaggagaaggtgacagttactctctcatcagccttttctctgaggcacagatctctaacaacagattctaacttcagaagggacaaggattagaagaaccgtgtcagaaaggattccaggtgactttggaaattttagttgacaaggatagcacaatgggctaagaatacctgcttgttttagttttcrctactagctgtgtgacctcatactagtcccttaacctctctgggcctcctgtttcctgtctctgtaacagggaaataatccttctctaacttgcctcaccagggactgtgaggttcaaaagaaagaacagaagttaaaatgctttgaaaggaaaacacatcatataaatagaagagattattattaaaatccagtgtccttcaacagaaccttgctgatagcacacagctttggaaaaccagggtcctcacgtccataggacttttctggaaagacctgtgggtaccatggggagatggaagatggagtggtcccatttcatcttcaggatatcaaaccagaacctcgtgcggctgtaactgtactctcatcctcacaccgatgcttgtaacctgggagttttgccattttacagaagagttcactgagacttaagagagattaaataactcgcctaagtggcagaaccaatactgaagtcaactagaaaatgacagaaccaactcgtgaacccatgggtttctaacccgaagtctatttcttggggtttaccccaccaatatttctttcactttaagaagttattttcccatgrtgtaggtcaaatcccaccagactctgcagtcctcaaggacaaggactgtgtcttattctctgaatccccctggtcctggcccccaaatacttagttgttccataaagacacacaggaggaatccttccactctgtgacagtccatctgcttcccctccagatgtgtttttcaggaaagcaggcactttgcgttgaccatcgaagaaaactccggccttctccccgcttcgccggccctctctcccctcctgccctggcccagctcgggaagtgctggaggaactgtcgaattgaactctccttagcaaaagatcgccaaaggcccagtctttttgaactgacttaagaagcagcagtctgtgtagccacatttcaacccggccaggggacagaggatcacatataacatgacctcaatgcaaagatgcccagactgcttcgattctctgctgcatctactttaaagctcttccagttttaccttcctttccttcagcggtggaaagagcactcaagcggtcagcggtcaagaggccttcccgatgacaaccaacactcccagctctgcccattaccagctgggggtgttgagcagctcgctttacctccctccaatctgttcccttttccatggccactaggacacttagcaagggcaggagcaccagmgtgaaagaggagcaggctcaggggcccagccctgggctgtgggctggggatgcagacaaccagagctgagtcagatgggagaggaaccactccaggttcagaataactttcactgagtcctggccagctctgccgtcctctcgggcctcacaccaaccacactgttgtagtccctacattcagctagtgctggcttcagcttctagagcaccggggccactctctggaagagagcatgcttttctgagttgatcctttcctagctcatccccttaccccctcttcccacccaaatcactactactcacctcctacagtgtttaatggtctccagactactcttccccatctgtgtccccagctggggacaccccagcttatttgggaaactgcaaccaccatggccgatggccccaccacgccctgtctaggaagcagaggcctccccagcagcgtgtccactgtgcccctggccctgcgtgaagtgccatcagatgccccgcatccctgcagcagggccctcgtgactggcctcacagatgaggacacagaggcccagggaagtcacttgcttgccaaagtcactcagcaaaccagctaggcctggagaccctgcggtgggagcaggagggccctgcacacaatcagatgttctagtgtccgaaatctgagacygcttcccacgggattactgtctaatccgctggtgacaatccagctgctcacctgtccccagcctcagctctggtccccagggcctgcacactcctggcagggcatcctgataattagtgcagccctccccttcttcctctccccagccccagggtggagggtcttcaatgcgcaccccctgggagttcacctttctcttcctggcggccaccccacaggaggtgtccccatcatatgctccagcatcataacaagcccagggtcggtgagtgcagcccccgtccctgtgtgtttcctctggtgacaggatcccctcgtgccgacaacccgcagggaaaactccccgagtgtcagaaggggcaatgtggcttcctgttcttggttgccgttgttgggttttatctgactgggtgcgccaggacatctgtaccacgttactctttcttggcatctttatatcccgctggctcactctgctaacttttagaatgggtgtggtcaagaggctgctttcttcccaccatttatcaattcagttgcaaaacagccagcacttcccgaggacaagcaaaagaaaatgagttaattgaagaatctggagaattgacatttggtgtgtttttacatgtgccaggaagtttaagccaaaagtaatttgctgagcacctattaggtatcaagtactctactagamcctatggtaaacagagaagtgagtgagctgataacgacagccggtgtgctgtggatgtgaggcggggttttaccagagatgagattgcggaggtggatggcggggccctgaatctggagggctttgaacacttcagacagcattttccaggggatattcatgggtggtatagggaaagcaagtctatgttcaaataaacttgggaaataggactttttaaaaaagagttaataggtttttgcctggtttgggtgggtttttttcttgcaagactcaccagcctttgctatgctaacaggcgttgtgaatccccaaaaggagcaagacagaagacagcatttctcagatttgcctggctggggaacctccttttttcccttcacacaatgcgtctcccaggatggtgtttctcagcagacaccctgtgagatgccggccttccactgagatgatttcatctgccaagtgccaagactgggtggacatttttttaagtcctctctggaaacaaatgtaggcgatggactgggagggggagaggctggaggcagggaaacctgctgatggtaatggttgctaatgtctgttggtggcactgtgcaaagaacctgaygtccatcatctcgttgaatcttcctaacaggacactcgggtaggcagtgctgttacctgtacttcacagatgaggacagtaaggcttggaatggtcaaatcgtgggcctggagtaacccagggagtaaatgggagaactggggttctctccaaaactgtctgacccctagaggctgcctcccgagcgctctggtgcactgccacccagcaggaatggaaatagcccaagccagaggtgacaagcagtgaagacagtggggctggagaagatggttcccccgaagtagaaaggccaagcataagagaagcagtattgtggggagtggtgtaggagagctgggtgtctagacagggtagcagcctgtgcacyggtggagggggtgggctcccctctccctgatcacctcttcctcttgatgaatggtgtgaattgaggggtgggggggctgttcccctttaccccacacacttcctgtaagccaggaaggggaaaaaacatggtggccttgcccatccctaggcagcacccccaactcccgggtagctgtcagctgaagggtcaccaagcatgggtcagccctcacgcccagctaatggcataggatctgggaagccacggtgtcattctatcccatcgtgttctccatgtgccgccagggaaccctccaccaagtccctggacccgctttcccctcaggctgccccgacaggttccatgcagagcaccagggacccagggacaactgggacacaggccctgccctccaggagtagtggggcaggttcagaaaacaaattctaaggcagatttgagatctgaagtgtcactcccactcagtagagccctatatcagcactgtccaagaaaaacataatgggagcttcatacgggagtcacatgtggaattctgaatgtgaaacataaacaggtgaaattgattttaatataatgaacccaatatatccaaaatattatttcaacatgtaatcaatctaaaaattattactgaggcgtctgacattctttcctcgtgccgagtctctgaagtccagtgttttgcacttatagcacgtgttttttggttttgttttgagacagtctcactctgtcgcccaggctggattgcaatggcacgatcttggctcactgcaacctccgccttccgggttcaagcaattcttctgtcctagcctcccgagtacgtgggattacaggcatgtgccatcatgcccggctaatttttgtatttttgtatagatgggggtttcaccatgttggccaggctggtctcgaactcctgacctcaggtggtccgcccaccttggcctcccaaagtgctgggatttagagcacatcttaacgtggaccagacacatgggacattggctccccttttggctggggcaagtctggatttggtccagttagatgtatctttgtgacctgagtgacggaatgggcaggaaacaaccggaagcctcccggggattgctgtgggtccgcggcctgggtctcgcgtgaatttttactttccttactcagcctccctgtctcccatgcctgcgagagcatcaagacaggcaggctgttgaaaggacactgctgggcgttcaagataaagggtttgaggggagagctgagaagtctgtgctctactggttttgattcaaatcctgatttcaaaagccaatcattttggacaaattttatttgttcatcagacgcttgttgagcagattttttccccaggtctcacagagcctgcaggcatagggatgaacccccttggagatagacctgtaagaggtcccgtgggggcaggggtgagggatcccacgctgagtcccacatagcaggaggcacgaggcagcatccgagccgacagagctcttgaaggacaggcacacgtttggcaggccagtccagccggagcagcccattccacccggagggtgggtggcaaacaaggcatgagagcccagtgctacttaaaggatctgcccagggcaggcatgggtgaaggttgagaaaggtctgtgtggggcacagtggagtcccggtcttgggggacatgcagtgccagcctctagccttgagcaggcgcccaaggacaggagggggcatgagaggtctggagagggggtgggctcgccctattgcacctgggaagggcccccagcctgtgtggagcatggtggagggcggagctgggagccctgttgggagatgattgcagtaacccaggctggagacaaggttagaaggaaagaatgagcagaggagacggcctcaaaaggtggacagtggggcgaggcaggaggcgtcgaggttggccctctggctctggcttaggtgactgggtgccttcctccaggccgtgtgtggaaatgcattgagccttctcagtgtgtcctgatgttgtaagtttccactttaatgcagctgcagagactgcgtcccacccgaccgcctcccaagatacagcgctcgaggcccgtgagtagctggtggttctgccctccccacctaacactgcctgagccattctccctcagcctgactaaacctccagagtttggaccctcctgcctggcaaaagaaaactgggaattgggtttttcagcttccctctctgtgtggcatgaacttgagcttgcattctctgggcttctcttgctttttcgtgaataagtttggtgacttgcagatcagagccataggtagcaagggggccactgtgtgctgcgtgtgctgcgtgtgcattatttgagcaagtctcctagggtgagcaatgggttggaagccttcctccagacgcctgttcctcacaaacgaagcagaagtccgggggcaagggtctcgttcccgccagatcttggtctggagatgcatttgtaccttcccaggggtggaggctatgtccagggagtatggagccagctcatatggatacaggtaccgctgccctgccaggccttccttggagatccactttcccatgttaagtgccaagtaaggggcgtggtggtgcatgcctgtagtcctagctactcaggaggctaagatgggaggatcacttgagcccaggaggctgaggctacagtgagctatgattgcaccactgcactccagcctgggtgacagagcaagaccctgtctcttaaaagaaaaaaaaaaaaaaaccaagtaaggatggagaagcaggacaaaatgtgataaacccaccaccacctgggaatggggtgggagggcgagagagatccgtccatggaaaaatatggggtctgggtcccgtgttaagcatcagtggagtcgttttccttggtaggtcagactccggccatgctgaggcatgcgaactttagcaggtgctttgaaagtgggaaaccatccaggacctttcgatgggggctgtttaccaagggaaaagtttctccatctaccattcagtgtggccaccactctgtggccaaccaaagagtaccccacaacccagtgtcctagtcctcccgccctctgcaacacacgtgtccaaatccatcttgtgaaggcaaagaggccggggcctgcaggtgaccaggtgaactgtgtctgttcacctggggagatgcacccagcatccactgggtagctgctctctgggtgggtgttggccattctgtggcacagttttccttcccttcccttcccygctgtgggtgggaattagagggctagatgggaggctgggaggacttagatgccttcccctgtgaccgtcgcgagtccacactcccagccacacgtgaccgtggatccatcccgtatctccatcaaactgtggttggcccaaaccccccatcgacacagctggcaaggagctagaatatgtctgctcactgtcactggaaagaagacacaagcagcaaaaagaaactgctttgggggacaggaggccccttctaggctgaaccttgtgtgactagtgagagtttcagtacagatttggggggccgacagagctaggcttgaatgctgaagtcatgtcactctggcaagcactgaagctctctgagtctgatttcacctccggggctgtgccctcattcctagaggggttttgtgagaaggaaagtggatgacatttgtcatttgcagaacacacacagtaagagtttttttttgtttgtttgtttgttttgagatggagtcttactctgtcattcaggctggagtgcagtggtgcaatctcagctcactgcaggctccgcctcctggattcacaccattttcctgcctcagcctcctgagtagctgggacaacaggtgcccgccaccatgcacggctaatttttttctatttttaatagagacggggtttcactgtgttagccagaatggtctcgatctcctgaccttgtgatccgcccgcctcagcctcccaaagtgctgggattacagacgtgagccaccgcacccggccaacggttcttattcttaacaggtttttgcatattacagcttctaaggaatggcccagtttattaataaccatcacttgcctaggattttatagtcagcaaatcattcttaggtacctcatcccagctgcgcctcacagtcgctcagtgaagtaggcattgtcaccagtttagcaatgagaaaactgatgcttggtaacttaacccaggttcctcaactgcaaataaggtcatctggactctagaacctgtggtcttgccagtattccaagctctctggaccctccgtcttctgcttgggaccagaatagtttcagctttcagtttgtttcggattttagaatatttgcgtgatacttcctggttgtgtgcccctaatccaaaatccagaatactccagtgagcatttcctttagcatcatgttggggctcaaaaagtcttggattttggggtgtttcagatctcggattttcagattagggatgctcaacctatataaaatgctgcgggaagaaaaaaaattcagtcaagaaaaaaatgaatcagtagcagctgaactgtctgtggaatctccagtgccatgttaggtctggcagagacacagaggagaagagaattaatattcattgagcaccttttatggtgcctaggactgtgctaggcacttgtgtaattattgtctcatttgtccagcccagagcaggcagatgccatctccctaatttgtagccaacaccacagggatgatgacaggcctgatgataagtcctgcctttgagcccagcttgcctctctccactgtctctctttgttttctaccaaacagcctccccttaagccaaagtcagcagcaggtagctctcagaattccccttcgaggcttgggatccaaggcgggcagggaatcttggaagccatgattcagggaaggatcattccccttggaaaaattcaagtattggagacagctacagtggactctgtgttgtctcactggtgtggggatctgtgcagattgcggggtgggctgccacatccattggcaactgaggactcgggagacagacgctgtgagagacacggagtagcagctgcctcaggcgctgagctaatgcaggaggtgactagcctggcgctagctttggctggacctcctgggttgatggcatgctgaagaggcaggatgcctaggagaaccagctctcctaggcttggaagtcagagaggcctgccctggtttgaattacagcttggccacttcctggctgtgcgaccttaggcaggatcctcacctctgagcattagtttcatcatctgtaaaatgggtttaacaataccacctggtaaaggtaatgaggttgtgtatgtatagcacctagcacagtccctggcatgtcccccgaacttacactgccaagcatcaccactaagaggccaatttgggagtcatagaagatttgtgctttctgggcccctaaggaccatttattctaaatgcatttatgcaagcatttccagtggacactgctacagactaggtgggaaccggggagactcggsatatggaacccacaagggcctcgaagagaacagcctaccaagctcccatgtcaggagccatcagcctccagtgtggctttgctgggtcacgtagccacaaactttccagacagaagtgcagccgttggcccagggtagcaggggctggggagggtctagccattcagcctttctggaaggagctttgtagcctggcacctgtggctggagttcagatgttacccgaagatttgggttttctttttaaaaagaagaaaaaagaaagagcagaagaaamccatgccagtgtctcctggacgaaggggcatgggttggggcctgccagggaaaggcaggctgccgtcggcctgcgtgtgaagcactttataagctctgtatttattatttcttgctcaccattaaaatcaaatgtactcagtgcttttgtattcaatacacatttaaccctgccgacttagatttctcaggttttaaatccagtggggaattggctggcttcccaagtttcccctccagtcccccttgaacagagctggaaatctctgtttagcattttctccccggacgcggctgggatcctcacaccggtggggccagtcactgttgtgtgtgcctgtgggtttcttccttcatcaccagtacccacccttcctaagcacccccgaaacatgggtgtgatcgctgaaatatgacaagacttgtctgcatcgtctgtgattcgggcttcattaaaccgttttgtctgtgtgtgtctgtgcctggttgtggtctgccaccgtgtgtgtgtgagggggtgtgtgtgtgagtgtgtgagtcatacgtgtgccttcacctcttgcgcgtgcctctgtgagtgtgtatttgtgagatagtgtgtacacggaagtctggaggcctcgatgtatctcgggatggtcaggtctgtgagtgtaattttgtgtctggctttgtccacactagtcaggtgtgtgtgactctgggtgggtcggcagccatgctggtgaccaaccgcctctgggtctggcgtgtctttctctccctccccagcctccgaggctccagctccgtgctccccacccccccgcccctccccccctgctctgtctgttttatcatccctaatgaagcagtctcctccaccgatcccgctgattgccaacccattccttttgtttgttggcgctgagccattcagcggcactctgacagctcagctcgtctaattagctctgttgttctttttccccatgtttcaccacgttgcaagttcagttgaagttgccacaaacttaatccccccatttcagccacaagttcacattcttaacccgcctttattgtagcaaggagcagccctgtgcaaggatgagctgacaggccttaaagtctgacctttcctgaaagctctgccccggggccccgcggggcaggggcagaactgctccttcaccctacccacactcctgcttttgtgggcagaagttgggggtggggatcattccagccaggtgaccctgttgaccagctgccagagctggggaaaccagtgcagagtcagaaggggtgcagggatacccacttgtttattcagcacgtgttgactgaatgtgagctgtgtggcaggcccagctctaatcacgatgatactcgcagcgtcattatgcacttctcagattccgagcagcaacattcattcgtttctaaaaatcttgctgagcgaccatgacataccaggcagtccacagaatgcgaggcaggggtaagagaatcctaaaactcatcttctaattcagagacacccactcatcgtcttccttttgttgttgacaagaagggacatccaggtcacagaggagcaggatgagcatttattgagcccccattgtgtaccagaccccttggggggactttccctgtatccgggcttcacaatcaccccacagatgaagacagccagtttggtggaatgcctttggtgtttaccacatccctgatatgccaaacctgtctgagatcagactggccactccacaggaaaaactttggttagatcagacgtgcgcagacctgagggcttgacaagactctgtaaagacttgtcttttatgcagccagcttctatcatctgtgtccctaagccaccgtgccgtgtcacccacaagcttctggggggtggggggtacgatgttcaggaaaaagggtgggcaggaagtggagtgtgtgcctgcttcccttccctgtcttgtcctggaaactcaaagggtgggcaggaagtggagtgtgtgcctgcttcccttccctgtcttgtcctggaaactcaaagggtgggcaggaagtggagtgtgtgcctgcttcccttccctgtcttgtcctggaaactcaaagggtgggcaggargtggagtgtgtgcctgcttcccttccytrtcttgtcctggaaactcaaagggtaggcaggaagtggagtgtgtgcctgcttcccttccctgtcttgtcctggaaactcaaagggtgggcaggaagtggagtgtgtgcctgcttcccttccctgtcttgtcctggaaactcaaagggtgggcaggaagtggagtgtgtgcctgcttcccttccctgtcttgtcctggaaactcaaagggtgggcaggaagtggagtgtgtgcctgcttcccttccctgtcttgtcctggaaactcaaagggtgggcaggargtggagtgtgtgcctgcttcccttccctgtcttgtcctggaaactcaaagggtgggcaggaggtggagtgtgtgcctgcttcccttccctgtcttgtcctggaaactcagcagttgtggcatcccatccgtggagaaagcaagccccctgccccggcaggctcggttgtttttatcagcaatgaaattcagagatagactttctcagcttagctctcaacccatccctctcgggcactgggagtgtacagagatggccatgccaaatttaaagccatgtaatgtcgactggaccaaatgagtatccttctaagggcacctagaaattctcagcctaacatccatcacgaactctggcaggggatgagggtgtctttctctgtgggccctcatgttcgctttcagagacagcgggtcagaaaaacccatcccgctgctgcagcagctgtggggttaggaagttgggtccttcctgatgtgcccactgcagaccctcccactaggtctgctcagtgcatgtagctacacaagatgggcagcatccaggctgaaccctgctgggaggactagcacagggatgctctgggaagcagaaagacgatttgtagtggcactctctcatgcctctcttatttagagaggaaaataagcaccctgtgattctgttgtaaaaagagcaaactaagcatgttcaccctaaaaacaagtgtaagcgcaaccttttctttctacaaaaccagcttctgggcatcagaggaagatgagagggaattgtcattgataagggcctctttgttccgggtcctatgtagacatcatctcattggaccctcaccacagccctgcaaggaggccaatggarctatcctcatcttgcagatgaagaaaccgagctttccaggagcacccttctgatttgaataggccacagaattccagttaatgtgtctgtctgctgcctattagatggtgatgtttctgtgataggctgggcttttgtagcctgtagctttgaaaatccctaaacgttttttgggggggccgtttatccaaatgttcagaatgtacctgtatggcttttccaactcactccttcttggggctctccccctgtacctcctctaggtgcgcccacctcgtccacatgttgttaagagaccaaagagcaacatcgcagtggaaggccggaggacgtctgtgccgagccctgagcagtgagtattgtgcctctcccctctgtctgtaagaaccctgtgtctgcggagccagcactttgcgaagcccaagcgtgtagccccggcctttgtgaggcttccccggggctcccagcgggtgtttcacaaaggggtcattcagggaacaggacttgatcttttactcggtctggttgtcacaccagtgggaggccccagaggccagggagccgggcacttgggctggatttcgaggggtggggtccaaagcatactttgctgggttcagaagaaggtcctaggcctcttgtgctgaagatgccgagtcagtaggtgagggttagaacctggtgaaggaggccaagtgttgaactggatccacccaccttcctaggcctccatggccgagaacctatatacaggactgccctcatccactgccccagacccaccaggaccctttgcccacctgtgccggaggatttatgttactgtggtttttcttacccatctccctgagacgcggagctccctgggtgttatgcccagcacctcccgtaggactggcctagagtcacctgctcaggaggcgtggggtagatgaagtgaatgaggggggcagaaagacaagcagtggactgaagtggacctgcctgtggtggggtgaggcagaaggctgcagatagccccgagtccagaccagagccatctgcagaaggtagcactgcttccctttgtccgcaaaaggagcacagccctcagtctctatccagacaactcagcggctacacgctgacttcctgtgatgccttgaaaaagtgcatgagttcgtcttggtctaggattgttggaggagtcagaaaaactaccccagggatcctgaagtcctttgggtggaaagggggaggcccccatgtctgtctggctctcagaaaatgggaaagaaggtaagggacatggcaggtcccagtcagagttggagcaagaaggaaaaaaaatgatttcgagctgtcaagctggggcctaacccaagttgcagttcacttcagctctccaggattttctggttgatagcgagggtacggtctttaaggaaccagcccacccagacagccctcagactttgcccagaaagttccggaattatatgtgtgcgtgcgtgtgtgtgtgtgtgtgtgtgcacgtgtgcgcttgcacacaaggatgctcagttattagacatttggaagagaggactcctgaagctgggttaagtttaacttttgctctgcacaatagcctggtgggaacatgagggatggattatgattgcccccttatggagagaacgctgcatggcacctgagtgcctcggactaaagattcctccttaaggggatgaaatttgtcacatttctttgaagtcccctctttaaaactggactaaaccttttagacactgtaccaggatacagggtcacaggcctgttgatattgagatgtaaacccagaatattcttgcattacacagaaacaccattgcaacaccagctacactccacatcctacagaaaagcattacccattttgcggccaagttcccgacgagaggctggacctcttcatcacattgacttacgccgttgcttttccagactgggcagaggggctgacttcgcagtgtgtgccaaagagccggtgtctgataatcccattttcctgcttatcacctgaactgtgtcagtatcacttttagttttgttggttggttggtttgttgtttgtttaatatgccctgttttctacttctgttggaaaatatttggggttgaaataaaccagtgggagcatgggagccagtttggtggttggcaaactaccagtgatagaaaacaaatgacaggttttctgtgagcgtacgtcacagtggctcgggcccacaaggagacagaggggtacgtttcaggacatcattccaagggtttctgttcacgtttgtttaacgaggaaggggaagttgttctcccataataccagtggtatttctagtgcaacccgggtgtttttctacgcctcttcccatgctgcttccccacccccccactgtgctccgccccttccaaatgccatgtcacaacagcacttggatgtgtttttctcaactgtcatcagctccagctggcaggaccaacttcttgaaacacaggaagcatccagcggaaaatattttaataaaacagactcctcataaaatattgttcgggggagggggaagaaaccggctccaccaatctgtcggcattgtattgggagatgtgagaagccaggctggcagcaggggcccgatcctaatgggcctttgtcaggtggtggttccgtgttgggcacacggacttggtgcctggccctttaatctggcctgggttttcttgaatcacagatcttcatctccactgggaatatcaaagtgcttgggaaacttagaagactggggcagcagaaggggatgcaggatctttgaagtggagaggagagattcattcctcctgacttcttgccccaactctcacttccaattgcacattaaataatcccagcactttgggaggccaaggcgagcggatcacctgaggtcaggggttcgagaccagcctgggcaacatggcgaaaccccgtctctactaaaaatacaaaaattagccgagtgtggtggcgcacccctgtaattccagctactcgggaggctgaggcatgagaatcacttgaacccaggaggcggaggctgccgtgagctgagatcacaccaccacactccagcctgtgcaacagagtgagactctgtctcaaaaataaaataaccagctttgtggacagcaagatggggctgattaagagtaagactgtctcctggagtagctgagcatcctgggactcatcagggcccagaaacactagccagccactctctggccagtccacccctgaagttcatttcttccttcccagctgatgtccatccctccatcattccatctgtccattcgtgcattcattcattcagcaagtatctttgaaaacctactaggcgcaagcacggacgatttttttaaaggaggccttaaaagggagtccccatgctgactcttggttgacttgcattttcccaaaatgaaattttcctgtgtcaaattttctttctgaatcaatgataggtttcctagtcccttaaaactggccgttggcaattggaagaagacttttttgaagatttgtgggggaaacattccctttacttttcaggtaacattacttggttaatattcagttactaaatctcttcaagaagtactggctacttccattactattcagagcacagctgatgtgacgcccaggggcttccgtggggcagggatcggggtaggagggatcctgcatgagaggctgtgggtcagacaccagtcagcagggggcgcggtggagcacccattgatttctaggycctcttgggctagcatcgtttcttcccgagtgggagctcaggcccagaatgtggatttgaccagtcttcccaaggtcacccagttgaaaagtggccaggccagcattcagaattcttgatttcattctctccatgacattctgatgctgtccttggaacggggcccttcagggttcatctttagtctggctttgcccagagagacagctccacatcctaaaatgagatgatggcctgcccagcaggccacccttcctctctggctccctgaaggctggagttgggaaccggatctgttcagtcttctcaccgccaaagaaaccatgtgcactggtgcctgagtgtttcttcttggggaaggaaagaggaatgacattcaccaacatcccttaaggttgtcagaggtattagccgggcatggtggcgtgtacctgtagtcccagctagtcgggaggctgaggcatgagaattgcatgagccctggggagttgaaggttgcagtgagctgagatcatgacactgcacaccaccctgggcctcagagcgagaccctatctcaaaaaataaaataaaaaagattgtcaaaggtaggtggtagctttcccattgaacagacagaaaaactgaggctcagagagactttcataacttgcccaaggtttctcagggccagaaaatggtaggatcggctgtctgatgacagaagcctggtccattcttctctactctccaggctttttgttaagacctaattatcctcacgtgcttctctgactggtggggacgacggctacggcagtgagcacagtgaggttcacagctcccctcctattaaaagcaggccacggccgggcgcggtggctcacacctgtaatcccagcaccttgggaggccsaggcgggcgggtcacttgaggtcaggagttcaagaccagcctggctaacatggcgaaaccccgtctctactaaaaacacaaaaaattagctgggtgtggtgatacatgcttgtaatcccagttactagggaggctgaggcaggagaatcgcttgaacctaggaggtggagcttgcagtgagccgagatcacaccattgcactccagcctgagtaacagaacgagactctgtctccaaaaaaaaaaaaaaatgctgtgtggtggtttccatggggtgcgcacagctgcgaggccccaagttatcttccttttggtctgccaggtataggtaaattgcccatccaactgggtgcwtagaaagagccaatggtggccgggcgcggtggctcacgcctgttatcccagcactttgggaggccgaggcgggcggatcacgagrtcaggagatcragaccatcctggctaacacagtgaaaccccgtctctactaaaaaaaatacaaaaaattagccgggcatggtggtggatccctgtagtcccagctactcaggaggctgaggcaggagaatggcgtgaacccgggaggtggagctggcagtgagccgagatcgcaccactgcactctagcctgggtgacagagtgagacgccgtctcaaataaaaaagaaaaagaaaaaaaaaagccaatggcaggctctgaaaggcagcactgtggtctgagccgccgggcccctcatgatggcacactgtgtgcagactaaggccaaggcagggagtgacacactgatcccggggtgcatctctctgccaggcagctagtcatttgttccctgctgggaagtggcagtaggggctggggcactggccctcacagagttgctgagagtatggagggagataattacaggcatctgccacctgtttaatcttcacagcccagatgtagggctgtcttctgagtcttaagggttaaggggcttgcagctggttgtggatctgaggtgcccctcctgacaacctgcatgcagagccaagtgctttcgactgcacaccttgtctcctaatgggtgagacactgaacactctccagtcacacgagggtcttgactggctgcatcctggttatttgaagttccactgtactaagtaagaagggtccaaactcagccaccagggcccagggctgctgcccagctcacttctctggccagatccgtgcaaaatctgctcttttcaggtaatttttggtttgtaaaaattacccggtagcctgatagacaatctggaatgttagggaaaagagacaaattcattctgaatcccattactttcattccactacatattagcattcctggagatccatgcccagtctttatcctgcatgtcttttatagagctgcaacttccttgcaatatgccagcatgtggacttgttccgtgtgtctctgtaacccctattgtctgtgactgcagaggatctcattgtgtgtatgctcatggtctgcctaactattgccctcatactggatctttagatcctttccaggttttcattaatataaaaaatgccagggtaaatatccttattctaggctgggcacggtggctcatgcttgtatcccagtactttgggaggccaaggtgggtggatcacttgaggtcaggagttcgacaccagcctggccaacatggcaaaactccgtctctactaaacatacaaaaatcagccggtcttggttgcacacacttataatctcagctactcggaagcctgaggcaggagaatcatttgaacccaggaggcagagtttgcagggaacagagatcatgccactgccctccagcctgggcaacagagtgagactctaaaaaaaaagaaaaaggaaacggaattattgacaactcccattaactgggaatgtgctaagcactttacatacaccatttcattgaatcctcacaagaaatatgtagggggaggtcttatgagatctattttatagaaatagctgagacttcaagagattgtcactgcccttggtcacacagctagttagtagcagacctgagcctcaaacatgccttgttaagaccaaaagcctttacccttaaccagttgtaagaagatttctgctccatattgctatataactttctgaagaattgtaccaccttataccctcaccagaactggactcccggacatctgattctgagggacccagagaaacatgtgactggcattcaaacatgtgtccgaatccttctggacaaggaaaacttctgtaggccatgctagctaggtagacagtctctaccccaaatgcctgacccttgctgcctaggaattggagtgtctgatcctctgaattgcactgcgtgaccccagcaccaaagccccagaagattaaaataagatcagaagaagctgccagaagcatttagtgagaaaaccccgcccgaagcccaggtctcagaacactttgcaagggactctggacactcacacacatgctctggcaaaagctggcgtgccgcttgtgcacgttcaacggccttgccctcctcgagcctagactcagcatagcctcagcagatcagttgctcccagctgtggatcacacaggggtagagcactttccctcctgcacagccccactgctgccctgggggcgtgggcccatcatttggatggcggcctggtgcatgggcagagctctggcatccaacaggcctgagtcagcctcctggcccaccaggcaccagcctggaggctatgggcatgtctcctggtcctcctttcttaacatgatgcctattaacatctccaggagcgtggctggggaaaaggcccacagtaggcactggcatcctgagtgagcagagcgcgtggcctccctcctggccttatctcagcactccgacaccccaacacctcccccacgaaccacccactctcctccctcccacgcccacaatcccctgtgcgtctcctgatctggcggtgaccggccatgttgtagctttctctttgtctcacacgcgcgcacacacacacacacacaccaggcacaccagtagtctgtgagctcttcctcagctttgactctccaactcctggaccacatccgagcccagacctctgctctgagatgtttcctgggtgaatgaacaaaggaatctgaaggcagagtgcggcttgcagtcaagcacctgggaggcggggtaggggcgtccggtaacaaccacaaacaggtaaagagcacctactgtgtgccaggtgtgattaggacgtgcgtatgaagctgccagtgcatccccagccctctaagagccaggaactgtgctcagccccaggagcaagtctccaagatgccagctgggccctcggccccagggggtaggggcagctgtctgggctctaccccctggcaggctgccagggcccactcccttagcagccagctatgcaaacacatgagcagaaggtcacagacccaattagcagggctagaggcctctcactctcactctctctctctctctctgtcacacacacacacacacacacacacagagagagagagagagtagattctgggccctggagacaaaaccaagcctaaagccagccgtggagcctgagcctaaactggaagagcaggaagtgccaagaatacctcacttctgcccacccaggatccccccaaggatctgcagcagccccggaagacacgggacccatttgtctgtcgcctcttctgcctggcaaatcagagggaaggacttttcccaggagctgtcaccacagggagttaactggaaaccaagccttggggatgctttaggaacaggggcctcatcctcaagacatgactgatttcagtcacccctgaaaggctttgccttcccacctagccctctgcctcttccagatgccacatcgccatttctcaactgcctgtttkgtgcccagcaatttcacacgtgttgtcttggctaagctccctgctccccaaaaaatcttcgcagcctgggcattcagccatgagggagccacggctgtagccagtggaatgacgtaccctcagtccaggatgtgcacccgggcagccaggtcccacagccactactttcttgcccccaccactgctcccacagttcccagaactcagtctccagatctgggctccaggatgcagaggctgtcctcagggtgaggggcaggtgttctgcacagtgcctcttccctgcagaggaaagtgcccccaaggcattcccagccccatcttccctccaccgcagagcctgaagcccacatcctgtgctggggccactgcctatgtgagtgtccagccagtggtcgtggaagggcttctcgggcatgctggggcacrggtatggatgtgtgaaattggcattcatgatttttgttgaaagaaggaaggagtgaacctacagactgagaagtaatcaaataaatgcccgaataaaggctgaagaagccaagggcataacccaagagagggggatgggcagccaggcatgcttcctgcttgactgcagccaccccaaggccttgcaccacccccagacttgcacgtcacctctcatccttgcgctggctccaggccctccacgacctggtccctgccaacctccagcctcttctcttgaactccccacccggacatggagttccctgtgcctgcccctctcggagatgcctccaggtcattatgatcctctcccatgctcaggattaaaagtccagctctggccaggcgctttgggaggccgaggcggatggattgcctaagtttaggagttcaagaccagcctaggcaacatggtgaaaccccatctctactaaaataaaaaataaaaaaaatagccaggcatggtagcacatgcctatagtcccagctactctggaggctgaggcaggagaatcgcttgaacacatgaggcggaggttgcagtgagccgagattgtgccactgcactccagcctgggcaacagagtgagactccgtctcaaaaaaaaaaaaaagtctggctcccacatcacctcccaaatggagccttgtccaagagcccttgagccaggcacgcccccaccattgtcctccggcaaagcaagtccccagtggggcgggaaggacctggtatctcacactcacccatctctcccacctcccctaaaccagttcactggacaggcagaacaggcagascatgctggtgatcgtgacttgtggcaacaagaattcttatcgtcgttgcttttaagtagatattcacctgcaactgagtttacaggttcctatgtacagtagcttcctctgtctccattgcttcctccctgagaacagtcctagcccttatcctgggtcgcacagagaacagctccagtctaattccagagtttcttctatggggcgtgtgccactgtgtacccccagagaccctgcagtcttggttcagagccaccttcttttttttttttttatttttttaagatgmggtctagctgtgttgcccaggctggcctggaactcctgggctgaagcaatcctcccacctcagcctcttgagtagctggaacttcagagattcctttgctgtggaatctctggcaggagacgggggttcccagatgattctgatgtgctgacatacattcagctgaggaccactaaccatgcctggaaagttctgggaaggcagggactgccttactcatccttgaacacctaggaaagacccygcacaggakacagatgcccagaatctacttgttggcaggtgaatgtggcatgtggacagtagtggattagtcactgtgtgctcagcaccatgcaaagccctttacgaatacgtgcatttaagttttcccataagactctcaggagggctacagaatctccattttacagataagaaaataaggttgcaaagatgtggaaccagcccaaaggcccatcaatcagcaagtggataaagaaactgtggtatatctatgatggaatactactcagtcataaaaaggaatgaattaatggcatccacagcaacctggatgggattggagactcttattctcagtgaagtaactcaggaatggaaaaccaaacatcatatgttctcactcataagtgggaactaagctttgaggatgcaaaggcgtaagaatgacataagggactctggggcctcggcagggaaagggtaggaagggggtgagggataaaagattacaaattgggttcagtgtacactgctcgggcgatgggtgcaccaaaatctcacaaatcacagctgaagaaattactcatgtatccgaataccacctgttccccaaaaacctatggaaatagaaaattaaacaagaaagttaggttcagggagatgaagtgacttttccaaggtagcctgactaggaaggggagggtagtggatggttagacagactggcacccaccggacaggcaggacctagcctcaccctgggggctgtccctgctcgtcagcacctgcccactggagccaygtgacagagggacacagcgtagccaagacatttacaaagcgaggatcctttgtgcctgagtgaagtgatcctttcaaaaatgatcaccagctccccttcaccacctccggagaccaagtcctggctgatttttccccgtctttatctcaagtacatttaaatgtcaattaaatttgaaatatctacatttgtcagcatttcattttgggccagcgtgacgtgctgctgatttgtccacgcgatgtgacacatraaaaaaactcccgagatgcagatcttcctcattaaaaaataagccggtgcgatcccggcgcggcagagagcatggagcacgtccctgcttcctgacgccgtgtctctgacatggtatttaaaaaggaacagcctcgcctgtcaccactgtcacacgcgcgcgctaaccrgcgacacgttaaaccaaacattagaaggggttcgggaagtcatctgcatgggaactccacgcggagacaaggtgggcagaggcgggagcagccgtgggggatgatggggtctgatccatgacggacggccagcctttcttctgcaccaagactctggcagccctcgctgggcagccaagtttgccgcaacctgccttttcacagacagctctttgtgtgtaataaaatccaggcaagtggtgggtggcagaccgcaggggagtagctgaattgggttaatgagggaaaaggtgctttttttttttttttttttyycatattctgccttaagctaataaaaartttaagcctggacgttttcgatggttcatcctttatctctgacaaatatctgactgtatgtttcatgggagaacatgggyagctgaatttaagtaagtttattttgaaacctcacctttcattaaaagtaaaagaggaaacaccctatctcttatttcgttgtttctgacccagaaaactgaagaggcaagatcccgtagtggttgaaagttggcaaatccacattcagttcctagctctaccttkagctgctgtgtgaccctgggcaagtgactccccctctctgagccttggctactttgtctgcaaaatggggttgcagtaaagaattcatgagaaattgtatggacagcatttcgcccaaggcttgtaagtatygccatccatgtggcctggactcgacaaagctctgatctgaccacatcagatgacaaacttctcacctggatgtaccctgccactttcaagagacaggtggtgtattctggagacagctaggcctcctgtggaaatcactgcccaaccagcctggctcagccagtacatccaactggagaaggaaagtggctcctgaactggaaactgcggttccctctcttcccccgcccaccacagtcacaccagtgtggaagcccccagccccctccaccatcacagcagtgtgggcagcgctggattgtgacagtggcctgaactgcggcagytggatttagcaaagccagggcayagcccagcgcagaggttcctcgctcctgggtgaagccggaaattcctggcaggttcagtggcgttgcaccaacgtgtcaagctgtgatctgtgctctcttgtcagagccagaggtgggggcccgtgcttggataggtgtcggaaaggcaaccaaggtggacgtgagggcgactggagagcctccctccatttggcccgagccggggctggtgtcccctcgtgtgcatctactccgagccccgctcacaggagagggtgaggcccctgggggtggaccatccgggctgcagtccctgttctccacttcttggccacgtggtcacctcttcaccagtgatgccccagtgcacagctagcctgggtctgctcacaccargtaggctcaaagcgcctcttggttgggtgcacagatggacagatggatgggtggactcatgaagccctcaccctctagaaaatcagtattgcgacaccttcttgttaggctcttgtgaggggtagaagtggcctctataaagcacggtacctgcttgttgatatcattttaaacactttctgcctgcccctacctacctgacaccctcaccttcaaacatcgtcccattcttcacatcttagcatctcagaacagatgggagcccagagggggagcacttttgtaccacagccacagtctggggaaaggggacagtgtggtgcagctccaggaagatggtaaagtgggggttcccccagcaggctggctttcattcattcgcaaacttccacagcattcatgctgtaccccagctggggagaaagagaagaacaaggcaggccctgcccttgaggaacttgactcagaaacagagtgrcaagaggttaaatggtatctatgaagtgcgaagaggcacagccagggagctctcctagcctccagtgggcttcgtagaagtcccgctgagctgagtcttcaagacggcagagcagtcagtgctccaagcaaaggtgacagggagggggaatatccagggcccagtgtggtcaaagayggtaagcatggccgcaggggaggccaggagagggccacagaggtaggtagagccaacacacagcatggagactgccctgctcggagctcggcacggccgctcagcagtgcatcccacgagctccccagagtgcagcagaagcccacggcctgcgcaccctctgcccctcacctgctcaggagagcagtcagtgctgcagagtgagagtgggctccccctcactttgaaacaagtccctgcaaatgtctgaacattattattcctaaccctttgctccacagatttatttactcaccataccaccaactgcagcaagatcacaattcagaatggcagatttataggttttagcaggagagtgacaagtgtgggtttgtgattgaaagagactctggtggctgtatggagggtagcctttctgctctgtcttctttgctgtggaagtggcaggagccaggtggtgccctggccccgagattcctgcaagtcaggtcttcctgacctgtccactgaggcgggaaaatgccccctggaccagagccccctcgagtccaggaagggctgagttgtgtcttgccccgacagccagcaaggcagcctgggagcagagaaaagcccagcactgggactcgctgcctcctgttgtgtaaccctgggctactggcttcccctcctgagcctcaacctccactgcagttcgaggacaaaactctttgcctggccagcctctgggaggaagtgagcgttctgatgtgcaagtgctgggatgggcaccagccctggcggattgcagcaaagtgcaggcacaggccacctgccccgtccccctgcgcagccactgtctctcactcaccctccagctgtggttctcatgtcctttttttggacacgttgccctttcctgaaataaaccctcaaaagaattctagcatacagagcagagaagggagacggctttagctgggggctggggggtgaggggagaggaggtagcccatgccagcccccgtgccccacattctccccagacttcactcgcctcagagcaagccagcccacagaatggggcaggggtgtggaacaccccgggtctgctcacaccaagcaggctcaaagtgcctcttggtggggtgcacagagacacctactccccagcacaagggccgggatttgaacccagatctgcctggtccagctcgcccctgctgagcacatggcctctggtgggccctggtcagtatataattcatgggagccgggcgtggagtttctccaggctgtgtatgtgttggtgtttatagaggtagagctcacaggtggctgacaagggagatgcattttttataacaatgaatatttaatttccacatcacagatgaaaaagactctctgaagaggcatctgagggaagctccagagagcagcygctaatcagaaaagggccttctcgcgagagctcttccgcacggctcacttttttcttgaacttttttattttttatttcttcctgcttattggaatagatatgctcattgtagaaaatgtataagacacagaaaaataaaaagcagcagaggggaaagaaatcacccatgattccactggctgttattgacgtttagccatgaacctttccagtcttttttctatgaatttttccataagcagatgacagcgaatgtggtgtgattgcagttctgcatcctgatctttaaatttgtcttcataaacattacgtttcatgggaggacaagattcagccactgcaccagctagttgttgctgacagtgtaggttgttccatgttttaatattataaacagcagtgatgacaatcttccagtgtgattctttgccaactttgagggttaaccaaatggaagtggaattactaggtcctatgtgatggatcatgagtttaaggctctggacacgtggcaaatttagtttcttttctatctggaacgagcttcctctcctgagagcccccaccccaggctggcacacagaggcagggccaggcgtggagcccagaggcctgcttcccgcctgcacgtgaagttctgagggcgcccctaactgcctgttctcttctcttttgtcttcctctgccccagcctggtaaagcccttgcgacactatgcggtcttcctctccgaagactcctctgatgatgaatgccagcgggaagagggcccgagctctggcttcaccgagagctttttcttctccgctccctttgaatggtctctccttccttcttccatttccctgagctcggcttggtgactctgcggggctgcatggcgaaagcggggggctggtgctgcttgcctttgtgtcggggggagggtgtctggagctgctgcctgccggtgccccagtgccaacatgcagggtggacaccacctctgcgtgccacctctcagggcatccgttttgccagctccacagaggctgtgacaatagagaggtgacagggtgatacgcgagcattggtccccttagagatgaaatgtgcttgattgctagtggaactggtgactacaattagcctggttgttgatctccaagtccttctttatctcagcacatcttggaaagccatggagatgggaatcagagtttaagttaaaaaagaaaacgttcctcatatgaaatgtgtatattaaatgccagcctatccaagtgttctgatctgcctgactttttaaagataatttaatcattattatttatagcctaagcctcataccaattacaagtagcgatttttaaaagtttcacccaccatccagccacccctaagattaagctgctgtcgccctccttcctttacccgttcttgcccctccacccacaagtgtttcagagctggcattgagcagagagacagcttttgtctgtctgcccttgttaacacggttatgtgtttttaatgggagcctttaagggaatggaaactgccctttgcgggatgcccgtggtgcccacagcaaccttccagggggcacgttaatcgttttggtcattgcacagaagagagatgcctttccctccctctccctcatgtcccctgcaccctctccctgttcccaaaccccagcatcaggtccctccccctgggatggcctgtgggttcctctggggaccttataaaccccaggctgcttggccctctgtcattgaccccacagggtcagagggtcctgatcctttcctgccagcaggtcactggggacccagacaagtcactcccctcccagtgtcctcacttagaaagtagtggccttgccaagcgcagtggctcacacctgtaatcccagcactttgggaggccaaagcgggcrgatcacttgaagccaggagttcgagaccagcctggccaacatggtgaaaccccatcattacttaaaaactacaaaaattagctgggcatggtggctcacacctgtaatcccagctactcaggaggctgaggcacgagaatcacttgaacccgggaggtggaggttgcagtgagccgagatcacactgctgtactccaacctgggtgacagaacgagactctgcctttaaaaaaaaaaaaaaaaagaaagaaaagaaagtagtggcctaagctggtgtcatccaagcatcacacgtcacttttgctgtatgtcaaatctttgtttcgattttttttcaaaagattttaaaattagccttctcctaagcaataatatctatgatgtcataggcgtaatgtattagttattatttctgttgctaattagaacaaaaagagaacctttagcataagaaatgttcatctatgtgtcaatttaaaacaccttttgggaaaaggcaccctgctcccagccaggagtccaccaggtcatgtccaaggcccagctccatcatatcgtctctgaactaactgrcgccttaattatttaaataacggcgagggctcgcttccttagcccatgaccttagaagtcagtacaggcctttgtgtgtgtgtttgaaaagaaactagcccatcctaactcaaaatgggctcaaaagaacactatttcctgaagttccagaagcacactgactgactttaaccctttcattgtgctcatctttattaaagggtctctaattccttggtcagggtgagtgagggacgtttgaagcctctcaagcttggcttccatttccacctcttgcgggtgctgtgtgacataggtgagttatttaacatctctgagcttcattcctcatccataaggtgggggtgtaagtccgacttcctggcctgcttgcattgcttcagcgagagagtacatgatggagtccctgcccatcactgggactgtttgatgagccctcccatgtcccccaccctggtgccttcactgtgatcctacccttgaccgccaggtggtgcccttcccccactttaccagtgccacgggcaccatctccgcctgacgtagggccaccaccagccccagacttggggttagaagaggtgagatgtggccaggcgcaatggctcacacctgtaatctcagcactttgggaggctgaggcgggcagatcacgaggtcaggagttcgagaccagcctggccaacatagtgaaaccccgtctctactaaaaatacaaaaaattagccaggcaaaaggcaggagcctgtaattccagctactcaggaggctaaggcaagagaattgcttgaacctgggaggcagaggttgcagtgagccgagactgcgccattgcactccagcctgggagacaagagtgaaactccgtctgaaaaataaaaatataaaaaasgctagatgcacttcccactggggctccactagaggtaagggttgacccaggcgctgcctctccatctacccagtggtgccctgggactcaggtccatgggaagggaaggcaagtggaaccctttgttaactatacttggatcagctgcaaagtagtggtgtggggttttttgtttgtttttttgttttgttttgttttttgcttttttgttttgagacagggtctcgctctgtcgcctaggctggagtgcagtgttgtgatcttggctcactgcaacctccacctcccaggttcaagcaattcccatgcctcagccacccgagtagctgagactacaggcacgcaccaccacaccccgcaaatttttgtgtttttaatagagacagggtttcaccatgttggtcaggctggtctcgaactcctgaactcaagtgatccgcccgcctcggcctcccaaagtgctgggattacaggcgtgagccaccgtgcccagccaatgactgcaaggttttgaatgtgtaaaagtacagaaagctgctagcagaagagcctgtgtgacagccgtgctcactggtgggcgatggatgctgtaaccaacccgtgcgtgtctgctgtgtgccgggcaccgcatttgctcatgtaaccaccaccaccacctgagcacctgaggctcagagagttaagtgacctgccaaaggtcccacagcaagaaatagcatgaccagaggtggaaccaaggttagcagggcaagcttaggcccagacagctcccctggagagcttccccagcccagttccccatgggctgttcacagaacctgactgtggctgtgcctaggccaccaaacaaacagcagagcagggcgggagcaagaggagcatgactgctggcctgtgagcccccttccagtcctgtctgttcctcacaccttgtctgaatggctcacaagcccagtagccagttttatgaaaggacctgtagtttggggggcactaaatgggtcccctgagtgcaagtgagagccaaagcgagttgccctggttcacagccccaggcccatcggcatgcccagcttgcaccctcgcagcctcccagactcctgccctcacggagaccccgggacactctcctgtcccgcaggcccctgcgtgcacccctcaagccctcaatgtgcttgggctggagtccgcttgctcctcccctgaaggcctgggtgggagagtgcagcctgctctgtccccsacaggccgcagccgtatcggacactcagggagtcagacagcgcggaaggcgacgaggcrgagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcaggtatggcatgggcaagggagggtatckgccgggggccggcactgtccgcacacgaggtgggatccccatgtgacagtggaagagactaagggagaaacagtgactttccaagaccctcagccaatgctcagggtcagtgtgactgtaaacacctcccagggtgccggggcccacaccaccctaacagtgacggtaggagaagatgctagagcccgatggaaacttgccccactctgtgtgtgcatcagacgggggggcgggtgctgccagccactctcctcgcacccccaggcagggctgcagcccctgctggaaccgggattgcgtccatccctgccagggctccttggcagagcctgtggatgcaagttcttggctctgcattatgaatgcaaatcagtgtgtaattcccactgtgacgtctaatccatcacatccccgctcggtgcctcagtttcctcacttgcaagtggggtcttctgactttgcatcactgggtcacaccgtggggttcacagagctccagtcattcatgagtgttccctgctgggaacgaggacctgggccaggagaaagggactggcacccgggccgtgtggcttgcaagtggcagagccaggactccaacttggcctcctccttcctccccagccaaggtgcctcctaccaggccctgagtctcactcgcgcccccgggcttacaggtgattgcgggtgcctgcgatctaaaaagtaaaaagggccagccggtagctggagtcactttcctaaaactccttggcaaccgccactggcataaagggacgagagctttgtcttgagttcccggagcacaggcttggagtcccagcacacgtgggtcctctgctggtaacctgggggagccctcagctgttccaagtccgaggagctgatcagccacacaactaggmccagcacacattcagcacacagaagtggtgtgggaatgggcacacatatgtcccaactcagcccgtggtcactgccgccctccttccctcccaacagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcrgccctgctcggraactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccaytgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctkctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaagaggctggcatccccgtgtccttgaagcttttgggtcggggaggccccacacgggcccggagccatcctcaccacctgctcctgtagaggcaggggccaggcgcagagcagttagggaaggagtcaactccccgcaccctcccaagccggtgcccactcagggctctaagccagctcatgctctgcccctcacagaccaggcacggggytgggctggcaacaggcctgctcagccctgcgggggccatggggcagactgcaggcctccaacgacgttgagggcacccaggagccaggaaagagttcaaggggacacctggcaagtcgcccccacaggtctctcattagcaagaacagagcctgggactctgcctctgttggacgctggtgtttgcggggaggcgggcgggggaatgcagaccaatcgaccaccccatagtgagcgtggaacatgcccagtcacaccacccaccccctccgactcgcccatcatctgaccatgcccccacttgcaggactgactgacaggctgaaaacgacaggcacgcgggccgggcgcggtggctcacacctgtcatcccacacctataatcccaacattttgggaggccggggcaggtggatcacgaggtcggtcaggagttcaagaccagcctggccaagatggtgaagccccgtctctactaaaagcaggcacctgtaatcccagctactccagaggctgaggcagggaattgcttgaacctgggaggcggaggttgcagtgagccgagatctcgccactgcactccagcctgggtgacagaactagactccatctcaaaaaaaaaaaaaaaaaaaaaaaaaaamaaaaacaggcmcccgaacccacaggagccaggaagaggacaggggacagccagctttcatctgcatgttaggttccacataaaatatcctaggagttacagctgacacaggttttccaaatctctaacttagtaaactgaccctggaaccagccgcctcctccccacgctcccaagggttgtagagaaagttcagggaaaggtggtcccacctcctacaggataaggaccaagcaagcccctgagcctggtgttcagggccctctctatcccagcgtctgctgacttcccagtcccatgtcccagtcccccacgttgtcaygtggctccccacattggactggacacccatgcctctgggacccgccaaaaccaaaaggaaaagctgactgtcgacccaaaagtgtaaacggatctactggcctgggaagcaggaaggatgaaagggcacatctccaggtccatgaagctggaaggaggccaggccctcaggcaggtgcccttcagggatgggaggtcacagtgtgatgggcatcgccggggaaggggctgggagcaagcagcagagtctcctctgagtcggcctctgcaggcccagccccgactcagaggcagcgccagtgttcactgagcccctgtactcagcagacaacccagagggcttccttcaagtcctctcgccgagtctgtgtagaggcagccagtcatcaggggaaggagtgagctcaccaggctgctaggaaggaccggagctggagaaccagaggtrgtcaggtgagctgggggggttcagggcaggagaagggttgctctgtcatcctcatcccagaaggacacccagacggtccttcccatcagacggcagttgaagacttccagattctttccccactgtcgtcctctctgatcctcacaacagccctgtgaggtaggcagtgggtgccttccccctttgacaaatgaccacagcagggtgggaagctccaggcagcccctcctctgctccctcgggctgctccggctgagggggcgggtgggtctgtggttccctcgcatgactggctctggcttctggcagacagacctgcctgaagggacatttgttctaggagccagaagcccactcagcctctgctagtggccttccctgacttcccagctgcctccacagcaggagcagcccccagaggcggggaaggaggtgcctgggcaaccccggcctggcctcctggagaacatgcagccttgggccgcccctgccctaggactgtaatggttgaccccatggcgcagccgccacctcctgggatcagctacacccatcacagtcatagacacacagtaaacacggcagacacgccctggagccatgtcaggacacactcacactagcatctgcagactaacacaggcccaggtacacactcacacacacactcctccagatacacacactcctgaacacactgtgaacccacgtgtgccctcccacgcacagccgtacacctgccaaggcggaaccccgagggtgggatggagaagtccgcagcctctctaggcctctgtttccctgagttgctcccctcgtcctccatccaggatggggcagaggcagaggcagaggctgccagccaaggggacacttccgtagcaatgtcccgagccctggaagcagcttccttgggtctccaggtagaaaccattcaggacctccaggtgctggtgccagcagccaggctggcctagatgagtctctcctccggtggcaccttgaggacactgtccatctccagccgggccccagccacctcctgctggcttgggctgtaggtgccctcagactggcggcgctttcgggctgccaggatccctgaaaggaggcccaggaggaggaggaggaggcaggcacaggctgcaggtacggccacctccagcagtgggaatggcagcggcaggggcaggcccttctgcaagagacacgacaccgaggcctaagaccgcagagaaggggaggacgccggggccctcagagagcagagagcgcagcacaaggacctactcagagaaaatcagagctgggagcaggctgccctgggagcagtgaagacccagccccaggggtgtgcaggcaagtgccaggaaaccacctgtcacagccactgctcggggaggcctatacaacaaaggagttctggctagaaggacagagatgggcgtttattgaacacccggcaggagctaagcagggtgcatgggtttcacagaagcctacgagggtctcatgaggcagagcaggagcaggggcaggctgagcggccccctgccacaatagcaaggtcagaatccactggggcccacctgcgggggcagggtggcaggggggccgaggggctgttatgacagcttgtccctgcgagcctcggcccaggcttcggggagcccagcaaacctccctggtgtctccagtcacaggctcccaggattccccatcaaagcctctacatgcctgggactctgtagtcccaggatgcgaggattccagaggcatgggctctgggactcaccagcctccctctgtacctccaggcttcccagcccactgtgacctgggtcctaaaacttgacaggaaagttcctctggtcctgagagggtcctgccagcctccaccgttggacattttgagggaggagctgtaaagccatttcctccccctgccctggggaggtggctgggtagggaagccagaggctgtaaaagttcaacttgaaaggaaacattccccgtaagcggaggggatttgtggtttatgacccaggctgccagaagcctgtggagatcaaggctgctccccagacttcccttccaagcctctcctcgccagcacccactccccccaccccgccccaggaaggggtgtggcggggaggttcacagctccagcgcctgctgccttcgtctgtccaggctcctcctgggctgagccacccggggttggggccagcctgcacagcgggccgagcctgctccagtgcggactcccaggccccctgcccctccgtgtcttcctactcaggacactggctcagaaacccctggagatgagtctcctggattcaccaacctaaatcccagaacaccaacatggccctgagtcctggttggattggcagagaccatctgtcctcactgccactgccctgggcactctgaggaagccsctgacccagctaggagctttgtgctcttgtcaatagacggtgacagcccccaaagctctccctgcagtggaaatacctcttgtgtggggggtgtggaagggacctgaggctcctctcactgccccaccccatgacagagtggcccaggaacagccccatggtgctgcgctctctccccagcagcatctcgccaagggcccagcaggccacgtccacggcccctcacccctgacaacactcaccgccacttcacagaactggccggagaatctggcattgcagatacattcagacacccctccagctgcccggcaggtgcccccattcaagcaggggttggcttcacaggggagagtggggacctgacacctggagagggaggggggctgagaaagcggcttcccccatggctgcctcttgtgctcccagctgctctgctgcccatccccacttcagcaagcatcagagcttatccatccactgtccccatgcgctgctcctgcccagctgggccctgccaggtgaccacctgagcagccgtcactgagaaggactctcatcccattagggtgacgggagcctgtgtgaaggcaggtgccccagacgctgacgccactgtctgcagggcccagaatctgcacttttatggtctcccacaggcgggctgaggctgggtttccagaactgccaccaggcaaccactgcccagcagcagtctgtatcacagaggatggtcttgcgagtcatggaaggaaactcaagtgacaatggtgactgtgataccagggaggggtgagaaggtgggcgaggacccccgccccaccctggctggaggaacagccctccacattcattggacctcctcacagttcccaggcccccagacccacctctggccagcaagaccctccaggcagctgcagttggcagcgggagagccaccctcacatgggctgccatcgaggcaggtgacattcaggctgcactccttggatgggacaggcaacctggggagagagcagaggctggagtgggtgcaggacacctgggacctgccctccccagcgctgtgaccgtgggccacctgagcttgtgttctcatgtatggaactcagggccttcctctattgggcatgggattgaggtccctgatgggagggaagggacacagggttgtcactcgctttccagagtctcagaggactcaggacaacaaagtgtaaggactctgaacaaaagcaggtcctaaacacaacgcctggacattccttgaggggagagggaggggtcaggccacagccagatccccttccacacgctgggctcccgggagagccactgccagatgaataagggaagcgccaaagcctgaccccctccctccaccccaaccagccaccaatagggatgaacctccgtgtaagcggcaggcggctcccagccccagaccacagcgctgtttatctgaaattccaggctaactggttgtgttttgatctgtattttatcaggaaatttatcaaattaaactgtcctcctcatgtcacagataaggacatgaggaccagggaagggaagcgactcatccacagacctggcagacttctctgccccaccatagccccagggggcattcgcagcccacccccctgcccagccatcccacctgcagcgcgggcccccgaagccaggcgggcagcggcactcgaagcggccgtcggggtgcgtgtgacagcggccacgggcgcagggggcggagtgacaggggtcgacgtgggcttcgcagcgcgggccttcccaccccgggccgcaggcgcaggcaaaggcgtcgaagaggtcacggcaggcaccgtcgtgcagacagggcgagggcgcacacacgggcgcgccgcggcagccgaggatcggggccggcgtcccaggccaags

SEQ ID NO: 17731 - DNA, 23597 bp, Homo sapiens
gctctcctccttatgggttgtgtagacttgaatgaggtcccctctccaagcctttatttactcattgctgcaatgacagcaacctctctgcttcataaaagggtatatgaagcaaccctagcatggtctccaataagctcagtgggcattccttctctgtccccaccatatccatatggcctttctacaactatttctatgtttaaaagagctaaacctgcctgttatcccatttattataattctttcatttcgtatgtctaactgcacttgagtcctcacaattcagatggatagagtgaaggcttttcagaccctcaactgattaggtgaggcccacccacactcaatggggccacctgctttcatcacatggatatgctgaagacagattgttgaaatattctttgtttttaatttaaacttgtttcatcatactggttcttttgaggtgattttcatctcactttcaggtcgtttgagagtttcatcttactatataatggttgaaaaaggaaaggaagtcatcacttgcccaaggtggtggtgaattcccattctgttaccagccaagggaagggattaggggaaaatatttcacccagaaaagtgctgtgttgtttgagttcgccttttggttattaagggtactaatatatttttcatcaacaatgacttaaggcccctagaagttcatgaacctggtgtgggtgtgtgtttcccactcagatgtgctgtgtaacttgcacctgagggtaacacgaactctccctgggcaagatgtaaccagggaaagaaaggagaaggcagagctcagagcaagcagaaagccaagcaggagaccaaaagaggcctcagaggccatgtttgcatcttccacagagggacagacacattctctgcctctccagtaaacacaaacatgcaaacatgcacacacagagacatgcacacacacggaccatacacaccacaccacacacacacacacacaactacttatgtttctgaatattacaaacatcattacaaaatatgaaatgtacaaagaacaattcccggtggctcatgcttgtaatcccagaactttgggaagccgaggcaggtagatcacccgaggtcaggagttcaagactagcctgatcaacatggtgaaaccccgtctctattaaaaaatacaaaaattagccaggcacagtggtgggcgcctgtaatcccagctactcaggaggctgaggcaggagaattgcttgaacccaggaggcggaggttgcagtgagctgagattacaccattgcactccagcctgggcaacagagcaagcctccgtcttaaaaaaaaaaaaaggaacaattcctgaagcttctgatgatttctggctgaccatgaggttggaagtgggaacacattaagggcttaatgatgggacacagtgatgtaaccactgtggagccacaattgaagtgctgagattcagcattggaagacatctctgtcaccaaatgaacacgcctccctaaagagctctggcagtgagtcaaaggcttcatttgggtcaagacagagttattatacaaaaagccaagtttcattctacaaatccacatcggggtcaatattttaaagtgatttcccccaagttctgtgtagagcaagctgacagagaagaaatggctctgagatatctggcaaggtgcagatggactgaccacaagccgcttatccccactgtagctccgggctcccttctaccacagtggccatatctgtgaggttctgccctttccctggggccactgcatcagtcagggctctccagagaaacggaatccacaggaggtatacctatagcatacacaaaggctttattataaggaattggcccatgcaattatggaagctgacacatccaatgtctataggtccaaggtcccagttccagtcctaagaggattctcctagttagagacttctctctaactagggagagtgttggctttttgtcttcaataacagtctactcaggccctcaactaattgggtgaggctcacccacactaggaagggccatctgctctcctcagtctactgactcacttgtcaatctcatccagaaaccccctcacagacacattcagaataatgtttgaccacatatctgggcaccccatgccccagtcaagttcacacatacaattaaccatcataactatctgttagaccccaccttgcagggggcagtcctcctctggaaaccttcaggacttgaagtgtcaagctcatgtgtgcaaactgtgaccaacacacattttcctgagaagaggcctcagacaaacaaaaaaatatcatgcatgcacatttactcagataatgactgtctgttgcagcctttacgctaaacagagctaagagtagagatagtgcagattaactcagacccagaaacttggggaggcaccctgggatcctggaagcagatgctgggagggcagaggggaccgagaaaggaggtgcatttactcagctcttctgagacaattctgctctcctgcggtgcactcgttctgctggagaaagggctcactttgagtttgaatcttaaaactgcatgtcctttaaccacactgtacctgctcaccaggctgtggacactaaattgttgggaaagtgaatatatttcatttttttaattaaaaaagcatgtaaggttatattacataattgtgatatataatacatttattcaaatcatatttaagtttggggccacatgattttcaaaagtatacagatataactcatagtatctttcaattttattcccataagcctagatttgatttaaagtctaagcgcaaaggtagagaaattttttagttgtttagtacctgccattttatttttctccaactttttattatggaaaaagttcaaagatacaaagaaggagaacagattgtacaaccccttccctaaatccaccacgtagaaccaataatcaccaaccttttgtcatatcagcttatgtgcacgtactgtgctgaacaatttaaaataagttttagacatgaagacattttaccctttaatacttcagcagcacctcctaaaattaaagccattctcctaaacaaacattatgccattatcacacctaaaaacattaacaataattctatactatcagtcaatatcccctccaatttgtaatttcctccaaaatgtttttgtgtgcgtgtgtgtgtgctgatttgtccagctgggagtcaatccggatttgtacttattgttatacttcttcttttcagctgttcttataccagaagaatccttcacccctttttcttgacattgattttttttggaagagctcaggactgcagaatgcccacactctggtagtccagtttttcccatggtgtcatttaactcatggctcaaactcttccatttcctgtaaacttgcagtaaagtctagaggctttgcaattgattcaattgaagcatctttggcaagcacacagcaacaatgatgttgtgtgtttcttttgcatcacataatgccaggttgagccagtattagtgacactgagtttgatcttcctgtaaggtacagccagatgtctccataaaaaaatggaaaatggaaaacctttttcttttttttttccaattagcacccgttcgcctgcacactttcacctaagggtttgacacccactagtgcacactgcctgatttaattatttcattaagggttacagaatggggatttcctcattctcgcatttctacgtttatgagctggcattcttctgttaaactgctttcacttgtgaaacaggatgcagaggaggagacttattcaacagaattgtagggagggctgtttctctcaaaaggagtggtgagagaagatggtctctaccggggcatggagggctccttgtcagagtctagtgtctgagctttaaggcccaggaagagggcagcagatgggggtggggcagtgggtgagtgagaggcccgtgtgtggggagacccactgaggacagggatcgttagggaaacggagcctcactgaaagaggaatttcagtgatgccatgggtcagatcctgggtctctcttagggaaacctgccataaagcatgagagccacattactcctcaggccttctgggctccgattccgcagactagttttggaggcatcaccacgcctcaaggttgctctgttatatcagggtaactgactttctctaggaacggagacttgggtgccccttaaaacaaccctcagccagtatcctagcagtaaatttttcatcacgggaagcaactaattgaacagaggtgtgatgaacctactgaccactttggtaatatagacacagtggccacagtatgggggattgttatcctggttgtgaccaatgccaaaggagcatgtttccttcttttcttgacttgatgctgtaggagtccaacaaagggaagcacattcaggcccacatgaaacttgggacagaagtggcttctcagagccgtgcaccaggcactttgaacaagttggaaggctacagtgccggaagactccacagtagcacaggcgaagtggcttaggcgaaaacgctgggaagtaccccagctcccgggggccagagcctctagggctggcagcctcagcaggcagagtcacttgcctccttcagctcaattgctgagggcttgcgtttctctgcagggaacaggagtgccgccgacttccactcttggtgcccttcaccgctcaaactgcaccccaaataagcgtatgcaccctgctccaagagaaggatgcgctgggctgatcctctggaggcaagagggcaaaagacagaaagtaacgagcggcctttgcacaaagaatcctcaactctctgcagcggcccctgcggcccaatcctgccggcccaggaatgcacggtcggataacaggcctctccttgctttttcgtcttcttcctcccgcttctctcctctctccttttcctcctcctcctttttctttaattttctcctttctccccaagcttctacagttgtttctgtgttcgctcaatcatggcctttggcattgattgaaaatttggcagttccttctctcggaattctgtttgaagccttcatatggatttattattattattattatttttgccacacaaaaggggcaaatccgcgtgaggaagggggtcgcatgggggtcggctgagatctgctggctgccggtctaggaggggcgctgctctgtgccggagtgggctctggtgcaccagcagaggctgggggagagtgctgcccccgcctggagcccaagtctctgcgtgcctgggggtagagcgcggagagggaccaggcaggcgccggaggggacccgcgcggaaaaggaagaagcccaaacaaaaacgctgtccggcgccaggcgcccacctgcaagcccaagccggtgctcggccagttacaaaagaaatggtcaggatctggacaacgataatgatagtattaatcctcctattaagaatcggcccaaacaaaccctcgctgtcagggcgacaggcgcccgcccaagcccagacctcggacctggttccaagcctgttcccgctgggtctctgggcgcccggtttctgcacctggagctcgcccgatgaggacaaggtctggaggccggcctgggaacaggggccgaagggcgagccggaccctaggggattggtagggtcggggagaaggggtccaggctaggggcgggcggggcgcasggagaccaggcggcttgagcgggaggtggggagctggaggagtgccgggttcgcgggcgggggacggggagaggggggcggggagaggggcgggagtcgggggcggcgaggggaggggcggagcgcgggtcccgccccggcgggccgctggaaaagtttagtctctgactcgctcgggcagaggccgaggaagccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggaggtgagaggcgggcccgggcggggcgcggaaccagggtggggggctgggggccgaaggacccacctttccaacaaaatccccaccgatcccgggcgcgacggggacttgggcgcgccacggcggccggagcgctccacatcagcacccctcccccagagccgctgcaggaacagggaggaggccttttccaccgcacccggarcgtttacaacgggctggagctgaatacctggatgaaagtggagaggctgttcgtggagaagttccatcagtcgttttccttggacaattaacaagttaggcttccacagtgccagggcctggggatgctggacgtgggagagggttgtggtcgttagcctgggaaaatcattcttttaaacaatattcgccggaaaattagttttttcctaacatttctcaaacaaggcaattagggccgtcagaatcggtgctggaagacgaagtccccacagtgcaataatgaggttcccacggaaaatcagtacgttgtgttcgtaactgagataacagctagagaaggggctttgggctttttgagtctcccaatagtcagtctctctctctctctctctctctctcttcctctgactttctggctttggacactcccaatggtatatttctttgtggtgtttttatatttggatataagagaggaacttcttgttggatttttaagggaacacacttcgttttgacccttccaataaggaaaggggagctacaggaacagagagctctttagaaggttacttttaaatggaggcccccccattcatggtacccactcccacttggacctctgagacctccagaattaggcatcattctaaaatctggacattagaagtcacagactttgtatataaccacatattcataatttatcttttcaatgttttttattcatagatgaaaatcttgcaggcatagttaagaaaaatataattcctagaaagtacaagggaaggattatgctctgcagatacatgactaacaaggatagctggccatgcccagggctggtgttggttgaggaggtggtgatggtgcggggcatgtgtgtgtgtgtgtgtgtgygcgcttgaggagttgtggaagtgttcatatctgtaaagtattatttcatggatgcagaccttaatgctaggttgaataactttgttgccatagaagaagaaccgcacgtcaggcttttttcattagcaaaccagtaagcactcactttgggcctytgaaatcacttccatcacctaacaccagagatacaaactgaagctagcccttaagagcctccccctaagatttagagagaatgatttctcaaccagttttcatctttgaaagtgccatttctccctttatcattgtgatttttattcaaatgcatgagtctctgattttctaccatatacaaagggtagagactacagtttcctatagaagaaacttcacatagtggccgaaggatcttatttctcaaaattcaggaactggtttcctctttctggaaattatgacattaacttgatttcatggtatctctttcatcttcctcaatgcctgtgctgtatgtatatttttattatatactgtaggtatatttttattaccaaaaaaaggagaatttgagcatgccacaatcttgaaaaatctgaggttgccctgctgtagaaccctttaactgccaggactttgtactgtttcccaagtgttaccagagccaggccgccagccttatgcagtctgtttaccttagctggaaccagggtgctgtgctgtgggttctatgaaactttctgtttcttcatatttggctttgtaattcctttcttatcagttttggaggcatttcctattattcctctgccatatgttttctgccaaattaattgccttaagattttccttaagcttttggaaatgtataatgtttgagaaaaaagaaaaagaatagactgagtggaatcgtatctagtttcagttaataacaygtttcagttgatgttactgttatagctactgggcataaagtctccttcccttttttgaatcctatttttgaggcattgaagctgtgtctgtaagagacaataggccagttgggttaaatcagtgacgagattgtccagtgcagattggtgcccagtgagtggatcttcactgctcacaggccggactggggtcagctcacacagcgaggtgacggtccgctcctcaagcagtggatggtgctcttcggccttgcagatgccgctccattttcctggcttcaaaattttccagatatttcagtgcccccagaatgacatgctaacattctgctggcatgggagcatgaggcagtttgtctctaaaacatgccagagaatctcttgtcactacctaggcaaagaaccagtggcaaggtggcagcctcccaaagagctcatccctaatgtgacatcctggaatcagatggcacggacaccggcccagccccttcccagctctgtgactaaggacaagtgacaccccccctcccccagcctcggtctcctcctgtgtacattcagaaggcagatgctgccatgaggccatgtgtgctatgtccatggtgcaaggtggcacgcatgccgagtcaccaggtgagactgccgctttgggaagggataggaaggatctccggtagccttcgtgggcaggatgcctcttatttgaatgtgcctttagccacctcacagagcctatttccacatccctgtggattcatccctgtggaaatcttgagaatcatttatcctatgctgtcatgaagcagcagcagaatggagaaggtttaaaaagactcatggacaggcaaagcggtcaaacacctcctggctcagacgcacttgccttcccacacacaagtctggaagctcaggatggtgttcacggaggcagatgctcggggccggggcctgagtttcctggggcacagcctccatatctggggttccctggactatgcccagatagctcataatgtcccagccttatttgtgatggagaaggacttggggaaaagccaccgggaagcagtaagtctaaccagggaagtgcactgacttgcatgctttgaagaagagaagggagaaaagatacaaaaccctcacctggtttgtctgtaacagttgttatttctcaggggagctgcattaatgggccaagcctgtgcagctgggtgtgtgaagcatgcattttgcaatggactgtctccaaaagcagagcgaggtcacccaagaaatctagagcaagggaaaatactcattagcaaaggaattttgctggagccttgtaacggccgactcattatttcctttccaagttattttaaatgaaattttaaaaaacatcttgctttccaagaaattttgcttgttggcatatgtttggtgttttgattcagtttggaggatgaactagttaatttccctgggagtacatgcctattaaaaatatagcatcctgcatctgaccaagatgctatcttactatcttattgtgcctatcttttatgcggagagagaaaggggggtgttgggaaggagaccagactgtggaaacattttctttattttttctctttttcttccttttatagtttgtttatttttcaacttgacatgggtagagaaagcgaatcgctagtatagaaagcacatctggaatccatccggcctcctctctctggctcaccctcctcccagcaatgtttctccttggaagttgggggaaggtaggcacctctgaccttggcagggtctaacttggggtcatccactgcatactcatcttccagaaggcgtcttattcctcctcgacaaaaaaaaaatgtgttggtattaaaatgctttgaggtaggctggatgaacccagcttagtgargatgacatgaaaacccttagctaatggggtctttattgagtagaactcaggtaagttcagatgtaagcagtgtctctcagtaaacatgaaaagactgaagatgcagacaatcaaatacttaagtctcttgaagagctgggtggtgggcgggggtcttcccaggtggtcagggagatgtgttagtgtagcacttggaagagagtggaacgaccaggcaaggatgtgccgtggaggtgggcagtgggagcagcccagtgtcagcatctgtattggttagaagaccaccgctaatgaggaggagcgtctctaccctgcagctgtctgtactcctgtgtcttccgtaatgtgccaagctctctgaatatatgcaaaactagtctgcaaaragccatatgtctcagcatctggctttatttctaagtgttcaggtggaatttaagccgcgatcaaatttacaatgtcactgccagctctggacacttacttttggaataaagcaaagagtgaacactaatactgcatcagtcttgccctctgttaggggccgccccttctccccacaccagttttgcaagatgggctggctggggtctgagaaacccagtgcctccgagtcatggttaaagcccatctcagacaccaacacaccgctcacaaatcaacatcgacctgcgaaaacatggacatgtgttcgccaagagaacatcctcaatcaatcccagcagtgctacttgatgataatcaacacatgggccatggaagaaattaccccatgtccataaacaagaatgaatagagggtagtgtatctacccacaccatgagagcaagaatattcagcatgcaggtgcatctatgtgcatgactcgtacaagcatcatggggagaggaaagcaatggacacaattgtatcctgtagggtttcattcacgtgaaggtcagaagcaggctaaactcacctaggggagagtcctatcccaggtagtggtcatgcttggggacaggtggtgactaggaggggcacaaggaaggctgcagsgtccggcccatcttgttgctggcctgggtgctggtctcactgatctctgtgtggtggggcaggtcagcctcccaggcctgctggtgcctgcagtgcccagcactcctgccgtgcctggcagtgttagtaccaatccgccagagtgactgactcccctcttgccctgagtagggcttgctgactccaggagcctcagggcggggtgggctttgagctttcttctagcaaacttgaggtctgtggctggtacccctcaggagcggaggggaactcttgtccatgagatgcttttaaccgtgcgcaataatgtgtagacgcatccaaaatcaatctggcctttagcccagcacttaactcttgggatgaggcctgctttgtaaatgttgataatccagagaaaatgagcttttagattccaaagacagccagatatcttccacttatgcaaaatgcagagaatcatatttaacaaaagatgttctggacaaatatgcttcttgagggatgaatatttaattataagggaaatgataaatcaaacattaatgggaaaatatgtttgccctcaagattcatgattttgatgggtctctggcaaatcttatactatgtttattggggttattttattgctggttattagtttttaattgtttgcttgttttctgctctgatcaatttttgtataagccgtgggtctattcaccctcttctctccattcccgggagcaagtccacatctggctgttggatgcatggcaaaagcaaaggtgtggagaaggttcagaggagacaggacatgtataaaatggtagggtcaggttgtcatgggggaaactgaggcacaggaggcaagctgagttagtacaagaacagtctgaatcataacgacatgccagtattacctaaaaggatgaggaacatggagctgtacttgaatccctacgtgagctggggaaaaggggcctcaggaatcactgacattggaaccaaggtttgtctgcagcttgtcggtttctgggacagaaacccaacatactggagtgggtatcccagcgatctgtaggataaaccaggacactgtggtgtcatggatagctggctgtctgccaggtgatggcccctctggttgcaatgtgagccgggcaggtcatccatttggcagcatggtgagggctctggccccagttgctatgggagggaggatgctggcacagggcactgttcacagactgcctttgctccatgccttttccatgagcatgagtggctgttcgtgtgggaaacggcagagccctcgcrgtccccatcagcactgtgcagtggtaccggaggtggcaggagacagcctgatggcccaggttgtcttcatacccggcttcatgccagggtgcatgccgggcatagcacatgtgtccctgagaggcccctgatcaggggtggaaacccagcaaagtgaaaatcagaaatagtgattctccagttcctgttcacagataaagaaagaaagaaataataagcaatactaggcctggtgtggtagttcacacctgtaatcccagcactttgggaggccaaggcaggcaatcacttgaggtcaggagttcaagaccagcctggccaacatggtgaaaccccgtctctactaaaaatacaaatattagccgggcatggtggcgggcgcctgtagtcccagctactcaggaggctgaggcagaagaatcgcttgaaccggggaggcggagggtgtggtgagccgggatcgcaccgctgcactccagcctgggtgacagaatgagactccatcccaaaaacaaaacaaaacaaaacaaaaaacaaacaaaaacaactaaaaggacagtatctttttagcacccatcagtgtacaggatgctggggagggtactgtgaacttacccatggtgaaagtccctgtgttaatggataagctcaatgctcagaaaatgctgctgactgtggtattgccccatttaaagagacagtttgcagtacgttttcagaagtggcatgcagcctcagagaaaagtcaccaggggctggcatgattccagaaaatgttacagagcaagtggaatttgacttgaggcttgaaggatgggcaagatttaaataaaattcagaaacggtagagagggaggggctggggggaaggctgcccactggactgtcctgtttgcctccaggagaacctacaggcaagacatggtctcttctcaggtgaatgggaagccaagtagggctggcatgggtgagccacagctcgaggaggcaggccccgggccctgcgctgcctgtcatggctcatgagtgatgggagagatctgggcaggcaacctcctctcatcctgcatcatcagcctggacttggaacttggctgctttttctttctgcagttagcrgagggccttggccaacacataagcctttctgccagcacttggcattccagctgacctcgacccaaggcctctgtgacttcaggaggcggcagctgggaagggtcagggcagttccaggcagagcacagacgtcagctcagacatcctaccccccgccaaccccccgcccccggggtttccagagcaaccaacaccaccaagctccaggacactggaaaaaaaatctttgcaaagaagcaaggggccatctcagaaaatccaggtcccccaaattgatgtagggagaggagggctttgacagcattcagcactccagagggtcacgaggatacagaaaccatttggagccacctctgcttctcagccccacccaggcaagccctggatcttcaagggactgatttgtacctgggaataaactcatgcatggatgagattcagagtcaatcacaccctaaaatgcagagcccatagtattggtgagttgttcatgtgtctctgaagcaaatttagggctgtggttcaaacatcgtaaaagttaaaaaaaattcactggatacacacagtaggctcttttaaattagcctcatttgaacttaattacatatttaaatactcaaataataaatgatggctgggtgcggtgtctcatgcctgtaatcccagcactttgggaggctgaggcaggctgatcacttgaggtcaggagttcgagcccagcctggccaacatggtgaaaccccgtctctactaaaaatacaaaaattagccatgcatggtggcgggtgcctgtaatcccagctacttgggaggctgaggcagcagaagcacttgaacccaggaggcagtggttgcaatgagccgagatcgcaccactgcattccagcctgggtgacagagcaacactgtgtctcaaaagaaaattttttttaataaaaataaaaaataaaataaaataagtgagtccactgaaagcggtttctaccttgatagttgggtgtgtggcgtcatcaacatcacagaaggctgatcgatattaccaggtgtggttgagtgcaagtgtttgaggtctcgtgggggaagagtttggaattcagaatccattgaggccttcactcaccactttccctctctcgctgtgttcccaaatgtgccacttttctgttggctcacatgcacccatgctctatttgatattcagggctctgaatttcaagccagactcagtcagtgtgattgtcactgctttcctgtccttcctttatcatctgtagacttgggtcccgtttttgcaggttgatgttctgtcttcgctgggctctggactcactgctcacgagtgcggtgtctgcatgggcactgcccagacatgcactgttggtccctcgatggctgcatggtcaggcctcagggctctctgccaggccgacctacagcccatacagacctgatttctgggcctggatccaggggatgccatctgggaagtgcgggatcttcccacgatgtcactgtaaaactcaccagggaggttttagaaattgaaccggcatcattcagattccatcctgctttttggtcctgagaaaatcctgcttttccctgagtaactgggataatgggtcaccagctcccatgccctagatgaggactagttagcattttctagtgcctggagatttccagatggaagctgtacttgggtctgtgtatctttgttacaggattcaataattcatgcactgaatttcccttcccggcaactccagacaccaaatcgcttcccatggtgtcccccaatcacttaggaatttagcctgtgtctaaagaccctctctgcagcctgacgtggctmgccatcccagtacttccacgtttttcrtgcctttctccaacagcgttgccgtggccccttaggcggcgatcgttttatcaatggtcgctccctctttttatctgttggcaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttyaygctgggcgccctgcccattctgggctggaactgcctgcacaatctccctgactgctctaccatcctgcccctctactccaagaagtacattgccttctgcatcagcatcttcacggccatcctggtgacsatcgtgatcctctacgcacgcatctacttcctggtgaagtccagcagccgtaaggtggccaaccacaacaactcggagcggtccatggcactgctgcrgaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccactgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaactttgaagtttggaaacaggtggtcttctatgctgcagagaaactatgcattaggtctcttttcaattagaaacctttactatttccaatgtatgtttgttaaaaataataataataaaaccaaaagcctttgtggaaacccactcttcgtagtccatgtgatgggattgttttatcgttttcaccgggtgccctccccactgcaggggtgcgcactgttgttgcaggcttgctacccacctgtgtttcttagcatttcaggaattaaaccacattcagaaccccaaataacctttcccctttcttcttacccactatcataggtggtattttaatgaagcatctgtgccttgggtgctatttacaccaattttggtaggtcatactattttgagaatggtcttttgatagggagaaatttctaagacccatggtaataaaagtgcagctcaaagacatgggacctcttgtcctgccccatttgctgttgtttatgcagcaggagagaataggtcagaaccaacctttgcacactagctttctcccacacaaacggtccattttagcctctctgtcccacttgctatgtaaagaggaggccagtgctcggcataactgttctggtagcgatgcttgttacaactcatgatgaaatgtcccaacgcaagtgaggacgcagctgcccgccccagagctagaaggtaaggtgagttctctaggagtacatctgcccggatgcattttcattccgcagccttgatgaatgggacgaggctttgttgtgactgttttttaagcagtcccccagggaatcactgaaaatacctacttcttagagaaaagtttcaagctcccctcctctcttttgtgaggcaatacaaaatccatcatccaaatgaaagatacttttcacaacagcctttattgcctgcagacttacatgtatagtcctttaaacaattaactgtttagaaaatggttgtttctctcaacccttgagccagttattccacgctggtaagaccctttcacagaaatgtaacaaggtgcattttatagaaaacatctaattaaatcaccagtttcatgcttttaagttgtatctacaagtgcaaaactgcaacacccaaatgtttttagtatctaagtcagatatccaaaagttagctccataatcagaaatgcgcacaccactgttctgataataaaggcacattttccaataaccaattataacaagaagtgcagcattacctaaattgggtgtgtcatcttcccctcctgggtcacaggatgacacctggggatgcgatgccgtgcctgcacttggcgatcccaggagcacagaaatgcaccagacagatcatgaagggctaatgcttggaaaccacaccatttcctgacagagtgaagggatccctgtggatttatcaaaagggaggagggaatttaagctaattctcttcacctgctgtattctcaaatctccaaaacaccagataacttaggttttttcatttgtcatagaacaaagattagagaacttgaaattcgttttgcatttccactcctcagggatgtcaaaaaagccagttctgttccagcacaaagtagaaagtggtgaattggcaatacgccaagacatagactgttacagtaattctttttgtttcacaaaagttaatggaaacaaaacaactttcagataatattcatttgtcagtatgtataatttgccatccaaatgctttttaaaaagttattatcttattattacacattaaatttacatggagttgtctcctaatcctgggattttaacaccaaatgtttaattctgaatacaaagaaacattcacatacttaattttacaatattctggaacaagttatattcaaaagtcaaatgaacagagaacattccacttgcaaccaacacatagctgttaacaaaattaaccccattaatatttaaagacggatttatccattaatgcctgttttaattgtcacttgattttgatggttagaaactttggttatggtaaaaatgatcacatgagtgggaattcattacctcaaagctcaggaccacagctccccatgtgcatgtttttctgtctgcagtatttcaaggtgagacaacaaaatagacacctaaaattgtatgagattttattcctggtgctttttcagcgagaaccatttttccagacctagggaaggagcctgtgtgtttttggcctgaaggattcatcaattcagagcatctgtgacagccaggaggaggaaagaagggaggctgggatcacctcccgccccttctagcatctctactgagagtgacaactccaggctgtccacccccatcctgagccttccacactcttctccatgccactaacactcagtatctgacgcctgcagtgcgaagcctccagagtccccagactgacctgggcactccacccttgctggttctactttacttggacacacgggtaccttaaggcttgtcacactccaacacctttgtgtgtgtgtgtctttatttctttctaggttataaactcaggcagaggcctcatacattcacttctctatcccaccatcccagtacagggccagccacatattaactaatgcacaaatgaggccaagaaactggctagaaatcccaagaaactgtgccaagtatatgcagctgcacctgggaatacacgaaagcatgacatcacgagcacagcctcctccaccacaccttccctttctcctccttccctgctggcctcagacagctatgcatggctgcatgaaggaagatctaaatctggacttgttttatcctccccttcccttcttctcacctttattctgcctccaccttcttctttctttgtcttcccccgctggcttctctgtcatttcccacagtgggttcccccaatccctgtggtcctcatgtcctgttcttgttctctttgtgctggatctcacatcctacagcatccaggaccatcctccatggctgatgccacagcctgccaattcccaaattcttcacgtttgtttgacttcctacttagctgtaaaaccaaagcccagggaggagtcccaaggtgcacaacacagagccaatctgcgtgtgtacagagatgcagatccgtttttaatcaatgtaagtatatgcgtatatgtatatacatatgcaattcacattcacaagtcctggtataaagttgcaatttttctggctgctataaaatgtgccagttttaaaactgtgcatttgttgcttgcaaacttataaatatgtataaaccccattataaataaattatggctggcagatggcatttaagctgccagcaatggttgcatggagttataaatgcttattaattctccacttttaaattcacagcacggaccctgggatctgtgacatgaagtggtgtgaaagcataattataaattagaggggggaaagccatcaataagagacaggtaagggctggaaactctcactagtgagtggttctcaaagtcaagacttcagagcagctgcaccagcatcacctcgagattttttgaaatgcaaattcccgggccccactccagacctagggagtcaggaacttggcggggccaggggggtggaagggcctgcaatctttgtctgaaccagctcacagggtggttctgatgcctgccttccactcgaagtctgcttgtcacgaacgcctgtctcagctcagggacatccccggcttaggaagtatgctcaggtgtgtgcagggccagtcagaaattgtttccagaaacagcctttcataagtgatagacttggtgaataaataccccagctgtctccccgccttgctgggtgaactctggggtgtcagctctgtctctcggggttccccagtgggattcagctccagttgtgcacatgacggtaacttacttgataatgcacgccttccccgtcagcttccttctctccctacttccgggatcttcactcagataaactacataacctcaagtcctctctcagggtctccttctggaggaaccccaactaagaggaagtagaaacactgtctctcccatctgaatgactcaggcttttatgcattttgagatggagcacagatgtagaacccctggagggaagcactgcttgccatttccgtggggcagggggct

SEQ ID NO: 17732 - DNA, 32070 bp, Homo sapiens
  misc_feature (1)...(32070): n = A,T,C or G, or insertion/deletion polymorphism (see Tables 1-2)
gggaatatcatattccctgatccaccctcatcagggaaggtagaaagaatgaatcaaactctaaaaagtcacctaaccaaactaatcttggaaacgcggttaccatggacaaaatgccttcccattgccttactaagaatccaaactgcccctcgaaaagatctcggcctgtccccttacgaaatgctctatggactgccttatctaaattccactactgaccttcctacatttgaaacaaaagatcagtttctaaaaaaatgtatattttgtctgtcttccaccctttcctccctcaggactcaaggccttctagggcaaactccaccctagttcgaattcccagttcactaacaccagcccagagatcatgtccttatcaaaagacggaaagagggaaagttcaaaccaacctgggaaggaccttatctaatactcctaaccactgagatagcaatccaaaggccgaaaaaggagggacccaccccttgcaaagtcatggactgtcactccaggaccaacaccctccaaaccaatgttcaaaagggtttagtctgtctttttttttaattcctttagttaccaaagaacatcttatcatcaatgtaacccgatcaccctgccctcaaacgatcacattcaatgcttgccttgtcatgccctgtggagacctttagagtcaaaaacagctagcttcttcagaaaagtacctctgcccctccacccgcttcagacaaatcagaaacccttgtgatggacaaccacgagccttccaggggttatgttataattggggagatgttatctagaccacccagtatcagggctggacctcctcagagggttgcaccgccctaaaaccttacatccaccttaccaaaggagtcacaccctcaaattgccaaaaccaccagttttcccaaaagtcagaagccctacgggacagcccccaagggccattcgacttccagctcttgatgccaattttacctcatgtctctcatggcaaggggaaaatctgacgttcctsggaaacctgatgggatgtactgggcctaaacctttccaagagctaaccagtcagtcagccctaatccatccccaagcagatgtacagtggtattgtgggggaccaatattgagtactctgccaaacaattggagcagcatttgcgctccgatccaattggccatccctttcaccttggcatttcaacaaccagacaggaagcaggtaacccaaaggaaaagagaaacccytcacgggtcctttgayctctcatatttacatagacagtatcggggttgcgctggggggtacaaaatgaattcaaagctcgaaaccaaatagccaccaggtttgagtctgtattattctggtggtccactataaacaaaaatgtagactggatacattatatatactataatcaacagtgattcatcaattacaccagagatgccataaaaagaatagctcaacaattaggccctaccagccagatggcctgggaaaacaggatagcccttgacatgatattggccaaaaaaaggcggagtctgtgtcatgattggggtccaatgttgcacttttatccccaataacacagccctggacgggacaatcacaaaagccttacaagccttaccaccctagcaaatgaattagccgagaactctggaatagatgacccctttgcaggtgtcatggagaaatggtttggaaaatggaagggactcatgacctaaatmtttacctcccttgcaacagttacaggtgtactcatccttgtgggctgctgtatcataccttgtattcgtgggttaacccaaaggctcatagaagcagctctcacaaaaacctcccccacctctccccatccatagtcagataagctcttgctcctagatgataaagaagaacaacaaagccaactcctgttaaataaatttgaaggggaagaactataaaacagaagaggggaaattgttgggacaactaagttcctcttcaaagattcaacttcctggccataacttggaaacaaatcctacccctacaaccttttcaaaaatcacacctttaccttatttgggaaggtttaagcattagcctgtcggggtcagcttagattatgcggcccaaccccagccaataggggaaggacacagaaacagaaacwgccttaccccagccaataggggaaggacacagaaacagaaactgcgttaccccagccaataggggaaggacacagaaacagaaactgcgttaccccagccaataggggaaggacacagaaacagaaactgcgttagggataaaaaccccttccctcctttgttcagtgtgctcttgggattgtaacaggcacaggcagcacccttctacagaagtaaaagtgacttgctgagaaattttctaagtgcgggtttcttttcgctacaccaagcacttgtttccaacacatgcaaaccagaatggaggtctccctggacctgggtttgggccacaagcttgcaagaccttgggcaagactgttccctcttctgaaccaagtccttccctggcccagccgcttgtgagtaacacatcagtttcatgcttacacctcctggtcttgtgagtaacacatcggtttcatgcttacacctcctggtctgaccgggctctcctttgcagagccttttattccttcccttcctctgaacactggctggctgctttcagggaagaagttcagggcagtggcagggagctccttgcacatcgccatgacaaatgttttatggaaacagtgagctgatgggacgaggggtcggggctagaaagtcagccaaaaggtgtgagaacccggactagcccccagccctgaacatggcaggccactgtgccatggtaggggagtgaaagtttccctctgctcctcttagggttccagctggggctccttacaaaagagaaaaacagttcattaatgcatgtagtgcacctcactgaagaagcttcaacaaaaagcaactcagaacagtgacttagaactgggttatggagcaacttcaacaaagaataatcaacgtgtggggaaatgacaggacccaggagagcggttttaggcttccaagtttgggaaaccrgcaaggtgagtattgggaggaaactaaggcggaagtttcattcacagagccctagggtgccttctttcctctggctgatgcgtctctctcctataatttccatcctgcctcagacagcagagggacagggcagagagagatttccctgcttctgctgcatcttagttgccttcaactcaagataatttctgaggctcattttggagtgacatattctggtgtccttcacggtacagggcacagcctcagaggaccagatccacagctgatcactgagctcttccatgtgccaggcccgtccagggagaacactcagccccacaaacagggcaggtggcaccaggatgctgggcggcagcctaaccctcagctcatgggtgggtggagtggagagcaccctccccatgtggggctccctggtcgtggacctggagaccaccaaggctctgcagtctcagaagtggcctgttggaatggggtctgcaggcagggaagccttgggccagagtccctcaggggcaggaacacagcccccaggcttgtcccacttgtccctctgaatagttaagggctgcccacagggaacttccctccctccctcccttccttcctgcctccctccctcccttctttccccttttcttctttcatcctcccctttcttccttccttactgtggtaaaatacacataacatgaaatttaccatctcaactatttaaacacgcacagttccatggtgttgagttcactcacatcgttgtacagccatcaccagcatccatctacaacactcttttcatcttcccagactgaaactcaacaccgttcacagctccccattcccgccttccccaggcgcccaccattctcctctctatttctacgaatttgatgactccagtccctcagatatgtggaattgtggctgggcgcggtggttcacatctgtaatcccagcactttcagaggccaaggcaggcaaatcaccttaggtcaggagttctagaacagcctggccaacatggtgaaacccagtctctactaaaaatacaaaaataagccgggcatggtggcacacatctgtggtgccagctactcaggaggctgaggcgggagaatcgcttgaacctgggaggcagaggttgcagtgagctgagatctcaccactgcactccagcctgggagagagagcgagactctgccaaaaaaaaaaaaaaaaagttaatagaatcgcatggcatttttccttgttggactggattttacttagcataaggcatcaaggctcacccacgctgtagcaggtgtcagcgtctcctccctttctagggctgagaaacattccatctagagacagactcactccgtgcagccatgacgccttggtgaacaccacggctgcttccagcttttggctatggtgagttccgttgctaggaacacagatgtgcacatgtctcttccagacctcctttcaattccttgggtgtatacacaaaagcaggattgccagctcatacggtaataatatttttatttttatttttattttttgagaaggagtcttgctatgttgcccaggctggagtgcagtggtgcgattttggttcactgcaacctccacctcccaagttcaagcgattctcctgcctcagcgtcccaagtagctgggattacagactcgagccaccacgaccggctaatttttgtatttttagtggagatggaggattcaccatgttggccaggctggtctcgaacttctgacctcaagtgatccgcccgcctcggcctctgaaagtgctaggattgtaggcatgagccaccgcgcccggcctcgtacggtaattctgtgtgatgttttgaggaattgccacaattttttcctgcgcctgcaccagggacacgtctcggagctggcgaactggacttggggtgggagggaaaggaagcattaaagatgcccccagctttcacggagatgagaacggtgccccgggagggcgggacgggatcagggtcctgtgaacggggtatcagtgtaaactcctctgagagatatcaggaaaagcaggaagaagcctctgggacccttcgggaggtaactcctcttcgcagcggggcgcgctctcccagtccctgcagccgccgccgccctctcctgagcttcctcgagcggacgccaggcaagggcgggggtcgtagcggggcggagcggggctttgtccacggaccgcgcgaagaggcctcagggcccggcgcgggcgccggagggggactcgctcgcagggggaacgcgaaggttcctcagtctgcgggacgcagagctccgtggggccgcgagccggggccggggaagcgactctgcctagggggacgtcgcgggcgcggggcacagggtcctgcggggctggagggctacaggctgcggcgcgcgcgagccggaaggccggggatcgtgggttctggggccgcagcttcacgggttcgtctcccccgcctccccgggggagcaggatgtcagggggtcgcccccgcccgggagacagggtgtcaaggggcccccggggacggggcttcaggggcacccggagccgctcggccccagggcgggatgcggggacagggccccaaggtaccagggccacgaggggcgcgcgggtcccttggggatgcgcgcgaggaggcgccgtcccttcctagcaggggtccctggggacccgcggccgcctcccgcgcccctctgtcccctcccgtgttcggcctcgggaagtcggggcggcgggcggcgcgggccgggagggggcgcctcgggctcaccccgccccagggccgccgggcggaaggcggaggccgagaccagacgcggagccatggccgaggtgttgcggacgctggccggtgagtgcaggcctcggccccgggtgcccgcgagggagccgctaccgcagggaatgcggggtgcacccgacagccgggccggggtgggggcgcycagggctgcgaggcttcrggccggccgccgccccagcctccgagaccctgcgtcctggggagccggcgggcaggtgggctyggccgcgctgtgggtgcctgggacccgcagggaggatgggcgcggtggcgcggcctggcggggggctcgtctccggggtccccgggtcctggtgagagcggggtccctcgacgccgtggcggtctccagcctctcctcgcccctccacgctccccgccttccatgagctgctattttcagcacctaccgcccgaccctggactaggacaaggctctgggctgccctgcccgccccccagcccttccctcgggcacggcggccaggcgcccgggttgaccgggaacagcctccataccccaaacgcggaggcgcctcgggaaggcgaggtgggcaagttcaatgccaagcgtgacgggggaactgtgccccgggccctcaggtgatataggagttaagaagaaattattgaggcaaccagatgcggtgactcaggcctgtaaccccagcactttgggaggccgagggtggatcacctgtccttaattttcttggcgccagaagatgaattgagtatttacccagacaacaacgtcgcttcagagggagggatgcagaacgcagggccacggggygcaggctgcaggccagtgaaccccaacgccaaaggccagggagagccgggtggggtacccagagccagcacacagccctttaatttagaggagtgctgtgtacacatytggggagagatgttttactttgatttggaatcaggtggcggataaggcatactgaggcctgacttggtgagggctcctgccccggaggtgcagccctggaggagcgggaggcagaggagtggaaaattcatgaagaaaacngggtatggtgtaggtcgaggccctgccctcagtaatgctcaccatttgtcagtgtttactgtgaggcagcactgtgttcartatcgctgagttctcaggaaggaacggtaaatacttcccgggtcattctttcacccacgggaaaacaggtttggagagatctgggacagtgctctggtccyaggcaggaagggctgagtggggcctgggactcargtctgactgcaaacacctgcctcctccctgtgctgccagcgccttccgggttcttccctgtccctcctttgtggtctttgttttcccttttttgtcttaatatgtttcaacggatgtatacaataaaccgcacatraaaggtacagctggatacatcttgacccagtcaagatgatgaacacagctgccaccccaggagtctgtcctgccccrcgggttatgctgtcttagttggtctcatgtcagggagccttggaggaccagggtcgggcagttggtctctatactcctggggttctggcactggctctggcccatgaccgcacccaagacaaacgtcttgaagactaagaggttaggtctttgagaaacctggcaaatgagtgcccattctcaggttacccacattctgcatgttgatttagtcatccaaccaatgttggttgaacactgatgagaacaagcaggcctgtgctagaaggtgcctgcagccaggagctggtgagctggtgtccttagggacaccaatggcgagggacccagtgtgtggaaatctgggggacaagcatgccagggagaagagctcacatggggaaggcccggctccacaaatcagtcaggcttgttggggcgggcaggagagcagggtagtggagtcagagggagtgatcccccgaaaggcaggaagaggacatgagagagccttggagatgacsrtgaggatgtggttggtgggcggtgagctgggtgtcatgtgctggctccttagagaatgctcagctccttcacacccatcataatccctggaggactgagaccacgtgcaggagttttggaagctggcagtgcacccagtcccggctctcctccattctggtgggtctcaccagagattggccaagaagagatcaaactgttcctggaccaaactgagggtggggctgctatctctcgyggcccaataacgagatgcagatgaactggggagaaagagactttttatttctgtaaccagttacaaggagaagacctggaaattatctccagaccaactcaayattacaaagttttccagagcrtatataccttctaagctatatgtctatgtgtaagtgtgcattcatctcakgacrtaagtaattgacttatgttaatctataactaaggtctgagtcctgaagaccttcctctggatcctcagtaaatttacttaatctaaaacccttatcttgtctcctaaatcatgggggtttgggaagttccttcagacccccagtaaacttatttgtggagtcctggggaatttcttcagatccccaataaaacttgtttaatcctaaatgggtcctgttaagaattccttcgttattttgtcatgcttgaaggcccaggaaaggtctaggcaaaactcttggtgggattttgttatattccagcctttttataagggcactggcttttaatatttaatttaaccactcagtcagtactgaaacagttgttagggaggcctgcgttagtgagacctgacctgccacaamacatcttactcggaatgctgcccataacttcaaaaaatcagctttgacggagccctactgaacacacctagcatctctcttccttcagcttagggtcaaggggctggggttgatggcaccrttgaaagaaacagctttattgccgtgtcattgatatgccataaaattcacctgtttcaaatgaattattttcagttagtttacagagttgtgaaataaattttataacttttccatccccagcccaccaaaactccctggaactcctcygcagtcattccccattcccacctggcctcagacaatcactttctgtctctccagtcttgccttttctggacagttcctatgaatggagtcctgtgttacatggtcttttgcatctgacttccttcacttagaataatgattccgagattcatgtatgttgtagtatgtatcagtatttaattcctttttattactgaataatccattgtacagatagaccacattttgtttatccattcatcagctgaaggacatttcggctgtttctgcttttttagctattttaaactgcacgcagcactgctatgaacatttgtgtacaagactttgtgtgaacatgttttcatttctcttgggttgatacccagcagaggaattgctgggtcatacagraagtctgatttaacattttaagaaactagcaaactgttttccaaagtgactgccccattttacattcccatcagcagtgtataacggttctaattttcttttcctttttcttttcttgagacaaggttttgctctgtcacccaggctrgagtgcagtggcatgatcttggctcactgcagcctcaatctcttgggctcaattggtcctcccacctcagcctcctgagtagctgggactacaggtgagtaccaccacatccagctaatttttgtatttttggtagagatggggttttgccatgttgcccaggctgttctcaaactcctgggctcaagtgatctgcccacctcggcctccccaagtcctgggattataggtgtgagccgctgcgcctggctgagggttccactgtctgtacrtctgcagcaatacataccattcttgtgggtaaaaggtggtatctcattatagttttgatttgcatttccccaaggwcaaatgatggcaagtggcttttcttgtgctttttagccatttgtatatgtttttggtgaaatgcctgttgaaatgttttgcctttttaaaaattgagttgtctcctttgttcagttttgagagttctttacatacacagtatcatatatatatatatatatatatatatataccagatatatgatttgcaaatattttcaaycatcaatagtttgtcttaacacttttttattggtgttttgaagtagaaaagttttacattttgatccattccaatttattaactttttcttttattgtgtatctggtatcatatctaagaaatcttaatccagtgtcacaaagatttaatcttatattttcttctaaccgctttctagtttatgtgtaagaatctgtccattttacctaagttgcataatttgttggcaaacagttgtwcatagtatttccttgaaatccttttaatctctgtaagattggaattgctgtctcctcttttagtcctgattttagttatttgtgttctctctctctctggtcaatgtagctaaagctttgtcaattctcttgatcttttcagagaactgmcatttgattttttttactttatctttttctytctgttctctagttcattggtttccactctaatatttattaatttcccytcttctcactttgggtttaattygttctgtcttttcttattgtagttacttacaatggaagcttacacacttgatttaagattttttttctaatgtagacatttacagctataaatttcccttgaaacacagctttagttatatctcataaattttggtatgttgtgtttacattttcattcagctcagtgtatcttttgattttcttctttgacccattgcttatttagaattatgttgtttaatttctatgtatttataggtttcccaaatttcttttgttaatttctgatttcattcccctgtggctagagaagaaactctgtggatatcagtcctttcgaatttctcagaattgttttatggtccagcatatgattgaccttggacactgttccatgtgcacttgaggagaacgtgacttcggctcttgccaggtggagtgttctagagatgtcagttggtgtccagtgatgtcaagtcatttgtatctactgattttctttctaattwttctatccattaytgagagtggggtaggattttggtgtccaattattgtttttttgtttttttttttttgtttgtttgtttttttttttgaggtggagtctcactttgtcacccaggctggagtgcagtggtatgatcacagctcactgcagcccccacctcccaaggcttaggtcacctcagcctcctgagtagctgcaactacaggcaagtaccatcatgcctagctgatttttgcattttttrtagacagggttttgccatgttacttaggctggtcacgaactcctgggctcaagtgacccacccacctcggcctcccaaagtgctgggattacaagcgtgagtcaccatgcctggcccaaccrttactggtgaattgactgtttcacccttcaattctgtgagtttttgcttcatgtattgctgcgggataattaaggaatcagagagaccgatggggttgaggaggaattatttaattatttaggcgcaccgacccaatcagattaacatccaaaggacygggccccaaacaaagagtcaagctaccttttaagcattttgtggggtggggggagatttgtgcagggggaagagtattacagaagcragaaacaaagacagttattcagttaagacatgcattacattatttcttacttttcaaggaacaacacgttttatgactcaagattatctgtttagtgaccttgcagctgcacagctagagaaacagagtcttcgcaatgcctgggaaagggagagataaggctcactagccacagaaaaacagccagttaatttttaaaggactccagccctttctcttcctcaaggggaattggttttttacatayaactgagtttttgcttacacagtttttaatttcttttaattcctgttctagtattttggggctaggttgtcaggtatgtatatatttctgtytgttatattttcgtgatgtattcactttatatcatggcagaatgtttctctttagtaagatttttgatcttaaaaaagttggccagatggggtggctcatgcctgtratcccagcactttgggaggccaaggcaggtggatcacctgaggtcaggagttcaagactagcctggcgaacatggtgaaaccccgtctctactgaaaatacaaaaaaattagccagcyrtgatggtgtgygcctgtaatcccwgctacttgggaggctgaggcacgagaattgcttgaacccgggaggctgaggttacagtcagccaagatcgtgccactgcactccaacctgggtgatagagtgagactctgtctcaaaaaaacaaaaaaattatttagtctgacgttagcatttctcctcaagctcccttacggytgtttgcatagcaaatctactatccttttgctttgacctatttgtatcttwgtttctaaagtatgtatgtctctcacaggcagcatatagtcaaagcttaaaaaaaaaatccagtctaacgatctctgccttttgattggcatgttcattctattcccattcaatgttattattgctgtggttggatttccatctatcagttcacaatttgttttctatgttttatgcctttttgttcttctgttcatcttttactaccttcttttgtattaagtattttctagtgtagcatttaaattccctttttctttttaagtgtatattttaaagttattttgttagtgtttgctccagggattacaatatgcattttaatttatcaggatctacttcagattaatactaattttagtaaaatacaggaacttgactccagtataactccatttcctccctccttgcttgtggtttgtagtattattgtcgtatatgttcatctatatatgttataaactcaacaacatggtgttataattattgtttcacacaatcttatttcttttcaattcagtaagacaagtaaggagaaaaacacttttcaagtcttttatattacactgtatatttatcactgactttactcttgatttcttcctgtatattcaagytattgtctggtgacctttccttgctccagtatatataataacttcattgcctccttgctcctttatgctrttattgtcatatatattatatatgtttatgctgtgagcccatcagctaagtcagcttagcaaggtctcaagatacaaagtcaatgaataaatcaggctgggtgtggtggctcacacctgcaatcccagcactttgggaggccaagataggtagatcactygaggccaggagtttgagagcagcctggcccacatggcaagactccatctttacaaaaatacaaaaaaaaaaaaaaagttgagtgtggtggtrygcctgtaatcccacctacttgggaggctgaggcatgagaattgcttgaacccaggagggagaggttgcagtgactggagatcacaccactgcactccagactgggcaacagggcaagacwcagtctaaaaaaaaaaaaaaaagaaaaaagaaaaacaagaataaatcaattatttttctataatacttgccacaatcaattgaaccatgaaaaattttaaataccatttacagtagcatcataaaacatgaaatatttagagaataatttaccaaattaggagaaatgtctatacaattaaaactgcaatataaaccaggcaccatggctcatgcctgtaatcccagcactttgggaggtcaaggtggccagatcacttgagcccagaagtttgagaccagcctgggtgacatagtgagaccctgtctctacaaaaaaaaaaaaaaattagctgggcatggtggcatgcacctgtagcccctgctactcaggaggctgaggtgagaggatgacttgagcccagtaggcagagattgcagtgcattccagcctgggctacacagcaagaccctgacaaaaaaaaaaaaaaaaagaaaaagaaggtcacaaaaaaacagaaaactgcaaaatattgatgacaaaaattaaagaagacataaataaatggagaaatataccatgctcatggattggaagacttacattgctaaactgtcacttctccccagatggatctacagagtccacataatctcacttaaaacyccagaagaaatttttgtaaagttgacagctgattctaaaatkttacatagtaatcagaataggttgatattaggatagacagatagttcaatggaatagaatgcagagtttagaaatagacctacacagaaatagtcmattgattttttaakagttgctttttgataagggtgctaaggtaatgtgatagagaaaggaaagtattttcaattcaaatggctgaaatgactggatatccattgagggaagaaagggactttagcctttcacacaatacacaaaaattatggaattctgaagaaaataagagaaaatgttcatgaacttggggtaggcaaaaatttaatagatgagscaaaaaaaaaaaaaggcccaaaccataaaaatggtttcatttttataaggataaattagagtttataaaaattaacacttcccttcaaaagaaaaattaaggaaaaatgaataaataagccaccgactgaragaaaatatttgttttctaagaagtattttgtttttcattttatgggttcatagtaggtgtatatatttatggggtccctgagatattgtggttcagtcatacaatggaaaattcacatcatggagaactggtatccatcctcttgagcaattatcctttgtgttacaaacaatccaactatactcttttagttatttttattctttttttttttttttttttgagatggagtctcgctctgtcacccaggctggagtgtggtggcgccatctcaactcactgcaacctccgcctcccaggtttaagtgattctcctgcctcagtttcctgagtagctgggactacaggcacccaccaccacgccyggctagtttttgtatttttaaactttttttttcttttttctttttcttcttttttttttttttgagatggagtctcgctctgtcgcccgggctggagtgcagtggtgcaatctcggctcactgcaacctccgtctcccaggttcaggagattctcctgcctcagcctcccaagtagctgggattacaggcatgcgccaccacacccagctaattttttgtatttttagtagaggcaggatttcaccgtgttggtcaggctagactcgaatgcctgacctcgtgatccacccacctcggcctcccaaagtgctggggttacgggcgtgagccaccacgcctggccttagtttttgtatttttagtagagatgaggtttcaccatgttggccaggctggtcttgaactcctgatctcaggtgatccacctgcctcggcctcccaaagtgctgagattacaggcatgagccactgtgcccgacctctcttttagttatttttaaatgtgcaattaaattattattgactatagtctccctgttatgctatcaaatactgggtcttattcattctttctatttatttgtacacattaaccatccctacataccctctcacccctgccactacccttccaagtctctgcgaaccatccttctattctctatctccatgagtttaattgtttcgatgttttgatactacagataagtgagaacatgcagtgtctgtctctctgtgcctggcgagaaaatatttgtaatatttgtatttggcaaaggacttgtatccaaaatatagaaataaattctgctcaataataaaaagagaaacaacttaatgagacccagtgtctacaaaaagtagaataattagccgggcatgttggtgcatgtctgtagtcccacctaatcaggaggctgagggggaaagatcacttaagctcaggagttcgaggttgcagcgagctgtgatcgtgccactgcactccagcctgggtgacagagtaagatcctgtctaaaaaaaataaaaatagagggccaggtgaggtggcttatgcctgtaatcccagcacattgggaggctgaggcaggtggattgcttaagcccaggagttcaagaccagcctgggcaacatggtgaaaccccatctctaccaaaaccacaaaaaatcagctagatgtggtgcatgcctatagtctcagctactcaaaaggctgaggtgggaggatcacctgagcccaggaagtcgaggctgtagtgagccatgatcatgccaccacactccagcctgggcaactggagtgggactgtgccccccaaaaatatatataagtaaataaataaataaataaataataaaatgagctaaagatctggacaggcttcataagaagcaagcaaatggccaataaatacatgaaaagatgatttacctccttagtcattggacacacttagataccactcctcatccactagcatggctaaaggataaaagagtgaccatcaagtgttggcaaggactgtggttctcgtacattcctggcgggaatggaaaattcagtcaccactttggaacacagtttggcagtttcttacaaagttaaacatacacttaccatatgacccatcttttccattccttggtatttactcaagggaaatgaaaacacaggtccacaaatacctgcacatgagtgtttacagaagctttgttgctagtggccccgaacagtgaaaaaaccacrgtgtctgtcaataggagacagaataaatgaattgtggcggattaacaatggcgtgcttctcagaaatgaaaaagaacgaacgattgatacacgtgacaatataggtgaatcttcaaaacagcatgcggtgtgatgcrgccagacataaaagagcatgtatcagaggattccgtgtatgggaaacgccagggaatcagatccatggttgtcagggtcaggagggaccttactggggtgattacatgtgtacatacattgtgtgaaactcatcaaaaccgtatacctaaagtgggcacattttattggatgtaagttatccctcaaattaaattaattttcaaagttttaaaaaatggaaccatttttgccacattgaaggaaaattatttccaccaagatttccctacagccaaacgatctaccaactacaaaaatggaaaaaataatttaggacatrtaaagttcaaatgttttgcctcccacgtttckgtttcaagaagctattcgagataaatcgctccgtggtcacaggacttagaaaggtggaggtaaacacacacaagcattataagataagaagtaacagatgaattagttgaaagggactgatttcgggggaaggaataggaactgggccaggagatagacgcctttcaggcttgcccttgtgaaaacgatagtcccctcttacctgcgggggataggttccgagatccccagtggatgtctgaaaccacagatagtaccaaaccctacagagagtatgttttctcctgtacacacatacctatgatagggtttaatttataaattaggcaccgggtgggattaacaaccataattaatagtaaaatagaacaattataacaatatactgtccgaggcgggtggatcacttgaagtcaggagatcgagaccagcctggccaacatggtgaaacctgtctctactaaaaatacaaaaaattagccaggcgtrgtggtgggcgcctgtaaacccagctactcgggaggctgaggcaggagaattgcttgaacccgggaggcggaggctgtagtgagccgaaggtgcccctttgcactccagcctgggcaacgagcaaaactccatctcaaaaacaacaacaaaacaacaacaacaacaaaaacaatatactgtaataaaggttacgtgaatgtggtctctctaaaaaaaaatgtgtatatatcttagtttgtgggttttttgttgttgtagttttgtttattattaagagacagggtcttgctctgttacccaggctggagtgcagtggtgtgatcatggcttactgcagccttcacctcctaggctcaagtgatccttccacctcagcctcctgggaccagaggcatgcaccactatgcccagctaattgttttttktttttttttcttgatagaaatgagttctcactaygttgcccaggctggtctagaactcctggcttccagcaattctgctggctcagcctcccaaagtcctgggattataggcacgagccacgatgcctgtcctcaaaatattttactgtactgtactcacctattattggcctttggttgaccatgggtaactgaaactccagcaagcgaaggtgtggataagggmactactgtacgtgactttaatatacataaaatcaccttaaagacaatgattgtttccagaacatgagcctctgagacagcagggagatactaggggaagttggtggctcctctccctggcaggaactggtctgggctcctggctcagcctggccatgaggctgtcctggcctccctcggtgggttcgacagtgacctcgacgtgctcatttcagtgtggttcattccggtctcccaggggaagggggtgctgagtggaaggaggtcamtgggaagccggggtggctctcagagtctgcaggagcagtcgggctgatgagctgggaggagcagaccgcctccctcttctctgagtgggaggagggccagatctggactgggtttggagatgctcaggtggggctcagagcatcacctgtggggcagagggaccatcttggcagatgaaggcccrtcgcagggtgtgatrcctgaattacraggygggacaggtaaagtggggcaggtgagagaaggagggtgagtgatgtgatttttctactcctgttttccaggaaaaccaaaatgccayrcacttcgacctatgatccttttcctaataatgcttgtcttggtcttgtttgggtaagacacatttgaccatcgaggctggcctggtttggggagaagtgaccacagcagccaatcagacccatggggcctccctgagctccccaagtatcacagttatcagggtcctaaggacagttattgcctgcgtccagctctggcggagggtgtgcttacttgctcccttattttagcctcacctgggcaacaggctcatctcactcccatttaaaattttcctaagtgtggagtctggggctgggagagcaagccccttgcccacaattgcgtggctgggggtggggaaggcaattctgggtcccaagctgttagtcgcttccagacacagaaggtcccagaaccaagagtgaagtcayctgtcasctctactggggcatctctggacacggyctggaaacactccctgacgtggcctcagggactgcactgaycaaggcactggtggcggggggtgagggagctggggctctggagctccagcaggtgcccatacgtgagcaatatcccagggaccaccctcctgcccacctccmggtgtgggacgtggcgaggcgcctgagctttgctgagaacttgccctacctgcctcgaggccttgcagcttcaccgggaactcttgtgctcacgctgctggccrcaccatgcactttttggaggaagggaccaacaggcagtcttcgttctgtgtcctgagtcttggcacacttcctttctgcagttacrggktcctaagccccagaagtctaatgccaggaagcctggaacgggggttctggtgagtgcagggaagagcaggtggagcatccatgctggccggggtgctggctgtgggcgggggtcccactctgggaactccccctccccttcctgggcccgctctctatgctctgcccagtgtagacatgctcaactctgtggccttgaagggtcacctggatacctctggagtcagccttgacctcccttctgacctccagtcyccaactccaggcttacccagagttcccatgcatggtctctgctcccccatccccacccctcctccaccagccatcctcaactctccctttgctctcacccctacactgggttcccaaatcctgccagccctgctcttcagcagctcgcgtgcccactggcctccctgccttcgacgtcctgctccagggctccggtggggctgccctcatctctgtgacagcctcagacttgtctccccatccccatcagccctgtcccccttcttctcacagyagctggagtgatctttccagaacataaggtaggaggctctccatgwtctgatcctgccttcctgacctccccagcctcatctctccctcctctgcyctcgccctctgtgctccagccaacgtggcctgtcactcgtccacctgccatactgtcctgactccaggcctttgcctgtgctatggcctctgttgggaccactcttgtctctcccctgctgtgtctgctaattcccactcgtgtcagtgatccatggctgcagaacacaccactccatccatggaaaacaatcacaatcattgattactatctctccctgggcttcctggggtggactgggctcagctgggtggttcactttggggcctcagcagtcatgggcagacagtggctggggtcactgcaaagacttccctgcatctctggcagttgatgctggctgtcatctgagacacctacccagggcctctccctggggcctgggctcctgctyagcttggttgggaggctccaagaccaacatcccaagaaagatgagacagaagccagatcacctttttgggcctggcttcagaagtcacccagcrtcacttctgctgcatttatttcttagaaacacagaatatcagaccccatctcttgatgggagggggcctcatggtttgtagacatgttctgaaactccactctgcccggccttggcttcgacgtgtctggtgaatgtgtgggctgtgaggctcccygaacgtagacctcagactgcaacgytggccgttacagggtctggcacacgggcccacgycaggcccatcgccacagtgatggttgttctgtgactgtttctggtggcctctgctccacactccaggctgacgctgtgycccttccactgggaccctcgggtggcttccatgcacttgtgccctaaatcctgctcctagactaaacttcatctcctgtgttctcattctgcagcatggctgttagggaacctgaccatctgcagcrygtctcgttgccaaggtataatgtcagtgcctcccttcagtgsctcccatgtcacagaattgtcctgcagccctggcacatgtgtgccatgtgggagctggggcaggtcctctttcctcctgtggctcygagggagggggccgctccttccccagtctctaccctgacttggccctcrtcctgcagccactcagagagcacgatggagctggagcttcagttttgaccaratgcgtgtcgccggcttttgtgtgtgtgtgtgtgtgatggagtctcgctctgtcgcccaggctggagtgcattggcaccatctctgcccactgcaacctctgcctcctgggctcaagtgattctcctgcctcagcctcctgagtagctgggattacaggcgcccaccaccacacctggctaatttttgtatttttagcagagacagcgtttcaccatgttggccaggctagtcttgaactcctgacttcaaatgatccgcccgcctcagcctcccaaagtgctgggattacaggcatgagccccggcacctggccttcaaattggcttttaaagaagatgaccagctggtctgttctgtctggggccttggagggctgtttcccaggatgtgggcctttatcagtgctgacctaggcaatcaaggccaagctggccacactgcttttgattttttttaaattgtgatgaaatacgcttaacataaaatttgccatcttagtcattttggagtgttcagtagckttaagtccattcacattgctgtgcagccatcaccaccatccatctccagaactcttttcatcttgccaacctgaagctctgtccccataaaatagcaactccattttccctcccccagctcaccattccatggtctgttgttatgagtctgctactccaactaccttttataagtggagtcaatggtacctgtgtttttatgtcgggctcaaatcactgagcgtgatgtcctcacggtccatccaggttgtaccaagtgtcagaatttccttcctgttttctgctgactccctgcttttaaaggccatcttggacattcaaattgtggccattactgacagttaaaatggccccggctcatgtctcctgagcctctacaatcctttaggtggggacagtactgcggcccacacgtccccacaggctgcgtgtgacacytgacagtgctttgtgccactgtggagcaggtgtcactctcccacttctcagagaggaagccgggctctggaagccagcagcccacaaggaggcccagcaggcttcgggcccaggtggggaggtctgcacatctcagggcctttccctgggaacaaccagggacagaggccacacacccagcctcctctctgcccacagtgaattgagacacaaccccttacgtccctcccagccttaagtcaagtggaaagcaatggcccctgaggtcacttagtccctcttgccagtttrtaagtgctgaatcagagactctgagcttyggccctttcccgagktcccgggattatgagctgacacagcccccaagcaaccacagtgattccagcctgggagtgtggccttggcgggagggtcaatgcccagtcatggttcagcggctgtgcacacccctgcttacctgcatcccacgctttccatgcaaactcacgtggcggcgctttgygcttgcaggatggtctacccccagycaaaggtgctgacaccgtggtgagtaaagttactgacactgaaactgaacgcagctcaaggggctgttctgaaggtattagagggcggtttccttgatgtaaatctcagttggggctgcttcgttctctcctctcagattctcctgacatctgaattcagaggcccacatggctgtcctctttccctttgctttcwctgacttgcgtctcttgtttcctgtccctttgttstccaaagcccctgcaaaggcctgataggtacctcctacctggggaggggcagcrggggttgggtgctggggagggtttgttcctatctctttgycagcaaagctcagcttgctgtgtgttcccrcaggtccaatgttgagggagggctgggaatgatttgcccggttggagtcgcatttgcctctggttggtttcccggggaagggcggctgcctctggaagggtggtcagaggaggmagaagctgagtggagtttccaggtgggggcggccgtgtgccagaggcrcatgtgggtggcaccctgccagctccatrtgrccgcacgcctctctccatgtgcagtaggaaggatgtcctcgtggtgaccccttggctggctcccattgtctgggagggcacattcaacatcgacatcctcaacgagcagttcaggctccagaacaccaccattgggttaactgtgtttgccatcaagaagtaagtcagtgaggtggccgagggtagagacccaggcagtgkcgagtgactgtggacattgaggtctctccttgtgttcaagacagagwggggtggcggccagccttgtcctcccagagggtagatgggaaaggtcattcatgcagcatcttactgagctcaygtgggctcgtgggctygtgggctcrccaggtcggtaaaacccagctccttctccagaggctgcgtctcacccagggatggtggcttctgctgccccctcctctctgtractgtggcyggccgtcatgctgagccaccccctcaatacaaggctccagatgtttcctgctcactgaccagagatagcaggagggggacacctgtttgctgtccttggaccctagaaagaggatgctggcagagccgtggtcacttctctgtcagatgtaggtggggcaggcaargcagttggccccagacaccaaaggaagtggctgacccacaaggccctgggactctgggccaggccagagagggagctagccaggcaaccgcagacacatacttgacttctcggcagctgtgggcagctgggccagcgacagtggcggaggccaggaatgacttactcttaggaataggtgcrgttcaagcctggagggaggaagctctagggtgcagaggcgggtgtgtggaggcctcgcgtgcagcttataatgagggagcacgtggccggcctggccataagaggggcagctgcgtggggaggcgtggctcaggccaggctgagggggagtgagcgggcgccagcctgcggcctgctaccagcctccagccacctgccctcagccctccttagtaagagggggtgctggtggtcccccatcgctgggaagaggatgaagtgagtcgcagcccgaggactcgctcaggacagggcaggagaacgtggtgcatctgctgctctragccttccaatggccgctggcgggcgggtgcaggacgggcctcctgcagcccaggggtgcrcrgccggcggctcccccagcccccgtccgcctgccttgcagatacgtggctttcctgaagctgttcctggagacggcggagaagcacttcatggtgggccaccgtgtccactactatgtcttcaccgaccagcyggccgcggtgccccrcgtgacgctggggaccggtsggcagctgtcagtgctggaggtgsgcgcctacaagcgctggcaggacgtgtccatgcgccgcatggagatgatcagtgacttctgcgagcggygcttcctcagcgaggtggattacctggtgtgcgtggacgtggacakggagwtccgcgaccaygtgggcgtggakatcctgactccrctgttcggcaccctgcacyccrgcttctacggaagcagccgggaggcyttcacctacgagcgccggccccagtcccaggcctacatmccyaaggacgagggcgatttctactacmtggggrsgttcttcggggggtcggtgcaagagrtgcagcggctcaccagggyctgccaccaggccatgatggtcraccaggccaacggcatcgaggccgtgtggcacgacgagagccacctgaacaagtacctrctgcgccacaaacccaccaaggtgctctcccccgagtacttgtgggaccagcagctgctgggctggcccgccgtcctgaggaagctgaggttcactgcggtgcccaagaaccaccaggcggtccbggaacccgtgagcggctgccaggggctctgggagggctgccrgcagccccgtccccctcccgcccttggttttagcagaacgggtaaactctgtttcctttgtccgtcctgttgtgagtaactgaagcctaggccccgtccccacctcaaatcacacacaccccctccccrccacagagacaccattacatacacagacacacacagaaagacacacacagacacaaaatcacacacacaccctccccgccacagagacaccattacatacacagacacacacagaaagacacagacacaaaatcacacacacaccctccccgccacagagacacaccattacatacacagacacgcaatcgcagatacgcccttccggccacagaaacacaccattacacacacatacacagaaagacacacacagacacacaatcacacgcagcccctccccgccacagagacacaccattacatacacagacacacacagaaagacacacacagacacaaaatcacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcccaaattcagcgcctggggcataagttcctggaggggtggccaccttcagcccccacggtaaggtcctgaggaaccttccccttagacaagggatcatggaggaggtctcttccggagcctggagggaggcctcaagtggtccttccacctcggcatcccaaagtgctaggattataagcatgagccactgcacctggccccaacatcatttattgaacagactgtcgtttccacattgtgtttcttggcatttctgtcaaaaatcagttgaccgtaaatgcatggattcacttccgggctctctattctgtttcattggtctgtttgtttttatgccaataccatgatgttttgattattatagctttatagtatatcttgaagttaggtagtgtattgtctccagctttgttctttttgcttaagattgctttggctatttaggggtctttgtggccattactgacagttaaaatggccctggctcatgtctcctgggcctctacagtactttaggtggggaagtactgtggcccacatgtcccaacaggctgtgtgtggcacctgacagtgctttgtgccactgtggagcaggtgttactccctcatacgaattttaggattattttatttatttcagtgaaaaatgtcaatgaaattttgatagggattgcattgaatctgtagattgtttggggttgtatggacattttaacaatattaattcttccaattcatgaacatgggatgtcttttttttggcacctgatctcagatatgggacagctttctaattatttgtatcttcaatttctttcacaaatgttttatagttttcagcatacagatctttcacttccttggttggatttatttgcaagtattttttgtagctattgtaaatgacattgttttcttgatttctttgttagggtatagaaatgctacagattgttgtatgttaattttatatcctgcaactttactgatttcatttattctaacatcttattggtggaatctttagggttttctataagatcatgtcatctgtaaacagggacaatttaagttcttcctttccaatttggataccttttatttcttcctcttgcctaattattttggctgagggccaacttgttgggtttgttgttgttggtttttgtctgtgtcttttggtgtttcgtgttgctggcttttccagcacacagtcgcagatatatgaggcagaaagaaaacccagggaacgcctgtcatgtcattcctcaggtcccaaggtccctacatggtctgccttcttctctccaccttttagtgtttggcatacatacgtttatgtatgtagttatatatgtatgtgtaatacccagggaaatatacagggattttaactgtccttagtgtagggcgtggggacaggtgcatctattctaccttgcctggaagtggaaaaatcttcaagaaatcaatttatcaccaactggcatgacagaactcctggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttcttcctgactccaaaagccaggcgccaccccatgctccttcccagcagaagctggttttcaccgggtcaggaggacaggatggctattcctgaccgttgtacagcagtgccacatctcctagtttccagaacatttaatgtgttgctgtggaggcctggcagctctgaagtagccccttgcgcccaggacaaaccgggcctggaggggtggggtggggtaagctgaagcttccagtatcccacgtgggcattctgttgctgagggcaaccgcccctccctgcaagggaggggaaggagcaggcaggcacacccktcctccctccacatttcactggagttgacctgtgtcctactgtggttgcacctggaccagcccagagggactggagtgactcttcccgcaggtagggcacagccagcctgggcacagggcctcactgcaatccctgcgccccgcctccctgggggatttccaggggttgtcctgctgcttggtgagctgggggtgtgggggaccacagatgaggcaggcgcctaaattgcttgggcggagtccggctgctctctccctccaggccctttcctgtgtcctcgggcccctcgggtccctgcaccaggccagcagcaatcgggtgtcagaggttcaagtccaggctgactcctsggacgcaccgactttgcccaggagggctggggagagggcagccccaaagtgtcatctttgattattctttgtccccaaagccagccttgggcatgtgcccagcacagggagagctgctgcctccgtgggcttgagtcatttttgcttccttgcccctctctgctctgtttggtttaaaaaacaaaaaccaacacccatgggtgaggcgaggcgaggcgaggcttgccttgatccacccgcttcctcccctgcagcctcgggccccatcctcccgcgtggccgcactaggggtgctgggggcggagtggggaccagacctgagtgggttctgggttcagcttcgcagcaggagcagctggggcatcatcagttgggcaggtgacccaggatctgaagcaggaatcttccaggtggaggtggggccgcccctctgcttgccacagctgccttctgctctgggggcagcactggctgagaatccagtgaagtaaggcctttgaaatggttttgattgtaaaagtaatgtttatgtttagccattcctttttttattttttattttttgagacgggtctccctctgtcacccaggctggagtgcagtcgtgaaatgtgggctcactgcaacctccacctcccaggttcaagtgattctcctgcctcagcctcctgagtagttgggattacaagtgcctgccaccacacctgactaagttttgtattttttagtagagatggagtttcaccatgttggccaggctggtctcaaactcatatcctcaagtgatccaccctcctcgtcctcccaaagtgctgggattttgccatgagccaccacgctcagccatgtttagccatttttaaaaggtgtgaacagataattaagtctattagcaacattagaaaatttaagttaaaatttaaatgactctagcaagaattagcctttaggtgccctgggtccccctccccaccgccccccaccccgccgccttctgagaagcgttttgtaatttttcttatttataaaatgggtttgattcaaaactgacttttcctcttcacagtctcacaggtccttccccaggtccaagaggctcttctgtgtcctgatgacaagtagctgcctagccgtggtggcacctcctatcacatgttaagggacccctccccagggccacacctggcagaaggtggcttatgatgttcgcagcttgaaagtagtgtaaaccaaagataaaattctaagcccactcccccagccatcggaatggacccctcctcttggccagggcactccaaagttaacctgaaaaaccggttcaggctgtgaagagaaggtggagtggacatgcctcatttatgtcctcctcccttttggaattcagcaaagctgaccagcatgaacattaacacagaccttaagtctgattagtggcatttacaatctatactctctgaagcgtgctacctggagkcttcctttgcatgataaaactttggtctccacaaccccttatcataacctagacactcctttctagtgataataactctttcaaccaattgccaataaaaaaattttgaatctacctataacctggaacctccccgctccaccttcgagttgtcctacctttctggacagaagcaatgtggatcttgcatgtatttgattgatgtctcatgtctccctaaaatgtatacaattaggctgtgcccagatcaccctgggcacatgttctcaggccctcctgaggtctctgtctcgggccattggtcactcagattcggctcagaataaatctcttcaaatatttttcagagtttgactctttttgtcgacaataagctcatcagattaaagctgttggaactttaaattacttccagccttgaaagaatgtgattctgacaccctagtcaagcagcaagtcgctgtgaactttgcttctccaattatagattaacgctcttcctttcttgatttgtaaaatgttatgaaagactaaatggcaccagatgtaagaccccttccctttcttagttactgaccttttgttacgaattaacttctttcttttcttgcacccaactcagaccagatggtacaaaagaccccatgcctatcaaattccataagacagtatgttaaatatacttttcccgaagggaacaggatataaccaaacaaattgctgcaactcataagccaatcttatgtggaaaatgtaatcatgctaaacctccttgtattttcccatttaagtgaagcccaaatccctccacctcagagcactgagcccattcctttagagtctgtgttttttgagtggtggtcgtcaaacttagagttcgaataaactctataacattggattttgaacctttcaattatttcaggtggcagaagaaacacacagaccccatctcttcctttggagttctgtactgctcatttcaaagggatttcatcctgccctctgtaaccacccaaggggttcctcctg

SEQ ID NO: 17733 - DNA, 121410 bp, Homo sapiens
cggggctttagggctgagcataaccagtcctgctttttatcttctctttctcaaccccatctcttcttcaggaaacatttaccagatgtgtggcttgagtgtccattcccgcaacaaaaacgctctgcagtaaagctccgagatggctgtgtttgtgttggactgctctagatggtaactttgaactgtgtctttctgctactgcctagctgcctccttgctctcagggaaagagcttcattttattgcaaacgtatgattaaagtcatacatggtcaatattctgaactttctatcagttcttagcatccccacgaggaagcctggctaataatggtgtaaacacagtgatggggctgtgtggactctgaactcgcttccaggaatctctgagctgggagtctggtgacatgaattccatgtgccgtgttttattcataccgccctgaagtaagagccatagagtttaaccccctacagagtggcttgtttctaattgatagggctgattgcccatcatgagggtgggccttttttattggacttattaagagacaatagactatgtgcatgcagcccagagtgcatagagcaattttgagccagtcacggacacggagagcggaggggaagggataatggggccgtgagaggctctcctgccctagggtacctctcttccctggtatcatgccctcatttcatggttgaggagaggaggaggtaatgggatcagggagagggtgcacttgggaagaagagggtatatttctgggaagcctcatgtaacatgaatgtgtggtgcagagggcctggaggaaagtcgcagtgactttggtatggggcagagaagatcatgaacatgggcactgtgatagtggggctgacttgataccacccgctcccactgccctcccaccgccctccctgttctccagcttgtttgaggagtggtctgagccctcaccatgtcaatgcttcacagcttctcccaacgtctcagtgctgttgcgtctgccttctgaagcgtgttaaatgtgcatttccctccgtgtccactgccttagcctggagccccttcatcaagccccrgggactgttgttccagctactaactggtctccctgcctctactttcccctgctccaaccctctcccagcttcctagacagggcatctttctgaagcacagatccctcctgacagagtcttccgtgggagaaaaaattaacaacctgttatcaagcatggcccctgagcctttgtccccctgcggaatggggcagatcccactcagagggcagcacccttcccaggttgctcaagacccctcatccccacttaaggggactaggggattgcatgtgcggggcaggggcactgcagggagcacctggaggagtcctaaccagcagcacctcactggtgctacactgcccagctgctctcggtgagtcagcacactgtggttgagcaatgcgagcccagaggcagagtccaacgtgctttgcaggacttagaggcatttcccggactcgcggagacctacctttctattgactctctctattttttttttttaaacagtggccaccaccctcccccaaccttgtgcctttcctggagccccgtctgcttttttccttgcatgttttgcacatgctgttggcttctgccatgtgcttcgtcctcttctctgtccagtgcagccctttctgacttttcagtccctgcccagctgcaaagtcttccttcaccccttgggtgctttgtgcgcttgtttgttgtagtgcttctcaggtcttgttttattttctcaatctgatttttaaagatgaacttattttgttctaattcacaaacaagaaaatgcacctgttttaagtgtgcagtttgacgaattttgaaaaatgtatagacctgtgtaataaccacaacaggcaagatataggatatttctaacccctcaaaagattcccttctgccccttcctggtcaattccccttaccccagtcctacaaaattattggtttgatttctatcattatagatttgaaggtctttcctggagcttcatataaatggagcatagagtacgtgcttgtgtgtgtctagtttcttgcactcagaatgatgttttgggattcatccatgttgtgtgcgccagtagatcatgagcactattcaattgtgtgactgtgccacagttagtttaccagttctcctgcagcttgggcactttctaattttgggctattatttttaaacttactctgcagtacagctgtttcatgggcagatatttttattctcttgagtagacacctaggaatggaactactgagtcaaagacaggcatatatttagttttatatgaaagtgccagcattcccccccgagtggctgcagcattgcacattctccccagcagcgcagagagctctggttgctccgcatctttgccgacatttgttcttgcccatcttctaaattttagccgttctgataggtgtgcagcgctcgcttgttgcgttaatttacattcccctttatcacagtgtattttaattatctgcttaagagtcagtctcacccgtcagaattcagtgcagggaaactgcattcacttttgctggttgaatgaacagtctgaacgccacatggtccttttcctcactccacttaaaatcaaacagggacagccgggtgtggtggctcaagcctgtaatcccagcactttcagaggctgaggtgggtggatcacctgaggtcaggggttcaagaccagcctggccaacatggtgaaaccctgtctctactaaaaatatgagaaatgagctgggcctggcggcggcgcctataatcccaactactcgggaggctgaggcaggagaattccttgaatccagaaggcagaggttgtagtgagccgagatcgtgccactagactccagcctgggcaacacagcaagactccatctcaaaacaaaccaaaacaaaaaaactccagtacatcctggacagatgatgcattggtgccaggtgaaggtggggtgactgaccatcccagtgtgcccaggcctgagggatctcttgggctgcaggacattcaatcctaaaaccaggactatcttgggcaaactaggatggctggtcatccagggaaggtaaggggccagcatgaagatagcagtgtgacatttagtcataattacaccaaaatgggactttctttctctataattgatcttaacttagctcatgaatccctacttctgcttatggtggaaaaattcagttttttccagctggtatggtttgaatgtgtccccacccaactctcaccttgaattttaataattcccacttgtcaagggtgaggccaggccgggcacggtggctcacgcctgtaatcccagcactttgggaggccgaggtgggcagatcacgaggtcaggagatcgagaccatcctggctaacacggtggaaccctgtctctactaaaaatacaaaaaattagctgggcgtggtggcaggcacctgtagtcccagctatttgggaggctgaggcaggagaatggcgtgaacccgggaggcggaggttgcagtgagctgagatcgcccactgcactccagcctgggtgacagagcgagactctgtcttagaaaaaaaaaaaaaaagggggtgaaggggtgaggccaggtggagataactgaatcatgggggcagtctccctgatactgttctcaaggtagtgaataggcctcatgagatttgatggttttataaagggcagttcccctgcacacactctcttgcctgaagccatggcagccatgtaagatgtgacattgctcctcatttgccttctgccatgattgtgaggcctccccagccatgtggaactgtgagtccattaaacctctttccttgataaattacccagtcttgggtatgtctttatgagcagtgtgagaacagactaatacaccatctcagggtcactcaggtcctctcagtcctacatatggttacttaagggtttgaaagagctcaagattctttgcctttcttcttttcctctcttctctcattgctgcccacaattggagctgcttagtgatatggacctggtcactgcaccttgtgctgttgatttctgtgtgtcctgcatgggccctgcatgggtccgtggggcacgtgctttgtaggaatagcccaggaactttccaaaacccttctgtagcttgctggggtgatttgaaccttgagacttccctcaagcccatcttcccaggtatccctccctcccctacccactgccaacccccttgttgcccatccacaggctccatcgtggagtgggcttcaatccaaggtttacagtctctggctggagcctggaaatcaacacaatttcctcgttttctcatgccccctactccctaacttccatttctgccccaaccctagtcgtcttccctcagtgttcattgtgttatgtgctggttcaaacgtgtacttcccttgaacaggaactctctggtttatggcataacgttatgctccaggctcttgatatataaggatatgttctagagttccaacaaataaaagcaaaaataaaaccaaaattcttctctctcaagtggcagacttaaaagtcaaggtttttaagattcacattttgaaaaatcagcttggtgactatgctggtttctcgactccatcctgtgcttgccctcctgtcagggcagtgcccggcgaatgcaacctgctgccttagtgtgggggcagaaggcataggggaggatggaggagagaggcggctctggagtgaggtttgaaggcttactggagatgtgtgaccggagattgactttaaagggcaaactttggctaagggggtgcgggggctggaaaccccttccacagaagaaacctggcaagaatcaaagcacaaagttggctgcgcctggtgtcagcccctgataagcagcctgactgcaggggaggacgtggctacagggcagataagatgtaagggtggctgaggaggtccctgggcagtttatctcatacctcccactggcttctgcgagcccaggtgggtgccaaggttagccacctcccccaaacctgctctcctattcgcagcacaaccctcctggacaaagcgtttttcctcagccttcaccacccatggaggaggtgtgattacctctattcacagaaaggagactgggacccaaccaaggcaagtcatttgcttcagaccacagagcaaagaatcattctgtcattccagaaatatttgtcaggcgcccctggtgtgtcaggtaggtgcaccttgaacatttgtttaatttgtacttaataacattttcaagaggacattacctccttaagtgaaaaatctgtgaggagttttctatctttctaagtctttgtggcacacttatcacatgcatagtactatttctcaagttacccaggcacacacagatgtatggctttcaggaagccatacatctgtgtagctctgaggcccagccttgttcaacacttcactcagaagaattgctggcctgatgaccaacaataattgtcaacaacttaaaacttcattgacggctcctaaaaaaaatcagtgtgcatgtgtgtgtgtatgtgtgtgtgcgtgtgtgtgtgtgtgtgtgtatgagtgtgtgtataacattcattactgcaaactggaatggagtggggctggaaggcagcccagaagcaaggctcagagcctggagctgctgacctcttggggacactgcagccctggcctggcctacttttctcttctcccatatctggaaaatgaaagtagcctgacgtatccggggacccggcccaagactccacccattggcagctcttcacttgtatcttttcatatcaaaaatgggaggtgacacccagtttaaggaaaattccaaggcatttgtctcgactaatgtgaaagatgattacagtggccagaggactgccaaggctccttctcaagctgcttgagtcaatgagggtaaggttttaaagggcccgccctggcttccttgggcctgtagtttgtgactgtgtcgttttcagagtgggaaggcccagagttggccccatggaattctttctgcttctagggtgtttgaagagatagaaagccagggtaaggttcaccgaacctccaagcaaaaataaatttccagaaggggcccctttactctgaggacattgaatagcaacaaaaactaccactgaagagtcattttgtcccaggccctgtgctggaaactttgaacacctgtgttcacccctccctcatgacactcatgaagatataccatggctgtctttattttctaggtgggaatctcaggcttgagggttggggtggcttggggaaggtgtgtatctaasaggtagctcttatttatttttacttctagagattaagacacattctttttcaagatagacatggaactgtcaaaaaggattaaaagttaaataaggataaggttatgtaaattgatcttatgtaaaaaaaaacactaagatatttgaagactaggcatcattatrtgttatatcatgatttttaaaatgatgctaccaagagtacttcagaggtccaaagctgaaatatatttgtatacttatatatataaagtaagggatacttatttaaaacctcaaaaaatcagaagtatgtaaaggaagaaataaaagctccctcttcccttctgattctaatttatatcaaatttatatctctatctgtagctcaatttgcctttttaactaaatagggtgatatcacacatatcattccttaacacttttctctcttaacgacttctaatggacatctatttgtggcactgtatatagggcatactttcttgaaaaatccattgcatggtattttattcttgaataaatcacttgcatggcattttattgtaagattgtgtcataatgtatttattcagttccctggtgatggctttatcatgtggcttttggctgaaagtatcagaaagtggcccaaactggcttacataaatttaccatctcatgtaactgaagttcaaagaaagagtggcttctgagtgggttccatactactagcataatatttggcatttccctgtatgtcccctcctctgtgtgttggttttgtttgaagattatttccctttatggtggcaaaatggtttttgtagtggcaccaggctttacaacctcttgtgagggaagagggagaaatgccatgccttaatgtgccaagaaggaggtgtgagatycaccctggttgaaccccatggtgccggtgtcctctcctagaccagtggctgccaagggccatcttccgaggaagcacctggactatacatcctccacaatgggcccttagaattggtccatatttttcaaaattgcaaataatgtgtaaaatcattgtacttggccgggtgtggtagcttatgcctgtaatcccagcactttgggaggccgaagtggggggartcagctgaggtcaggagttcgagaccaccctggctgacacggcaaaaccccgtctctagtaaaaatacaaaaaaattagctgggcatggtggcctgtgcctgtaatcctagctactagggaggctgaagcaggagaactgcttgaacccgggaggtggaggttgcagtgagccgagattgtgccattgcactccagcctgggtgacagagcaagactctgtgtcaccaaaaaaaaaaaaaaagaaaaaaattcgtacactttacatatagcactgtttacttgggcaattatctgtttaggataaactagaaataatattgctaagccaaatagaatataggttttaaaagtttggcgctttatcctccaaaacagattttaatagtttacacttgtaatagatgtacctggtttcttatacctcacttactggaatattagaaatcgtttagtctctaccaaaacatggcatttttctattatcttaattcacatttctttggttattagtaatcttgaacatgtttttcacgtctattggctttttgctttttgcttattgctttttgcttctttcttttttcttctgtggactgtttattcatgtcttttgcagtattctctcttggatttgtgagaattgtttatttattataaacattaaaccttgattggtaatacatgttgcaaatatttttccctaagttttcattgatttgccaaacttagtttttttttccaagttgtcttttctatgcaaaagttttcgcttttttgtaggtgaaactatgagaaattttcctttaccatttccgagtttaatgtcatgmtaagtccttcctgtcttgggaagatgtgttcacagcccactgactgaaggcccttcccggccagttctgagcttgagctgagtcaaatgtaaacagctcctggggctgtgggtatagaaactccctttctctttgggtctggaataccatgatgccttttccctgtcctcatttttcttaaatgttttcatttaatccaggcattatgtactgggggatcaactattcgcaaaactcagtaaaaggcggattcccaaggctccactttggatgcagtaggtctggggccaaagcatgtgagaaaaaaagtgtcagcatttattcattccacagctatttcatgagggttcagggcatcattctggggaccacggatacaatacggtgaacatcatagacaaggttcttattctcatgtagcctaaattctactgggggagatggataataggtgaacaaataaacaaacaaactcatctggcaccaaaaagtccactaggcaaagtgctgactgtgaagaaaagctggggtggaaagagaggccatggcccctgcaaaatggaataggaacaaagatttaatcatttgcctctgaaaaatctcagtgatgagttccttccctcccttccctcaacctccagtgtagaggagactgatgatgattgacagggaagcactggtggcttctcagaagtccatgtgcctcttccactgccttagtcaccccttactctgcattttcacagaatctcagtgaaattgcttaaacctctgagtacctgagagatactcagggctctttcttggatgccaaatagataaaatattgactcttaaacatatgtctgaattcctcttgcctttccaaggtaggagaccataccatactcatttgacagcaccatttacggtcaacaaatctctaagctcaaagaagagaagaggcaaaaagcaaccctaccttatgcaattaaaaaaaaatctccctttatagagtttcattgaccctttcttaaaaccccctaaaatggacgtcaacaatgcccctcttttatgatgagaggatggaggagcaaacaggtcgagggacttattccaatcgaacgtctcagtagctcagtcccaaggagctctgccccagtagtgccacttcaagtcccatgttcttttcatcttgtgagtgatgagcagcacgtggtctctaggtttgcaatataatttaggatttactccttgggtttagttttggtaactctcaaagaagttcaaatattaagaattttgctagctgttttagtaatctattgctgtgtaactacctcttcccctacccccagtccagaaaacaacaaccatcttctcttttctcgtggttctgtgggcagttctgctccacatgacgtggtctggggctgcagtcctgtggatgcttctttgggctggtgaggttccatatggtgctttcacacgtctggtgctttggtgagacagtggggaggctgggctcagatggcaagctgtgatgactgggcctatctgcccatgtcatctctgggcctctccatatggtctttctgcattctctccagccgggtggcctattccttacatggtagtttggggctcctaaaagtgcagacatggaagctgttcaacctttgtgagatgctgccccagagctagcctaacatcccttcctctgccctctatgggtaaagcagaagcaccaaattcaagctgggaggaaaacaaacttcctctttcaaaggcgaaagtgacaaagaatttgcaggccgtttaaatccaccacattgtccagtcaggagcacccattttctcattgaccttctgctaagtgaagaggtagaaggaattttcacaatggcttttagaaaagtaaaacaatacaggaagggattttgctgtcatttaaaacatggtctgctccagatggaggatttggtgatttttattttcttctttrctaaacatttctgcatttcatgaagtttttcagtgcatcatttttattatcagaaaaacaatgacattttattaaatatatatatatttaactcattaattatctaactcattgaatatatattttcattctatatgtatatatatgtgtgtttacatataaacgtgtgttatgcgtattctttatacatttttctcttgttttttgagttggaccttggcaaagtcagtggtgacacctggattaccttgtgttaactttaatcagttatgtgacatccatgggattggcaagtaaaacaagttattggtagtgggagtttgaatagatggcttctaaacaccctcccagacactgtaccttcaactctctgatctcatccaatccagaccaacacttctttactaagtttctctgttaatcagtttgcacaggaaaatgtttccattcaacacatatgtatgatgagcatgttgtgacactggctctgtgtagacatagtgggcactgaggaaatctggggatcctgccattaggagcttgtgagctggcggggagctatggtgatgcacaaaattataacacatgctaaaagaacacagttaaaagagaaataaaatttaaatgttaaagaggtgattaccagttatttgaaaaaaaaattcacctctttccaaggagattagatttctacttttagaattcttcatacaaatacacatattttgagttcttgatctcagaaccccattgcatatattgcatgcaactggtttgcaagtttttggtacacacccaccccacacatacctgattgcctactgcacttcctagaaatgtcgaggaagcctagatgacagaagttaatttcttcccagggaatgtaaagcatatcttggcagataagaacgaaaatacaggttaaagacagaagatttcactgggagtggctatgaggagccatttaaatttctagcagcaaatgggtggcacaattggctttaagatgatcaatctattggcagtgtatcatagagcttcccaacttatctgtgccagggagggatcaacagtgcacacctgaaacttattacagactaatttcaagtgatattgtactgcttcaggtatgatataagaactttataacgctttcatttctcccttcctggtctttgtgttattattgctgcacattttycttctacatatgttatgagacccacaatacatttttaattttgcttcagttatgttttgaaatgttttaattaataaaaatatcttacttatgtacccatgtagttaccatttctattgcttcgtattcttttttttttttttgagatggaatctcactctgtcgcctaggctggaatgcagtggtgtgatctcggctcactgcaagctcygcctcccaggttcacaccattctcctgcctcagcctcccaagtagctgggactacaggygcctgccaccatgcctggttaatattttgtatttttagtagagacggggtttcaccgtgttagccaggatggtctcaatctcctgacctcgtgatccacccacctcatgtttccatttggtataattttctttttatctggagggcttccttcaacatttcttatagtgcaggtctgctggtaacaaattatttcagtttatagatgtctgaaaatgacttcattttatcttcatttctgaaagacatttttgctgcataaatttttataggtctagaattatttcttttagccctttaaagatattgatctagggtcttttggcttgcattgtttctaatgagaaatctgctgtcattcttttttcttttttttgctcttctttggcagcttttaagattttctctttagcaggtattgtaagcatttgattatgatgtaccttagtgtagttgtcttcatattttttgtattagggcttgttgcccttcttggatctgtgggtttacagttactgtatttggggggtttgtagccattatttattcaaattttttttctattaattcctctctcataatccccccttgagggacttccattacacatatatttggatattttacattgttctacaattcattaatgctctgctcattttttcaatcttcttttctcaccgcttaattttgggtagtttctattgccatgtcttgaaatttactaatttttgtttttctttctttctttttattttattttttttgagagagagtcttgctctgttgcccaggctggagtatagtggtgcaatttcagctcactgcaacctccacctcctggattcaagcaattctcacatctcagcctcctgagtagctgggattacaggtgcctgccaccatgctggtctaatttttgtatttttagagatgatggggttttgccattttggccaggctggtcttgaactcctgacctcaggtgatccacccaccttggcctcccaaagtgctgggattataggtgtgagccgtggcacccggccgaagtttactaatcttttcttttgtaatgtgaatttgccataatacaatctaatgtgttttctcaaatctaagatacagctgattttatctcaattagttattttaccttaaaaaaatctcttttgtgtctctgttcaacatgcttgatctttcctctagcatcttggccttatagaatagtcataataaatgttttcatgtccttgcttgttaattcttgctctgtgttagttctgcatcagttttgattgattcatttttctcctcctgttggttatattttcctgcttctttgcatgcatggtaattttttattggatcgtaggcattgtgagtttgacattcaggttagacctaacatatacagaacactccacacaagaacagtgaaatacacatttttatccactgcatgtggactattttccagggttgaccatatgtgaagacataaaacaatgcttagtacactaaaaaaagagagaaatcatacaaagtatattctctgatcacaacgaaatgaaattagaaatcaataaaagaagaaaatttaggaaagtcacaaatatgtgaaaattaaacaatatactcttaaatatcaaatgggtcaaagaagaaattaaargagaaattaaaaatactgtaagattaaagaaaatgaaagcacaatacaccaagcttatgggatgcagctaaagctatacatagagaaaaaattaaagaaataaatgagtatattacaaaaaaggatcttaaatgacttatcattccactctaataaactaaaaaagaagagaatactaaatgccaaatatcagaaggaagttcataattaagatcagagtagaaatagataaaatggggaatagaaaaaaatagagaaaatcaacaaaccaaatgtaggttatcttctctgaaaagataaacaaaactggcaaagcattcactggactgatcaaaaattgaaagatgactcaaataactaaaatcaggaattaaagaggggaccttacagaaataagagggattataagggaatactacgaaaaaattatatgccaactaattaaaaagcctagttgaaaggcacaaattcctagaaagacacaactgaaactggatcaagaagaaatagataatctgaatgggactataataaataaagacactgaattagcagtcaaaaaacttcacacacacacacacacacacacacacacacacacacaagaaaaaaaaaaggaaaaaagcccatgcccagatggtttcactggtgaattccaccaaacatttaaaagagatgagcagcaatccttcagaaaactatttcaaaaagttgaaaaggaagggacacttgcgaattcatcctagaaagtcagtattaccccggtaccaacaccagatgaaaacatcatatgaaaagtaaaataaagaccaatatccctgatgaatacagacatacaaatcctcagcaaaacactggacatgaaatagagcagctataaaagaatcatatgccatgaccaagtgggatttatcctaagaatgcaacattatttcaacatccaaaaatcaatcaatgtaatgcaacatattaatagaataaaggatggaattgcataatcatctcaatagatgcagacaaaatgtctgataaaatctgacaccctttcaagattaaaaacaacaacaacaacaacaacaaaccaacaaaaatcagcagagtagtaatagaagaggactttcttaacctgataatgggcatccaaaaaaccccacagctaacattatacttaatgatcaaagaccagtagctttccctctgtgatcaggaagaagagaaggatgtttaatcctaccacttctattcaacattgtactaagaatgctagctagggaaatttggcaagaagaaataaaattcatattggaaaaaaccagctctattctcaaatgacctggtcttgtatatagaacattctaaggaatccactaaaaactattagactactaaacaagctcagtaagtttgcaagatacaaaatcaatatatgaaaattaattgtatttttatatattagcaatgaaaaatttgaaaatgaaattaagaaaacaattctacttacaatagcttcaaaaagaataaaatagcataaacttaagaaaagaagtataagacttgtacactaaaagtataaaatattattgaaagtaattttaaaatcgctcaattaattgaaagacatcccatgttcatgaatcagaagacttaacttttttaaagatggcagtactccccaaatgtatcccagatttatcacaatccttatgaatatccaaattgcctttattgcagaaattgagaaactgctcataaaatacacaaggaaatgcaaaggatggagaatatccaaaacaatcttgaaaaataacaaagtcaatgacttacactcccattttaaaacttactacaaagcaacggtatccaagacagtaggatgttctcagagtataaatataaaaatcaataaaaatagaattaagaattcagaaatatgcccttacgtttatggtcaattggttccaagaaagatgccagcaattcagtgggggaaagaataatcttcttaataaaaggtgatgggacatctggatatccacatgtgaagaaaaaatttgcatctctatctcatactgtacacaaaaatttactcaaaaagcaatcatagaactaaacgtatgatctagaactgcaaaactcttagaaggaaatataaatataaatctttgtgaccttgaattgggcaatgcttccttaagtatacagcgccagagcacaagcaacaacaaaatagataattgcacttcaccaaaattaaatcctttcatgttttaaagtactctcttaagaaagtgaaaatatagctcatggagtgggataaaatattggcaaattatctgataatgaacttgtatccataatatgcacaaatctctgataaattaacaataaaaagacaacccaattaaaaagtgagcaaaagatttgaatggacatttcgctgaagaagatagataaagggttgctaagcacattaaaagatgctcgacattactggtcattagcaaacgcaaagcaaaacatactaagatgccatccactagaatgacgggatgaaagaggccagaaataataaatgttagtgaggacatagagaaaytggtacactcatttattactggaaggaatgtaagatggtacagctacttttaaaatagtttgtggttctttgaaatgttcaacatagagttgccatatgactcagcaattccactcctaggtatctatgtgacataattaacaacacaaaaatytgtacaccaattttcatagcaacattattcaaaatagccaaaacatagaaacaacccaaatgtccattaatggatgaatggattaacaatatgcagtatatccaaacaacggaatattattcagccatggaaaggagtgaagtactacctatacacagtacaacatagaggaaccttgaaagcattatgctaagtgagaggagctagttacagaagcccacacattgtataattccatttatatggaatgcttagaataagcaaatttatagaatcagaaagtagtatatagattgccaggggctagaagaaaggggaacgaagagtgattgctaatgrgtatgaagtttcttttgggggtgatgaaaatgctctgaaattggatagtggtgatgggtgcgcaactctatgaatatactgaaaccctttgaattgtacacttttaaaagggtaattttatgctgtgtgaatgacatctcaataaaattctcattaaaataagaatatatgagagtatctatttctaactgtagagatttttgcaaatcctgcagaaatatgctgaattagttacaaccagctaagggagcctgggatggaagagtttgaaccacacccaatggcctgcatctggtgctctcccaagatccatggaaataatcttccaacctgcaatgtaccagggcatctaccagcctggctccacggtggtttcaggcattgctctacaaatgatcaagttttcattctagagtacgaatgaggattgagttagactaactgtacaagggacaggaaataacagctccttccctgtcctggggtcagtggtttgaaaagcaccccatctatcagtgaatatccagcttcctgacaaagaaaagggctaggggatttgcccccaccctgtttagaaggcgaaggcgaattaggcctgaatggcgacttgattctcatctgaatatcagagaaacacatgtgttgcaggctacactggaagtcctaatggcttcagtttgatagtggatttgggcttaatggttgagcaactccagtggcttcctctcttgattacgttggtggctgtgagatgaactacccagtcatcagtcatcattatcaatggcccatttgcctgggatgctttggaagartgaaagagagtaaaggcagttctacttttaaagaagttaaaacatgggctacagagcattttcgtttattgtttatcaaatgttagcctgcctcagaatacctggagggcacagattcctaggtcccacctctggagctgctaagtcagttgatgtgggcaaataacctaacaccttggcattcacttccaggttttcttcatttcctcgtcctccctttccttcttcaaatgttctcctgttycttcttggctttataactatctttgtctctgcttcccttcctatacattgccttaattaatcctttaatttagattaaattaaaggataaatataaattaaaggataaattaaaggataaatctaatcctttaatttaaatattatttctggagatatatttgccatgtgatccattttgtttgttagaaaaacacaagagaaaaaaattgctgataatcttctcaaaaaggattatcttgtttgttctaaagccaaggatgtatagtgcatcttggaatgttttggattgaggtgggacatttgctttctttttgttttcaaacatcattaatttacttggtataagaacttcagaatcagcataaagtaaaagtagtttcttaggaatagtgtcatgataattccatgcacttaacatgaggtaggtgataacggaagtagtggttttcttgatttttcttattcaaactgcttcatcaaacaaaacaaaacaraacaaacgccctggagacagagagtcttattgtgccatagtatttctctttctctctcttttttaaatatttcaagcgagcatgccatcagcagggctgtcttcactgagctatttgttgctgggagatgttgtagactgttgctcggtcagtgcaaatgagagctgctagcctcgctgtaacctcgctggctgggtactctcagagattgttaagagttttaaaatttttctaatcactaagcatgttaggaaaccagagctttgtgtatgaagaacaacttcctctcagggactgtactcaaggctgaggtttggacctcagccaattttatgaacgaacaggaacaatgtcaaaaacatcaggattcctggtcatgaggaccagagggggccactccaatgggatggtaagcttctgtagggctggcacgtgactttgcacccctgatgctccgcatgaagggattttctgcacccagcaagtgctgactgatttcctgaggacacttagtcctactctaaactctaagaaggtctagggccacatcaggaaagtgagattcatgcactgactcatttccacacttcagaggacactttctttgagtgggtgtttggaaaaaaatgcaaggtagatgtaattctccacacatcagctgatgactcgtactgacagtgtctagaatagaactttttttttccttttgggtaggtaccttctccccagatggatggtgtgttccccagagtgccgaggtatttctgggtgaagtaatattgttcccttgtgtgtaatcctactagttctctttcatgaagtagctggaatgtctgagtggtcaagggtaatccctgagctggccttgacacaaacagatacgggctcttccatccttgggtccctctgttctgacacctgatgacacacttaggagttttcctctagtacctaaaactatagttagtaggtacttagaaacaattacaagctgtgctaatgctttttaaaagtggaaatatcggccaggtgtggtggctcacacctgcaatcccagcactttgggacgccgaggcaggtggatcacgaggtcaggagttcaagaccagcctgaccaatatggtgaaaccccatctctactaaaaatacaaaaattagccaggcatggtgatgggcgcctgtaatcccagctactcaggaggctgaggcaggagaattgcttgaacctgggaggcagaggttgcagtgagccgagatcacgccactgcactccagcttaagcgactgagcaagactccgcctcaaaaaaaaaaaagtggaaatagcaatatgtgctttagctaaatattaattttgtttttgccctgccttttagctctgtggtcttgaccarggcctcatagcgactctgaatctcttgcgactctgaatctcttgcgactctgaatctctcgcaatctcaattttcttgtttgcaaaactaagatgtagcagttataatgtgaggcgcaaatgagaaaggccatacaaaaaccctaaccaaaaaatccagtaaaatgaagctcagttaaactaaagacagcccgttgacatcttttgtgcgtttcctccttggttcccaggaatgctggaaaaagaggcatttgttctaaacatggaaatgcagcaaaataatgattcttttatggcctggtggtctggtttgacacaatcaataactaaaataaatacacacagcgtacagccctgtaataatagaggttgctcggaatcaactcacagtagtaaaaatcctggttgagaaattatccccaaagatgatatgattttatcgcccygtacaaagttaaccagtcttatacataatatggatcttttcaaacttttaaatgaagtataatgcatacacagaacagtgaactcatcatgggcaactaaattaattttcacaaaatcatattttgtgaatatgctatgatttattaatacattgtactgctgatgaacatttggatagtttctggtttttggctaataaatatagggctgctatgagtatttttgtatacatactttggttgacatttctactattttctgttggtcttgtacctgtgagtgaaattactgagtcataagatatgtatttgttcctcagcagtagttactgctgccacacagcatggttctgctaatatgtacttccagtgggaatgtttgacagttccagctgatggaaatctttaccagcrtttaatattttctcttattcattttcaccattctggtaagagtgtcccgcaatttcattctggctttaattgaatttccccaatggctaatgcagttgaacactttttcaaattattttttggccatttaaatattttcttttgttaaggatcagttcaaccttttgtttgtatttctattgggttacctagatttttcttactgatttgcagtggtttttaatgcattctgggtaagaacactttgtcagcagtatctattccaaatacctgcttcaactctgtggattgcatttcatttccctaatggtgtctttggatgaacacaccttgatttatcaatagtctttctttgattatwagaatattttgtgtctgttttacaactatttgcctactccaaagtcataaaaattttctcctgtgcatttctttaaaggctttattgttttacttttcacattcagatctgcagaccaacaattaagatttggatatggtattaagcagtggctcaaggttcaattttcatttctccatttgactatccaaatgattcagtgccatttagagaaatgaatactcttttctctcttcagttcagtggcgtgttgggcataaatcaggtaactatgtaggtgtgtatgagtctttttctggactattcattctattgcattggccagtttgtataaattttcactgaaatgctgtcctaattactatagccctgatataaaatgctatctagtagggtaagtctttactattcctcaagattgccatagctattatttgcatttaatattttcatatgaattttaaaatcacctgtcaattcccacaaaataccaacagcgattttgattgggattgcaattaatttataaatcaatttgggaataactgacaactttacaacatcaaatctttcaattattgaacatgctacattgtatagctccatttataagatattctttaacttctcttggcaatttttaaaatttttcagtgtagggaacttacatgtttttcatattttcagaagaatcactgtgtcagcaatagctttatttttaggtggttactatttttagtgagcttgtacatgaagtaatttttgaaacatttcatttatgacttgttcgttgatagaaataaaagtgattttaatattgaccttttatccactagcactgctaaacttgtttactgattttaataatctgtacatgcttgtgaatattccagaaaaacaatcatgccatctgcaaataatggcattaatttttaaagggtggtttcactgggtaagatttcttaattgacagtttagttttctttaggtgcttagagtatgttgttccaatgccttttggcctccgtactttctcataagaattcagttgttaatcacttcattgtatttcctgtatgtgatgggtcgtttttctctagctgctctcaggatattttctttatcattggcttttaacaatttgcttatgatgtgctttctttgtgattattctttgttgggttgtattgagcttgttgaayatgtaaattaatatttttcactgtttgaaaagttgtcagtcattattactttaaatattttctacgcctttctccccctctttttttttggggattttaattacatatattttggcagagccaggggctctgtttatttttcaacagactttttttctttgtgatctttcaactgtgtaaaaaactcactagttctttatctgtcactaatctgctctgggaatcacctcgtaaattaaaaaattctcgttactgttctttccagctgtttttaaacgttatctagcctccctttctctctcaaagattttatatttgttcactcatcaatatcttatttaaaaattatttgaacatgtttctctttatttttttgagcatattgatacacaacatgtggacctactcagagtsacctacatttttgaagcccatattttttaagatgtagaattccagttttgcaattattttccactcacacattaaatatattataggtgtatctcagagatattgtggatttgcttccaaaccactgcagaaaagtgaatattgcaataaagcaagtcacaatttcttttttttttggttacccattgcatgtaaaagttatgtttacactatactgtagtctattaaatgtatggtagctttatgtctaaaaaacaatgtacatatcttagttaaaaatactttttcacttaaaaatgctaacaatgatctaaggcttcagtaagttgtaatctttttgctagtgggaggtctacccttgatgttgatggctgctgactgaccagagtggtggctgctgaaggttggggtagctgtggcaatttcttaaaataagacaacaattaaccatgccacagcgatcaactcttctcctcttgaaagatttctctgtagcatgtgatgctgtttgacagcattttacccaaagtagaacttctttcaagattggagttaatcctctcaaaccctgacactgctttctcaattcagtttaggtaatattcataatccttttgatatggtttggctctgtgtccccacccaaatctaatgtcaaattgtaattctcgtgcatcaggggagggacctggtgggaggtgactggatcatgggagctgttctcatgatagtgagtgtgagttctcatgaggtttgatggtttaaaggtgtggcatgttcccccttgctctctctccgtctctcctgccaccgtgtaagacgtgccttgcttcctcttcaccttcttccatgattgcaagcttcctgaggctgctccagctatgtggaactgtgggtcaattaaacctctttccttcrtaaattactcagttctttctttatagcagtgtgaaaatggactaatatacccatgttgtcatttcagcaaatgttcacagcatcttcaccaagagtggattccatgtcaagaaatcactttctttgctcaaccataagaaacaactcctcattcatccaaatttggtcatgagactgcagcaattgattccaccttcaggctccacttttaattctagttctcttgctattttcaccacatctgcagttacttcctctactgaagtcttgaaccccttaaagtcatccacgagggttggagtcaacttctaaactcctgttaatgttgatatgttgacctcctctcattaaccatgaatgttcttaatgacatctagaatggtgaatcctttccagaaagttttccatttacttttccagttccatcagaaaaatcactatctatggcacctatagccttacaaaatgtatttcttaaataataagaattgaaagtcaaaattacctcttgatccaatggaaattgtgttagcaggcatgaaaaaacattaatctctttttacatcttcatcagagcccttggatgaccagttcccttgccaatgaacagtgatatttttacaggaatctttttttttttcccctgagaactagctctcaacartgggcttaaaatattcagtaaaccatgctgtaaacagatgtgctgtcattcaggctttgttgttaagtttatagcgcataggtagagtagatgtagcctaagttttgaaatgagaaatggacgttggcgtcaacttaaagtcaccagctttattagctcctaataagaaagtcagcttgtcccttgaagcttcaaaaccagacgttgacttcttttctccactataaaagtcctagatggcattttcttccaacagaaggctgttttgtctacattgcaaatctgttgtttagtgtagccaccttcatcaatgatcttacctagatatgtgtaacttgctgcagcttctacattaacactagctgcttcatcttgcacttttgtgttatggagatggcgtctttccttcaacctcatgaaccaacctctgctagcttccaacttttcttctgcaggtttctcacctctctcagccttcctaaaattgaagagttagggccttgctctgtgttaggctttggattaagagaatgttgggtctgttttgatctattattgacactactgaaactttctccatatcaacaataaggctgttttgctttctgatcatttgtgtgttcactggagtagcacttttaatgtccttcaagtatttttactttgcactcacaacttttctaaccatctggtgcaagaggcctagctttcatcccatcttggctttcaacatgcctaagcttcatcatttcttgtttttattaaagtgagagaattgtgactcttctttgaatgcttagaggtctttgtagggctattaattgacctaatttcaatattgttgcatctcagagaataggaaggagacagagagatgggggagtagctggtctgtgggacagtcagaacacatttattaacttttctgtcttatgagtgtggtttgtgtcacctcaaaacaattacgatagtaacatcagatattgctgattgcagatcaccataacatataataataataaagtttgaaatagtgtgggaattaccaaaatgtgacacagagatatgaagttaccacatgctgttggaaaaatggagctgatagagccagatgcatggttgccacaaaccttcaatttgtaaaacaaaacaaaaacccccacagtatctgtgaggtacaataaagcaaagtgaaataaaatgaggtctgtttgtacctcgttgtcttctagttttcactgtttctatcaaggaggcagttgtaagtcttcctctgaatgcctttgtttctctgactgcttttaaattgttgctattttgtctgtggtattcaagagttttattatgatgggtcaaggtgtagttatctttggtttatctttttttttttttttttgagacagagtctcactctgttgctcaggctggagtgcagtggtacgatctcggctcactgcaagctccacctcccgggttcacgccattctcctgcctcagcctcctgagtagctgggactacaggtgcccgccaccacacccggctaatttttttgtatttttagtagagacagggtttcaccatgttagccaggatggtctcgatctcctgacctcatgatccgcctgcctcagcctcccaaagggctaggattacaggcatgagccactgcgcccagcctatcctttttttttcaattttttttttttttttgtaatttggccttctagtcctttgtcccctcctcatcaccaccacsacctaccatggggagttttgggtgcaggaacctaaatccccacaaaggttctatgttgggggtatgtaataacaaataagtcaatcagatcaaatattattttcccaccaacttggaatttgctaagccccatgaaaatgtggttcaccagttttgaaaaacrtttggccactatctcttcaactgttgcttctgatttgctctttctgtcttcttctaagattaattatacatatgttagacttcttgagtatatcatgcatatctcttacgctctttttattatttttctctctatgcattggttttgatattttctgttaaactacctccacatttgcaaaacctgtggtctgctgtgtttaatcagctgttaacccatcagctgaattttcacttcagctattatatttttcagttctagattgtctattagattcctttttatagatttcaatccattgttggtattttttatccttttacctgtttagttcatgtttttcygcatcttcttgagggtattaatcacagttatttacagtcttagtttgctaactataatttcttgattacatgtgagctgcttccatattctgcttttttctcttaattattagccatattttctcgtctctgtggtaaatttttaattttgccaaacaatgtgtatgagaggacaatagaggcttcggctaatgttattaatgatcagggagtttcttcttttctgttcagtagatgcaatgaggtattggtaaactcagtccarccagaattttccattttagtaaaacacattagaacttggtttacttgtgtttctcaattgagacttttctgggcttttcatagagagccttgtgagtctctgttgccttagttccaaaaaaattgtgggagaaccagatataccctccagagattcacagcccagctctcaagtgatcagtctcatagagatgaaaaatctggcaaatgttttgatggaaaacaggttatgtgcttgaggcagggcttcttctagtagttttttttctttctttcttttaatctatcaatctttaacagcatcttggatagcctatgagtgtatgtacttgacaaacattgcctctttatggttcacagtagtttctaaaatacattcactttattggccattatcctttgaaagctgattttgtaatcttgataaagtggaagtggattttatagtcttgagaaagtggaaattaacaaggcagcttcatggataatgtatccttttcttctttctgaaaattatacatactattttatatatttatggggtacatgtgatattttgttgcattcatagaatgtgtaatgatcaagtcagagtatgtggagtatctgccatcttgagtatttaccatttttatacgttgggaatatttcaagttctctcttgtaactactttgaaatagacaatacactgttgcttactatagtcaccctaccttgctctccaatagaacatatgctttctatctaactgtatgtttttacccattgaccaagctctctttatccccgtcttttacccacacagccttcccagcctctagtatctattattcttctctctaccttcatgggattaactttttaagctcctatacagaataagaacatgcaaaatttgtctttctgtgtctgccttgttccacttaatgtaatgacttccagttccattcatgttgctgcaaatgacataaaatcattactttttaatggctgaatagaaggtttttgatatgtaataacttaaagcttcatgagattttactctgccatttccaaagcttccacatccatttccagttacctacactatcccagaactcaggaaatccctattttgcaaactcatcatttgtttgagacccccctcaagcttctgattgtcagagtagccccacataaccattaaaagctttgctgctttctctttttccagcagaggtcctctgtgtgggtcaagccaagtcttcagcttgcagccaaaattggtaatgttggcagaggggcgggaggctggcaatcatcaattctcatcttaatcattgtcattgtctcttctctgaaaattttgtttttccgctcctagtcgttttcttagctctttgattcttaaaaaaaatacagcttcttcaatttatccatgtttgtccaatcattgtagcattatccagaatatcctttatcaattaaatcctcccaggaagcagaaggtcttgaaactcttattttgatattcatttcctgaccaactatagaaatctatgtttcttaagtgctctttaaaccaattctttttgggatttttccctattcatttcctcattaatgagctaaataacactcgggcctgttctaaacgtaacattgaaaattttgcacgcctcatataaactccgagaacagggcaaaggggagcatgtttatgacactaattcttctagcagtgaactcttgctgaaaaggtctggaatttactggcaaaacagggatggtgggagggcagcaagagaagaaaggatgggggtggagccgtgtccaaaggaagatgcttttccgctctctagttccatgactatgattttttttttcagccagagtaagtgcatcttgtctatagaggtttactcaggattgaatgaaatttcgccaagatgtacttagagaagaaaactcagaggccagaaagagagattgctctatacctaaaccaaaactacatatagacatctccaagaccttgagacttgaaggtgctgattagcagttttggaataagtgggtgattattaacttgtttccacttttgttcattaagaattgataagaaaataatagttgccttagtggaattgcctgttattcaagtaactcacgtagaacgtttctgaggatttaagttcctatggccaaaactccccaaggtagttagtggttgaagttggtgaaggagaaaaaaaaggggtggagaatcaaatgaagagcagtcattttaagggacagaaaagaaaatgtcatcaatctagcttatgttattgagaaagctagcaaaagtcctttccggaaaacccttgtgagtcttcatttctttggggtattttgaagtagaatgtctagattagataacaggtatatgtttaacttttggggaaaatgtaaatttgtttcccaaagcagctgtaccattttacattccctccagcagtatttgagttccagttcatccacatcctcccttgcacttggaatggttcaaactttccataatagccatcctaagaggtatatagtggtaccgcattctggattaatttgcatttccccaaggactagtgatattgagcattttwtcgtgtgcttatttgccatccatatatatcttccttggtgaaggatctgtttatatttcttgcccatttttcaattggcttatttattttcttgtattgctttttaagagttctttacatattctggatgcaagtccagtggtgtcagccgccccactccccagcacctggtctggccctacctgcagtgggacctccgcgtgaccctggtccccacctcctctgagtgtccgaggagacacgcgcggggcagcaggctcccggcagctgcagtggggcatccccgygggaccagtcctcctgcagcagtgtggggtccagccacgcccggttccagaacctgcctccgtcctgagcttcacctgcagcagaaatacaccatgatctgccctggggaaaacaaaacaaaacaaaaccaaccaaccaaccaaccacacatataaaactttaataggaagtggaatagaagtgactacaaaatactaccattcaatttcatcatgcaagtactttaatattttcactcactggcaaaataaagcacatgtaactctaaatgtgaaataattctgagtctttgactaagtcttctaaagaaagaataaaatgctggtgaaaacgtgaaattgtgtagtgagggatttatgaccttgtttattatttttctacagatgttaagatgatcatgattaataccaattgaagcatttacagaatgctatttaggcccaatagtgatgttaaattacagtatcagagaacctgatagatatggggtctgattataaagaaactttattcaaaatcatctttgtcaaagttttaacacagaagcaaaagtcaaatatgttcctacatgagatacaagctattcttgctaacagtacaaattctgtcctgtaagtattagtattttcaggttttttcttttctatgaaacrgttgaaaggaaaactttagtaygctataactcataggctactttgtgtatttatcattttataaacaaatgtcttgacaattaagttgtgtatgaaggccatcatcaagtcattaactcttatatcaaaacctattattattcactgatttagataattcaayttatgtgtgcgttaccaggttgcagtcagccaacagacacagaacaggttaatagaaatatatatatttttcttatcaggttttcttttattggaacaggttgcatatatatwcacacatatacacatatatgtgcatatatgtatgtatatttccattgatataatattctagaaaatgcagactaatcactagtaacagaaaagcagatcagtcatggcctggggaggggcaagagtgacgaattacaaaggggcgtgagaaaaattttaggatggtggacatattcactattttggtggtggtgatggtttcatgggcttatacatatgacaatacttaacagatacgccacttcacagctgtttcctaagagtttaacctttcagctttaggcccctcccccaacacggtgtcctttctcattgccacatcataaaccagtctttcccctgagtcacacacatgcaatccttgcacagcaagtcatgatggtgccctgtgtgtatgtgatagtgatgggaaaaggataaaacaaaacactcaacttgtgttatggcaaaaagagattgcagtgatgataaagaatgcaggaaaggaagccaatttatctgttaggaaaaaacttccacttgcttataaattctgtttcctctgatgaagtttcattataaagtgttttctttttctttaaaaacaagaagatgagaggacattgattacttaaaaatttttacgttaaagaatactggaaaatttcagagaataaatgtaatgtataaggcccatataaggccttaggttgaaaacaacatgcacccatgaacttgctaagtaatttgagaaatagaacataattggcatctttgaagttttctgtatacctctctttctacctccctgcttccccccagaaatagctgctcttctgaacgtcagtgtttctgtagtgttagcatttatgtttgcatataaaaaatacattattttacttcatttaaagatttttaggccgggcacggtggctcacgcctgaaatcccagcactttgggaggccgaggcgggcggatcatgaggttaggagatcgagaccatcctggccaacatggtgaaaccccatctctactaaaaatagaaaaattagctgggtgtggtggtacgtgcctgtaatcccagctactcgggaggccgagggaggagaatcacttgaacccgggaggcggagcttgcagtgagccgagatcttgccactgcactccagcctggcgatatagccagactctgtctcaaaaaaaaagaaaaaattttataaaaataatgcactattcttccttttttcattttacgttttgtttttaagctgtattcctgtcaatatatgtagcacaacttagttttcacactgtgtcctattcagcgtgtaaatatactgtaattgacgcattcattttccactcaatgaatttggggacttttacrggattttttgctattatgaaaaatgtttctctgagtgttcctctactcgcctcatagggtgtgtactcatgatattctttagacaaagtttaagctgaaccttcagataggcacgtgttcaaactgttttccaaagtggttgcagtgatttatatcacatcaaacagagtttctacttgttgccaacatctggtttgttagactctgaaagttgtttgcctacctcggaaatgtgaaatagtttctcatttgtgtttctaatttccttgggtttttaagttaggtatcttttcatttagtttattggcctttcaggttttctattctgtaaaatgcctgtttttgtctttttttgcctatttaatatttttttttctcttcctaactgattctaggcattctatatgtttgtgttactaactctttataagttatttgtgttataaatgtcttcctcttctggcttgtcttttatttttttaaatgatgtcttttggtgagtggaagtttttaataataatgtaggcaaatatattaatctttatatattttaaagcctttgagtctttttaaaacttttaattttaccatcctgacattctcttagataaatatattcttttgtattttattcttaaagatgggagattttgccttagtatgagattcatctgaagtggatctttttttttttttttctgcatgggatgaaataaggaaccaattctgtttcctcagcatatgctttgcctgttgtcccagaagctgttattgaacaacgtgcattgccacctctgtcatgtactaactttccataagtatttgtcaggataggaaatattacaatgaagttgcaaagcttgaaatctcagtgacttagcacaacaaaagtttacgtctcacagttgttaagtctaaagttggtcattggctctttttcgtggttcttttagaatggtgactttatcggggatcggggctgcttccttcctgcaaccctacaagctaggaattattttctttcatagcttcacatataagagaaagatagggatgatggaaactcacatgagctcttaactgccctggactagtggcttggtcccaaccataaacaagggagggtgtcaaatttggggagcatatatacatatttaatgaacattaattgtctgtaccatatcatctaagtgtggacctctttctgtttcctctattctgttcctggtctatttgtatatccttgcaataatctcttaattgctaaagctttgtaataagttttgatatctgcttgtacaagtccctcatctagaaatattgatgaaagaaaaaagactataaaatattaggaatgaacagggatgtataactatggacatggcaatatttaaagataagagaataccaagagtgactttaagccaaaacatttgaaattttagataaaaaaacaaattccaagaaaaacataatgtatcaaaattgactaaagaaaaaataaaaaaatctgaatagtctcatataatattaaatatttgattcatattataactatcctacaaagaatagtttgtataaagaaaatagtatagtttctacaaagaaaatattttacctaaatgatatttgagtgagttctaccaaatattcaagcaatagataatgtcaatcttatacaaaatttttagaggataaaaattaaaagaaacacattctaatatattatatgaagctggaataccattgacaccaaaactagaaaatcccagtataagaaaataaaatcatatttcaacttagaggtacaaatcttaaaatgaaataaaattatcagtgtataacccgtggagattttaaaaagatgagaatccatgaccgtgttacgattataccagaaatataaagatggcttaatctcaggcaatctattaatattatatatcatatatagagtaagggaaaaactgttattaatagatgcaaaaatagtttttcataatatccaatatctattcttgatactctcttgggaaaccaggaagagaggaggtcattcttaacctgataaatgatgtctactaaaaacctagaagtaaatcttgtactctataaaacactggttctctttaaatcaggagcaatacaagaattactattatgaattagtttatttaatgttttgctggagttgctggccaatgcagcaagataagaaaataacaaaagtaaaaagcactgtaataaaatgaacagagctattattatttgaagataatatgacctgtccacatggtaaaccaacaaaaaatgcttgctttttactgttgagaagctgggtcatattcgacagtcaagaattctggaataagttgtgtttcatcaaatccctatttaattgcatagtacactgcagtgaaagtatgattatgaaagccatataatagcataaaaactatttgttaagtcaaaagagattacaaagatgtatgtacataggaaaaaaaagagtaggtgggaatgttgcttaatgctaaagggggttaggtggcaagatcatgaattaattttccatctattctttatgtcccatatcttctgtgctgtggctatattgtttacaacaaaagtatttttaaaatttgtactaatgagaacctttggaatcttcctgcagatttagtgatgcttgttgatttgtatcagagagctgttgaagacaatacagtttcacctaacgtttaactgcacaataagtcagatgcatttattgggttgtgactcatacttagaacctgacatataatgaataccagtaagacatcatcttaccttattaaacacaataacttccttattcactaaaataactaaaaaaggcaccgcgcccaaagttcacagaaatatacatcgaggcattgtgatagagtaaaagagaagaaaaaggagttaaacaaagtctgtagatccaaatcctagtcttggttttcccatagtaggcttggtttcctatttcaaaatgtgaatagtgagaaactgccctgtttataacattgatttgtcatgagggcaaaacaaagaacccaaaattagagggcctagaagagatggtagaagcagtttccattggatgttcgtacccatccagtggcctttgtttgagttcttccagggatggggcaaacactgtctctgcattgctgagtgcttaatctattgttatgaagatctttttcacattggcctcctggacgtctatcccatggccttcgttccatctctgggttagggtaccatggctcctagcatggcctggtggctaccaggtgtacagatatcaatcctcttagtctaagggcctgtgggagagcctagctggtcttcttcggccatgaacagcctttgttattgttttctctgcatgccatgacaagagcgtgtctgagggcattctccagtgatgacctcctttgtatcagaaggtacacttccaccagggcaactacagcctcctaccacacatcattcactgtggacgtcttagtcagtcaagactctggcatttgtttggttttgttttccaccagtgctttgctttttcatatgccctgtcctgtacttaacaatatgaggttagggaactaagaatgggattttagatttgtctgtgttaagtctcactatgttagatttggcctatggttctatcttaatggcgtcttttgggaccctgatttgctctctcagtgaattcacagttcattttaactccaggactcccagaatgtggtaagcttgcctgctctgcccttctgctgtagaaacctgttctgcacctcccagctccctccccaacccctggcttggcctcgaggcattctcctttcctgcattcaaggcctccaggaatattaccacacaccatctgcacatcgtckggttcttttggccaatgccaatttgataaatttttttggcttcagtgtccagttctgctttctaaacttgtatttgcttcctttggaaaatgtattccttctttctaccctccctcctttcctgcattcctctgctctgtactctccacaattgaagagtgccatgaccatgtccatgcccagcctggctgcctcttttctgggaggagaggtcagctccacacctgagagccaggatggaaccaaatacctggaactgagcctgaggctttccagtagagcatactcttctaattgactcatttaccattgagtatgggtgtttatacatgtatccaactctactaaccatattctttgttttgctcacaagacagatgtttgcagatacttacatgaaattctgattcactaagttcacagcatttaactgtggtaatctcaccatctaacaacctcatcaaacaaaagattgcatgagcttcaccagacctggcctgtttttagtcatttcatgctttctcttggtgatcgtggcttccttaagtgctgaaagactatccctgtaatcattcatctagaatctttcccattccttcatctgtgcttgcaaaatcccttaaactcagtaatgggtgtggaagctgtctgtctggaggtatgaagaattaagggatggcattctccccggaggtttgatagaaagctggacacagtgcggtctggaagagtcatggggatgatacgaattgttcatgtatcattgcctggaataggagtatgataagcagccaggcactcaagtcagatccttagggcctgaccacaaaggttaccagtggccatcggggatggcatggttaattctctagtgtaaagagacaaaggttaaactaacagaatgtgtcacactggaaagcattttggagatcaggtcaattagcactccctgtgttactgtccacacaagtcacccagaaagcttagtcaaatatagatttgaattcagtggttctggggtgggccctaatgttctgcatttccatcgtgctccttggtgatgctcttggcttatgggccacactttgtgtcccaagagtttagactatactgttttgttttgttttttcagatgtagaaactgagatccagtgagatgaagtgattttcccaaagatacatagatgaagttgaagcttagctctttaacccaggtctgctggcgtccaggttggtgtctctctaattatagaattgctggacttaggaaagcagaagtctcctgccctctcttaatgacccatagcatgttgagggggagccaaggttagattctagggttgcacatacttgcacaaacatgcacacacatacacacatgctcatgcacacacatgcacacacatactgtacgtgcttcttcctattctcctttttcaattgggaggtataagaaacacatggattacagccacattaaagatattcataaatgcaaatcaattctgaatgtgtaaacttttccataagaatattctgggaaaatacttgagttatttctgaccttttatgtataaacacagacattctggagtttgtcaaagaccatgttactgataaaattgtgttagaatgacgtcttctgatagtttaaatgttaaaagctctgggctcggctcagggaattctatactttagcattcataaaggaccctagagtttgagagattatccattaacttctgatattgaatttttgttgccaactatgactatttgttttccctgaactctgtaggggaacaacacagctgacaaaacccaggcaaaagcgtgtgtgtgggtgcgtgtgggtgcatgtgtgtggcgtgtgtgttcacacaggttaactaaacagtgcagattcctccaatttttctcctttttgagaagtaggaaggagcaagagagaagaaatcatctggagtggaaaagagggctggaaaagtccttgaactaataatctgccaattaatccagctgcttggaaatagcctggaattggaaggtcttttgggtgctctctggaaagggtaccaggaagtatgagacaatggctgctaggaacttgcactgttcctgagtagataagacctgttgtcaagtaaattgcggtggatccctggtaacacttgaagagcaatgcaagcctgggctccacctgggctctacccctgcctgactaagggagcttggggaaagtatttacataatctcaatcagttttctcacctgtaaaatgggcctaaagaatttaaatttccatgcaagtcaaaaccataatgagatatcatctcacaccagtcaaaatggctattactaaaaagtcaaaaaataagagatgccaacaaggttgcagtgaaaagggaatgcttatattctgcttgtgggaatgtaaattagttcagccactatgaaaagcagtttggtgattgctcaaagaacttaaaacacaactaccatttgactcagccatcccattgttgggtatattcccacaggaatattaatcattctaccataagaacatgatgttcattacatcactattctcaatagcaaagacatggaatcaacctaaatgttcatcagtggtagactggataaagaaaatgtggtacatgtacaccgcggaatattatgcagccatgaaaaagaacaagatcatgtcttttgcagcaacatggatacaactggaggccattcttctgagaactaacacagaaacagaaaatcaaatactgcatggtctcacttataagtgagaattaaacactgagttcatacggacacaaagaaaggaaaaacagacaccaggacctacttgaggatggagtgtgggaggagggtgaggattgaaactacctatagggtaccatacttattacctaggttacaaaaaaatctgtagaccaagccgcctgaatacacaatttgcctatataacagacctgcacaagtacccctgaaactaaaataaaattaaaaataaataagtaaatgaatatataatttaaatttccttgaagaatgcctggcacctgtaagtgctcacttctgctatctccgttatcatcacagagagaaggcacaggttcagagtcgggaaaatcaccccaggatgcttgagtggggtctgcttgagcaaatggcggtgaaaactggaaagaaggggaaggagcaaagaggaggtgggctgtgtcgtgctgagtggtgtcaattggctagggtaaggagtggcagtggcagaattgaggctgcagagcattgaagcagaggtttgagcagtgcctcttagggtcagcaggcggcccatccaggtgagcacaaagcgctcttggaaagggtagcgggaacaatgacaggaaagtgtgtgagaccagatgtctgaagaccttgaatgctagaattggaggcttgactcttcctccctacgatgcagatttttgagtagcgttgtgataggctggactctgtatcatgttgagaatgttcatcggagtgcagagcacaggaggagctatgagagaaataaaagaggcaggccaggtgcggtggctcatgcctgtaaccccagcactttgggaggccaagggggtggatcatctgagttcaggagtttgagaccagcctgaccatcatggtgaaaccccatctctactaaaattacaaaaattagccagacatggtggcgggcatctataatcccagctactcgggctgaggcacgagaatcacttgaacctgggaagcaggggttgctgtgagccgagattgtgacattgcactccagcctgggagacagagcaagactgtctcagaaaaaaaaaaaaaaaaaaaaaaaagaggaggcttggcagcaccagctctcctaggtggatctggctgcatttgtggaagccagaggctccagctttcatctccctgagctgaggggtgatcagtggccatcccacctccagggtgtggtgaagggagacttccagagttctcagggcacatggcaggagtggtggccaccatgagaagtgggccagcatctgggacacgagcagacctgaataaagagtcctgcagcattgcctgggctgactctagggagattgctctaaggattgggaggtaggcagagagggaaagcttaggccaccacaggcctgggactgaccagtcaagactctgatgatgggaacatgataatgagctggattcagccagcaggcttgtccaggttcaacacaaagtcatgagaggaaagcaccagcttcgggaaactttagaggttaccgtgcagtggcgggtgttggtgtttcttaagggtctggcacgtttgctgagtgattctggctgtctgcctggctctgagcttcctgttcatagttccccagatgtgtcacggccgagggattaaagccctaagaggctgtgacacagccatctccaaaaccccactttctccttcctttgagcctccgtaccagctggggcgyccggcaagatgtgagttgtcactctgctgcggcacagacctgaattaacaactctagctagggctgacttcaaaaagcactttcgttttttaataaccaacatcagctcagcaggcttcatttgggaaaagaaaccttgtcggattaccccgacattctccacctcctgggaggccagccattcccaaatkccccaaggatgaagaacggagacggtaagatgattaattgcactgcaggttttttgtttctgtatttttttccctcctttttttgggtttacttwcacattaatgaggtatttaggaaagacaaatggaatctgataaaaggtaacgttatattktttgtcgaaacaacattttaaggatttcttgaagttatatggctctgtaggcatgtttcactttaagatgtgtttctgagtcatattaggagaacgactgtgattatctatggaagattaactatgaaacatatgggaaatatactttataactgtatattacttataaaccatgaatagttacatgacttttggtatgtggtgagagatgttawgtgaaaggtgttgtaaatgaagtcgttttataagactgttgttactgtaagaattgagacttattttatcacttcccattaagcttctacagtgttagagaggcataacccaatgtttgactgaaggtgctatgttttctttttaatttattttttattttgtttgagatggggtctcactttgtcacccagactggagtacaatggcatgatcttggctcactgcaacctccgcctcccaggttcaagcgattctcctgcctcagcctcccgagtagctgggactataggcgcctgccaccatgccctgctaactttttgtatttttagtagagatgggttttcactgtgttagccaggatggtctcgatctyctgacctcgtgatccacctgcctgggcctcccaaagtgctgggattacaggcatgagccaccaygcctggcctgaatgtgctatgttattaatggcagcctctattggtttcatttaaaggtataatgcattgtattggcaaaacttgtacacgctttcttcaataaggacctcaaaggtaatcttaaaagcctgatcatatttttctccccccttcagaagctttgccaatgttgcacctatagctatagagaagaccatgcactctcagaggggattataaacattgccttgcatttttatccttgatctccataatttatccttgatctccatttatccttgatcctcataattcctactgatagtgttgttgtgcataagaatgagaaaatgggactgaacctgaaagattaaggaaagaaaataacaaaacaaaaaggaaaacctaatgaagcttatcattcaattcaatttataactccttattgctcatgcaaaatgtgaatttttcgctgtgttgatgagggtgtgaggagtggatggtggggaaggatgcttcaaaaaatacagctaaggaccaactggtttggtgagtcatggcattcacccatgagacagctggagaacagtgacgtgtgtgtctctgtgtgtgtgtgtctgtgtgtgtgtgcatttgatgccagagattggtgtttactataaatgtgttgatctgttaggaaaaggaagaagacaaagttgtccagaaagagccaagaaaacttcttgagatgaatttgatctgcctaatggtagtgatgagtttaaaaagattcttatggcctttcctaacactacatgctattgttaatcattgaactgacaaaccccgttgagcacaagactgttagtttacttaggaggaaaacttggcaggaacggtcaaagaatagcgagggtatacttctaaaatacgtccttggmacatttacacaaacagcacaagctcattgtcaagaataaaattttaaaaaatacatagagataatagtaaaagacgagaagtaaaaacacaccactgtgaggtaaacactgttaacattttggtaggtgtatttgtctctgagtacatttacattttgaagaaatatatttgtactctacatgcttttcggttatctgcttttacctcacagcgatggagcatcttgttatgagaatgagttttcttttacaaaagcttttccatttcattgcatagatagtttattaaatcctgttggcaggtagttgattgtttttctcttattaacagtactacaactatgttcttctcttattaacagtactacaactaacacccttgtagctaaacctttgcatctccttgatgcaaaggttatctcaacgagttttccttgagataaatccccagaggtagaatggtaggggtcaaagggcatgggcattttaaaaactctagatccctgctgctaaattaatcctaggaaagtttaattaatttatgtgcccaccagcactgtatgaacattttccaactctctcatcagcattgggttttataattttttgaaaagtgtgctactctgcatgcacacgtatgtttattgtggcactattcacaatagcaaagacttggaaccaacccaaatgtccatcagtgatagactggattaagaaaatgtggcacatatacaccatggaatactatgcagccatgaaaaaggatgagttcatgtcctttgtagggacatggatgaagctggaaaccatcatcctgagcaaactatcacaaggacagaaaaccaaacgcygcatattctcactcgtaggtgggaattgaacaatgagaacacttggacacagggtggggaacatcacacaccggggcctgttgtggggtgggaggaggggggagggatagcattaggagacatacctaatgtaaatgacaagttaacaggtgcagcacaccaacatggcacatgtatacatatgtaacaaacctgcatgttgtgcacatgtaccctagaacttaaagtatcataataaataaaagaaaagtgtgctactctgataataggcaaaggtatattttgttgtcttaatttaccttaaggaaaccctttgcaaaatctgctggtttccagttctgcccctttgggttcagcctctcgtcttttttggttactcattgccaaagcagtcacctcttacagtaacttctgccaacctaatttctgaggactttgacctcttttgatgtctctcagaaagtctgctgagagagcgagagaactggatgcttttgctctgaatttttaccgattgagtaacctggggtaaacctcagtctttgtgattttgtctcctttttagctataaaatttagacagaaggcctgtgctagccacctcacaagattgtactgggaatataaagaggcaagatagaggcaagctttttgaatagaggaaaagcaaaaatgcaaaatggtattattattattgttgttactctaaagtttagtgataaatctaaccttctaaaatatatagtttctggagagctgcatgctgaaattttgtcgtcttctaattctaaacttgggaagtgtgtgtgtgtgtgtatgtatgtgtgtgtgtggggggggtgtgtataacatatttctatgcttcttggttcttagattcagtagcagtgtttagtgtgttacagcagtgcatggatacattttagattaaaaagatttccattttgttgcttatttattccattcttgtacaggaaaaccagccatcctcctcctattgcattctcatcatccatgggctttgctcagctccccagtggactgagagctcctcaaagacggggtccggtttcatgtgtatacctctctccagggcctgctttggggtctgacacccagagggcggatcaatcaatgtttctcaaatgagtcaatgtaagggaggtagaaaaatatttacccagttctgtggagaaaagaatattccaaaaaggcaccccagaagattaaaaaaaaacctaaatggagcttttctaggggcaactggttatttatttcgtttagtttgggtgagtctcagtttctattgagtaaatatttaaagctctgaaaggatattaaacaaatgaatgcaagccaaggataggaccaggaaaatggagaaccctgtctttataggtgcaagtgtcatggatttggcatgaatatcaaaaactttaaggaggcatcgattttcactctgactcccagctcagtgctgggctgcaaaaatcargaccaaactgacatttagtaatggtttgaacttggtactgaataataataataataataataataataataataataataaaagctaatatgtaatacagcacttgctaggtaggagacctggttttaggtaccgctcatataaaataatcagtactattattttattttgcagattaagaaacggaagcacagagagtgatttgctagggttataccagtagttattgcagagctggaattatgacgcagacaggctcactctggagcctgtgggtcagtgagggtaggtcggactgaactttggagacaatgtctcatggttttaggccactggtgatgtttgtgctgtttatttgggtatatgactaccatttattgagtcacctactaaaggaacatgcactcttctgggttctttaagtataatatcttgaatctttctcgcaaccttgaaacattattccaactctaggtccagacaagctgagaccctgagaagttcagtaagtttcccaaagctgcaggctagtgaggagagatccatcagcctgcaccaagtctgtctgccttctgagtccatgtgccacactggcctggacaactgagtgctgatgtacttggttcttccatccaaaggtgccragagtccagttctactgcatttggaggtgttgaacctggaaaactcrgccacaacaacccctcaacttggggatcaggcagggctcagcctcagcttctctgaacccacatgggccaatgtgaratggatttgatttttcagaccagatcctccctggcaggaccatccaatttatcacaccaacctagactcgatgggcgtttaaaatattgagagatatttccttatatttcctctctattgaccccccaaatctgcaccaaggaactccagcgaatgagatggagtatggtgagtgctagcttgggggccaagggcggcttcgtttctcctgggcgacttatctcccttttctttgtttagtgtttccagttataacatgagggaaaagactataatttaaaatggaattttactttttttggttaaacttttccatatgattttgaaactctttaaatttttttgagtgaatgacacatggtttatttgcttttggagtggtaacacaatttaaaaggtgaaagtctttttctcttccctttctgcagacgcttctttccctcttcctcaccaataggcgagtcttgttaatagtttctagttttttcttccacctctttcgcactcatagtgcgcaccattctgtaccttgatccatagctgtatcaaaggaggtgcgttttctgcctcttaacggacagttggattgtttgcaatgttttgttatttcaggcaatgttgcgaccagtggcagcctgccctcgtaattttgcagaagtgtttccaagttgttggttaaattcctggaagcagaattgtggggtcagaggctgtgtacacttgtgattttgatatatatttcagaattacccacccccccaccccaccaggtcataccaattaacacccctaccaggaatgtttgaaagaatgcctctccatgtgctcgtcaacagtgcctgctaacaagctggtttttattagacttcggcagtctcaaaggagaaagctgcaaacttagtaagttttctaaattttcctatctcgtatcatgaccatgcagtgtcagccccactgtgatctcttgtggcaaatacaacagtctgacaggtactttgttgactcaggttgggcatctattcaattggcttaaaaccatttgcgatcacaacttttttcatttggtgattgtgttttgaggccttgctgtgtgtccagtcatgggatggcacagggatgcgtggaccctgccagggttgcatgaaacagctaggcagccgcgggagttggcacatgtgtgctgagcactgtgaaagaaacacagagacagaaggctgcagagacagcgagtagggagccacggtccgtgttagcctggtgattgggacggctcgaggtggagtgatgaagtctgaggcatgagaaggagccagccagacagagggcagaggaagcagagcataaaaacccagcatgagaagcagaaagcagctctatgtatggccaatgaagagagtggaagggaggccaaggtgagctggagacagaggcagaggccagagcatggtgggtgtttagggctgtggcaaggagtttggcttttattgtgagtttcaggttgactgtagtcatgggctggrgaagatggtgccaaggtctgtaaactcttaccttgtagatgtaaattctcacctgaataacaccagggaggcatggttctatacacaagcacctgtcagactgtgttgtatttgccacaagagatcacagtggggccgcygctgcacatagggctggcgaccagaacactgtatctcttggccaaccttgtcctccgtgtgagacaagtggagacattttacaaaaatacgttctacgtctctctggagtacaactcagtttacaaagggctttctcattcattatctcatgcattaataaactgactgataattttgacagattattattgcatgtccaacctgtgytaagccctgtgctaggtgctggggatgatgagaggaagaaggagtggaaggggaaatagaaagatgaagaaaattcagagcagcttacagtccatctgcgagatagaatcaaatgtcaacaatgagaaggaragcaggaaggggacagtgaagaggacccggccacctctaggttctggaccagaacacgggtaactctgccccaggggcctgcttggtgccagggagtccttcagggatggggtctcaggagacagctgcaagtagggcttctctgacatccttttctccaggtgtaagtagggttatctttctaactttagaaagatagaggtgaccaactgagagctttcctcagggcttctgagtgggcaaagggcagaactggaacttttcctcccacccctgaaatctgaggccatggctctctgtgctcagaatagaacaaaattcctgaagcccaaccacctggggaaggcattgaggagagtgtctctattatgcatcgtctttcatgctggccaccctggttccatgatgatgaggctgctttgtttatgagtctgtagtgttttcagggctctggagaaggggtgggctctctaccagtcttagggtcttggtggctctaagcccagaggtgcttccattgtgtgaagaaacacaggagaccgagacaaaatattgttgatcagacactcaggcctatttyggcggcaaaactstcctaagtggtcatttatggccagcacagagtggggattaacgtgtgtgtgtgtgtgtgtgtgtgtgtgtkagtgtgagtgtgtgtgttgtgggaggtgtttgggggaggtctcargaattgctggccctgaggtgatactaatggatcaggtttccatggacacaggaacatctgggcaggaagtaggaagactgcaaagtcagctcacccccttcagtgagcttcacctcccagtccagggaaaggagggcagggcttgcttctgagaagggactcctggtgaattccaggtactcaacacagaattgccccaatcaggtgtaacatgggatgggggttgtcaaggcctaatgccaggtaaaagaggaagcaaaaggtgtgtttaccatagaaaagtctagaaatgtagtcataaaacttgaaatgtgtctgtgttaagtgtaatggaaataaatactttaatagttttttttaggcgttgggttttcctttgtctgtgtacatagattgaatgtctgtgtgtcccccaagcccaccactaaattcctatgttgaaaccctaattccagtgatggtgttaggaggtggcatgcttgggagattgttaggtcatgagggtggagccctgataaatgggattagtgcccctgtaagaagaggccagagaactagctagctctctttctaccatgtgaggatacaatgagaagtcagctgtctgcaaaccagaaagtgggccctcaccagacaccggatctgtcagaaccgtgatcttacacttccagcctccagaactgtgagacacaaatatttgttgtttaagccacccaatctatgataatttgttacagcagcccaggctaagacactgcgttcaatcagcctgtgacaatggtataactatctttaaagactttcagtaaggattttagtaagtttcaggtctatttcctgaactaatgaacaagtgaatgagccattgctatagaataggctcaaagcacatttgtgtcttttgtggaaatttgccttcttttatcctttggtgagaaattattagcggtgaatgtacttgtaagttatccatcttttctccgaaagtgctgaacgtcttaaccatgagtctcttcttgtctgagggaggyggtgttgcttttggtgaccagagctgctcagtcatgtataccaataacatattccaacatgggtcacaaaaccaaagcattccaaagccatgattgtgccccctgaatattgatgtggcttccctcattctattcctggagttagtgagagggtagaacttgactggaaatcctggaacaattttttgggacttttcattacttgcgattttatttgctgtctccttgatcttgcttgccccgctctaggctgattagcagccagtctcggaggctgcaccaatgacgctcggcctccttgccctggagcctgggtacccacctcatctgctattctagaaccggccaggatcagcagccatccatctcctccccatgatgtctgggagcttttcacattgcctctgttccttacacaggctttatgattttygatttgtctctaaggaaactgaggcttaaaaatagcaggtgagtttcttcaagtcgcggcagatcgataacagagtcagaatttgaacatgggtctgttggattctctcagctctgtacacatcattatgccraaatagtaaggaacatgaggaagggaaacactagtttatggaagagctctttctcacatgtccttcaggcagtcatatttgggcactggtttttgagtccattcatatcaagcatgccattcaggctctcttctgccacttctaagagttatccaaattggtgcatggtacccataaactagtttttaaaagagatatgattactgaaatgatcagtatgtaatattgaagcccaaatcaatacaaatgaaatgcatatcataataaagtacaaattcaagtaaagtagggacttggtagatgtttctctggaaaggttaaacacactgcgtggaatgcatggggaaacctggtttcacaaatagtatcagctgtctgctaaagaatctgtaaaaccacatgcgaaggttcacaggggttctttcctgtagggaaaatatgtgattattgtcaacagtgaaggaatgtgtactggaacttaattgatttaaaaagtctcatgtgaacctgccatgacaacctctttgaataagtttccctcaaggtttaagcatttctcgagattaacgtagtgggtttctgggctgactcacagggagaaggggaggttacatttttgctattgtgataatgtgggaaattacactcggtatcactcactgtgcttgaatctttatcatcaacctcaaactctgggatttatgtaaccrcaagatcagaactctaagcttctttttttctccagttgaaatttattttaagttggtaaggaaatatgacatatatctatagaacctaggctcataggaaggtaaaaaatgctttggattggaagtagaggcagacctttactttagtctggaactgatgtcctgattgtaaattgttgttctagggaaacccagtgtgtgtgaatgtaagcccctggagttgagttccctttcttggctgggccccagtctgccacgtcagtgctgaaaatggacattgctgctgcctcggtgacatacaaataggggaaatgtctcctgaatggaattactctttgtcatctaggccagtagttgtcaaccctggctgcatattggaatcacctgggagccttttaaacactgatgcctggatcctaactccagaagttctgatgtgatgggamtgcatgcagcctggctttttaaagtcctcaggtgatcatactgtgcagttagtgtaatgtgggttgagaaccactgacccgagaagtagacagtygccgagtcagtaaattacccaagtaaacaagaagctggttagaccaagcctgtccatagtgattgccaaatcctgcctggtggggaaatttaggaccatttcctcagaaaactttgttactggaagttatcaagggctctctacctagtaagtgtgctttcagttttttaaggcactgtggatataagttgtgtaaacgtagccactttcatttatttggcaaatatttaaacatctgctctgttcaagttatactcaatctcagcctacttttaagcttattaactgaacagcaggggagagaactcaagcaatgcaaagtaggggctgcaaagtgccatcagagagggggagatgaaaaacctcaaggtttcagagcagggagagatagttgcctgtttctcctggttggagggatgggaaaaccctaaagaagtggtgcagtatttgggataggccttggaggggggagaaggcggaagaagaagacttgagctggaggagaaagaagggttgtattctgggtagaggaaactgcacgagcaagaaaagaggtagacattagggaaacttgcaaggaaaygggcacatagtaaacatgggtacatcaagggcgaggagaggaacacattccaaaaggtaggatcaagggagactgaggagcatctggaatgctakactgagtggtctgggctttgtttgggaggcagtggagccttgcatggcaggttttgacatccaaccttgcagcaaacggcaaataggagcttgctcagcagtatttatatggcgaatctggattatttagaaggaaattgtgtttctgtctcactgtgtggcccatgtaggttgcatagttgcagtatcttcaactttgcattgacaaggtgggtgcgttgcactgggtcgagatggttcagatgtcccccaatgcattgctgctttcgacatctctccatttctctagcttctaacactttgtttgtctctcttcaaccaccatgctgagaaaaaagtttaagggcttttcttgttcccccacgtaatcttggcaagtaataacagtgaaccctggagatggaaagaggtgtggatgttaggagactggattgctagcatggcattaacaatttttggctatgttgactctcaagtaaatatggcaactgcttttgcttttccttttcaaaatacaaagataaaatttaaggggaagtgagattttggcataaatggctgactcttctgcaaatagcatttctggattaattttattacatccaattgctcttccatgtattccgataattttatttgtaataaagttcataagtgctgttggtgattagccaaaaaaaagagtaaagggaggtcaacttttgtgtagttgagatcactttttctaagtctgattttaaattgggtggtttgtactgtgttagcaatgttagaggatacaaacaaccataacaacaaaacagcaacagcagcaggaaggtcatccacccgtgctgaaaacctccttcctcttgggttcacttttccttctagtgggggaaatggtgaaatcacgttagcactttctactcttggtcctggtgtcttctttatgacctcgtaacattttcctagataaaatttgcatgtctctaacttctgagttccacttcttactgttctcatgttcattcattattccattgtgacgtgtttggctgagtttgaaagactctaatgataagtggagaaggaaaaaatgacttttataataaaaggtaacacttaatgacatgaatctgagacacatgactaagtaagaaaataaaatattgacgtcttggttttaaatattgggcaacaccatctcatgtttatcctttttctcatcaaaccrcatgtccaattttggattaggaagacattcttactgtacttatggtacgcctgcaatcatggtgcctcctctgtctatttttgggttgaccaaataacaacgcaaagcactgagtgccaaccaccacaacaaggacttggtctgtatttgtccatatgcttgcacttcccccaaggtggacactgtcatccccatgaatggatgagggaagagaagctgacagaacacagctggaaagagcagggtgagaggtcactgtgggcctctcccatcagtgatttggtgctatttgtggcctctgcaggcatggacatatcctgttgacattacaaaataaaatggatgcaaatattattgtttagtgtcttccaatttcttggatccttaaatagctgccaacatcgctcttcagttatttatgtacacaaagagctatttctgaatatccgtcctaattttcttctggcctgttccctgcatattaatgtattccaatgaatcccacccattccaaagagaactgaagcaagcttgtggcttgtttagatgtggtccaagtctgtgtggtcccctcagggaggtgtagtaaggatttctcagaaccggtgtttgcgtgtgagggaagcctgctgagcagagagcgtttacattgcccagtgttccgagtgcttgagtttcaatagttaccttagtttattaggaccttggaagagtaccaaagctgtgagttcctgggagttttccgtcaaaatcagtcctctggcatggtaaagaatatgtttgtaaaggaacaagaaaaaaatatataatttttctaaatatatatataggaaatgtatatatatatacacatataatatatatatagacaaaataaaaatatatatttgatctctggccctgattcccagcacagagctcctaacttcttggaatttcctgggtgatgggagtcttttgttctartgaagctcctgggaggagaatggtcactagaaagaacagattagaagcttgggaatttcagtcctacccccatcctctgggaagacctggaggctggagattgagttaatgatcagtgatgttcaagtaacaaagtcttgtaagaatcccagaactctggggtttggggagctccagggctgctgaacatgtggagggtagcccacccggagagggcaaggaagcgcacttcccctcccatacacctcgccctgcatatctcttcatctggctgtcttctgtatcmtttattgtattctttattacatagtaagctgggaaatgtgtttccctgaggtctgtgagccatcccagcaaattatgaaatccaaggatggggtcgtaggaaccctggtttacagctggtcagtcagacatataggtgacaacttggcacttgtatttggtatctgaaatggggggcagtcttgtgggactgaacccttaacctgaggtctgtgctaactccagttagtatcagaattgaattgaattgtgggacactcggctggtgtcattcagctggtgtcagagtattccttgacatcgcttcaatccctggtcacagaagtgtgtggagtgcaggtatagaaaaggaaaagtagggccgggtgtggtggctcacgcctgtaatcccagcactttgggaggccaaggtgggaggatcatgaggtcaggagatcaagaccatcccggctaacatggtgaaaccctgtctctactaaaaataggaaaaaattagccaggcgtggtggcaggcacctgtagtcccagctactcgggaggctgaggcaggagaatggtatgaacctgggaagcagagcttgcggtgagccgagatcgctccactgctctccagcttgggcaacacagtgagactgtgtctcaaaaaaaaaaaaaaaaaaaaaaagacaaggaaaaatagttgttttttatctatctcacgtttattttagattactcaaaataagcatatctgagcttatatctgctgtgcagagcaacgaaaacatttatgggarggtaatggcggtaaacactgtaacttcatgctgacgttaggtggtaacttctcttcgataattcaagctacctagtgataatgtaagttctttwttgcacttcaaaagtatttctctgtccatggagggcatttcttctcaaaacactttgtacttccttatgaagttggaatatttgctatggaaaccaaattgtacttcctttggcctgctgaaaattagaaaataaattttgtgtggtcagtaggttattgttttaaacttaactacatgagattaacttctggaactgagatgccaatgatgcaatttcagaatgcagttgttgcactcattaaacaccacagtttgggaaggatccctgatccacttggtgctcagtggctttctcagcctaacagggacatggtttgaagagtcttaaacaaaagttacataagaaccgcagatgactagctgttggttccataggtagattttcttttattatcttagttttcagctttattgaggtacaactgacaaacaataattgtgtatatttaaggtatacaacatgaggatttgttgtatgtacacattatggaatgatcaccacaatcaagctaacacattcatcaccttacatagttacctgttttgtgtatgcatggtgagaacagctaaaatcaactctcttagcaaacttcaagtgtacgatacagtattactcactatagtcaccacgttgtccattaggcccttcagaacttattcatttcatgatgaaaaatgtatatattttgataccatttcccccttccctccttggcagccaccactctactctctgtaaatcattcttcttgtcattagtcccctgtcagaactctgtcgtggccccttccaaacctccccctgagctatcaaagctttcatttactgcctcggtataattaattttcagtgcttatttggccagatcggacctacagcyctcagtggtctttaaagtgaaaaaagtgaaaagtctttagcatgaaacctttgatgtgcatgttgtgtgagcgtatgtgtttgagtgtgtgggtgttcatgtgtagtttcatgaacgtgtgtgtgggttttcatgtgtgttgagtcagtgtgtatcatatgttgtatatgggtgttatatgtatggtgtgaatgtacgtgtttgttgtgtgtgttttgtgtgtgttgcatgtgctctgtggctgtgtgttgcatgaatgtgtgtcgtgtgtgcattgtgtgcacgtgccaagtacctggcatgtattttactaggtgcttagtaaacatttgtcacatgcaggaaaggcacaattcctgcctccatgaagctcactgtgtaaactcacaggtgaattgtcaattccttaggcacagggtctgcgttgtgttcatttttctgtccttcagtgtcacacagaggcaggcaactccggcataaaatgtggggctcagatgggaaacaggtattgtataatgaaacacaaatttgctctcaattcaggtttcctgaagcagaagcttgttttcttcaattcacctttgcacacactacacaatcccattcactattatgtttgtcatgtattatccctccacgctctgcaggtgggtagggatttgttggatttgttcctagatacacctcaagtacctggaacactgcctagtacatggtgtgcgcacaataaaaaattggtttaatgatcaaatgtaagagtaaatgagttccggcacatgtggtccacatccgggtttttagcagaacataggtattatgatgtctgtcacagttcactctaaatctcagctggtcttggcaagcagctgcttggggactcttcctcttgctcctgtcaggccctagtgttaatctgcatcctgcagggtttccctcttaggctgtcatcatggagctggcccccgggagatggctcatcctgcttggtcaatggccacgctgtgcccttgggtccttgctgcagcctgtgcactgtatgccattgacccaggggtctgggacatccagccacccggtgctgaccaccatggactttgctgttgcctgcagatgtccgccccccaaccccctggtttctctccaggcatcttctgttcctctggtttctctcgcaacttctatccccctcctcggtgcctaggaattcttgtcagcttcctccgctttgccagaggcagcccttgcagctgtggagccacgtgtcactgagcactgccttctggaaagagactgccatttccaggctgctcctccaccagcccggtgactcagtttctactccttcttcyggagttgaccatcagagctgagctcttgccttccttctttctccttctgcagatcttccctctagctctacaggaagggcctccctggytgtgtggtcagaaggtctccactgtccaagtccagcctggcttactctagggtttatgggtccagtcttcctccatgactcttgagatgtcaagcccagtttggggagttcaaaaataccattttctctctctcaacraagcctagcacattttttaaaaccacattttaacatttctgaaattaggatgcatcttgcaatggatagtaggtcctagttatttggcagcattttttttcttattgtacatattacagctaacgatatttttgcttaggctgttgtcttgctatggatttaaactctatactggagtttaaagccatgcaacacttttttgttctcagccttcatcttcctcacctcaaggtaatagatgcctctcctttaaaaatgtgaagctgccaggcaaccagaatcaagaaaagggcagccctggaagatatacgtttgtttcatacattcaaaaataggattcccagtacctaagatcaccctttgaatcaatacacatggggytggaccaccttaaggccatggactggtttccatgctatacttttaaataaggtcaaagaaaaaatgtgtccatctcacaggggcctggccttcctggaagaagaaaacatactggtcagtaaataagaatagctgggccctttggcagttatagatgtaattttccacgaataaggcagaattgcattccacgcctctgtctcatgagaacataatgagtgtgagacatggagagactgcatttctgagtcaggcctgctgagatacaggcctaaaacttttatactgaagtcagagttttctgtgtcagttctctctctctccctgtctcctatgcacacatgcgcacagaataatgagtgagtggacatgaaatagagaagtgctgtacctggcaatagcaactgaatctaaaaaaaacagtttactaacaggcgtgagtgaggggcgctcagttatgagttggtgattttaagtatcaggatcaggtatgggccaggtttgttcaagcgaaaaattgtagttaatattcagaagggcctcgtgaaacccaagagcaaggacatagccatgtttctggaagaactgggaccagccagggaggttgtctgccagggtctgaaggaatcattcttcatttcttgtctccattccttgcttttctctctctctctttgaaaactggctttccttgttttcagaaaacacagtcactctgcatctcccaagtgatgttcagagctaaacactttgttttgactccatctataacacatatgcattaactccatgtatttcaatgtaaaattcttggggagagcatgtgaatgctgtagctttgggtctagcaaatattcttggccccaccagtcatggccaaggtgtcttttaggctcatgcctgtagactgaaagcagggatcagggaaattggtttactttagtaagaaatataggcatgctgagcaaatatcaactgagtaaacatcaactgaaatacatagaaatcatgaaagatggaatgcagtatactcactctatttccttaaggtacttctgcattccgatgcaatgtttgttgattcaaaggataatgtaataaaatgccaaagttttatcaatcagagacatttgactgcacatgtaataattccatgctatctttattatctgtgaaattgtgtttgtgtcttatgggacaagtgtcatgaaactcattttgagaagcaagctgagattttgtaataaatacatttagcttttttttggaatgaggcatacccagaggtccatgtttaaaacaaattagagtaaatcaaagtagcatttaccataaatattaacggtaaatgaaaaggctaggggaaatctttttaaattgtatcaaaataatactttgtttatacataggacagccacagtggctcacacttgtaatcccagcactttgggaggccaaggcagacagatcacctgaggtcaggagttccagaccagcctggccaacatggcgaaaccccacctctactaaaaatacaaaaatgttagctggtcatggtggcgtgcacctataatcccagctacttgggaggctgaggcaggagaatctcttgagccctagaggtggagtttgcagttagccgagatcacgccattgcactccagcctgggtgacagagtgagactstgtcttaataaaataaaataaaataaaataaaataaaataaaataatgtaacatgaattcaatgtaaaaaaatttagaaatatgcctacagtgcctcatatgggtctttcttggttgataggaatgagacttggcagagattaggaaggagatggtgaacaagagggagaaggagagaggtgaaagggatggaaaggggaagagggaaagagaaaggggtttatcttgtgagatcacctaagtaaagtactcacacactacctcctctattcttgaggcagggaaaggttagacaagggtgctgtgggagctggcagggtggacacctgtattagtctgtttctgcactgctgtaaagaaatacccgagactgggcacagtggctcatacctgtggtctcagmattttgggaggctgaggtgggcagattgcccaaggtcaggagttcaagaccagcctgggcaacatggtgaaactccatctctactaaaaatagaaaaattagccaagcatggtggtgcgcctgtaatcccagctactcgggaggctgaggcaggagaatcgcttgaacccaggaggtggaggatgcagtgagctgagattgcgccactgcactccagcctgggtgacagagcaagactccatctcccccccaccactgcccccccaaaaaagaaatacttgagactgggtaatttataaggaaaagaggtataattggctcacaattccacatggctggggaagcctcgggaaacttataatcattgtggaaggggaagcaagtgcatctgacatggtggcaggcgggagaagtgaagtgagagcacaggaaaaactgccacttttaaaaccatcagatctggcyggatgtggtggctcatgcctgtaatcccagcactttgagaggccgaggcaggtgaatcacttaaggtcaggagtttgggaccagcctggccaacatggtaaaaccctgtctctattaaatacaaaaattagctgggtgtggtggctggcacttgtaatcccagctactcgggargctgaggcaggagaatcacttgaacctgggaggcgggggttgcagtgagctgagattgtgccattgcactctagcctgggtaacagagcaagactctgtctcaaaaaataaaaaaaaataagacctcctgagactcacccactatcacgagaacagcatgggggaaccaccgccataatccaatcacctcccatcaggttcctcccttgacacatggagattacaatccaagatgagatttgggtggggacacagagccaaaccatatcctcacccttgcggcttgccaggctgatggcagggaacctctcatggtggctcttcctcggctaccacacaaccgtctagagtccattgattgtttagcacatgctgcctttactctgtagagtgtcttgctaggaaaaccacaggagagaacacatgcttgcaactcccttcatcrtctttgcatcaagaataattcttgtctsaacaacaaacaaacaaacgaaaccaataacgaaaattcttcatcatatttgcatcaagagtaattctagcttggatttagactggcacaaacaatgtctcctgttcttcttggtcgtagctcttgataaacttattattgtttcatggactgggagcttcctggggaagtgaaggggagagtttctggcatgggttgaggacagtcatgaaggtatgttcagaatgaagtcacatgtagcagtcaggatagataggcaagatacaaggaagaagtggggtatctaaaagggagaaagaaacacagaaagttgggccttgttaggcccttccagccccactgtggcactcactgctggggtatcagctgrcatggttaggtgaagtcctcctggtggtcttgggtgtaatatttcaaagcagcgctcacattaataaaaacaaggtctaattagttgtctgtgcttctaaaggaagactgaggaatgcgaagagggtctgtaatacacagtttcccaggggcccatccatgaacaaaactcttttgtgatgcctgggatgcaataagacacggaatttgaaatggttcttcccagaagacttattgctgagtaggtcacaaaccattgacgaggagtggaatacagtcaagagtgaatgagtagacaatcaggaaaaatcaaagaagaaaatagtgtcttcagctccaaccattaccttttttgagggactgattagaaggtttagatcagtggttcttaacttcaacagccttataatgctctttttcttaataactatttcataatatcccctaagtgaaattcattgacaacataacctacttaagcatgatattaaaaatttaaatgtattaccttagctataatgtaaagaagatataaaaggtagtccatattcagtttcatacatacatgtgtagacacgactgagctagaagacagaaaggagttgtcagatgcttgagctatacacagagaagtctttaatgcagcagctgcaaatgcaggctgaaacagcttgtgcctcgctggagagccaaataacatgagtggcattgctgttggggatgtggttttcttcctcccatggtgaaagatcttttataaacttacagaagaaaatcaagtttaacttgtcctcaattgacatggtagctgcttttctggaaaatttatacgtattaaaactgtgcgaaaaatactttgtgtttatatgacaaacagagctaggcttcagactcagatttttatctccattgaggtctggtgagatgtttgaaaggtttttttttttttttaaggatagaggacaatttgttgtgctgtgctgttctaggtgttgcaaaatgtctagtagccccaacttctgcctggtagatgcacacccaaccaaaaatactcccgcttgtattkaaaactcacttaggttatagctaattcccaggcactgtctgtagagattctgctcaggtagggctctagaatgtccaagaggctgcacagctaggcatgggaaccacggattcaagccatccctctctctgactcaccagatccctctgacatatcttgggccagtggctgtccagcctgggttttaaggagctgggtttcagtgaagaatgtcagtaggttcagttctcttcccagcccttttaatgcagaggcccccttgtcagcctagaaggctgttctaagctcctgtgcaaacccctcttgtgaacccttgggtgtggccatcctggagatggttgactggtgatccagatttcagcctctcccttctctgctttgcccagtgtcatgttcaggcccccggctttgtcaaaagagagaaacacttttccctgggtctcaatcctttgaagttccattgggtgagtcagctccccacttagcttcagaaggatccaggacaggttgtcctaaaattaatacctgcacattcatggacagtgcatggtgagaggaggcaaagatggcagagacaactataactggttgtggaaaagagttgagggagagaagagaaaatattattaaatggaagagattgaaaaatactgaaatcaagtgcaagaacctttaatgggcagagttaaatgacacatttattcatccaataaatatataaaatgcatctaccacctactaggcttcattcaagacaatgataatacggcagtgtataaaacagaccaaaacctaccctcatgaagcttacattctagagggggtagacagttawttaacaagaacaagaagtaatatatatagtaagtcagatggtgacacatgctaggaaaccccagtagggacttcaggtaagacagagatgtgtgtgtgtgactgtgtgtgtgtgtgtgtgtgtgtgtgtgtgtgtgtgtgtatccatgcaacatccaatgatctgggatacctatttggcaacaagagaggaaaatctctttggcaatagtgatttggatgttagtagtgtaggaggaatgagaaagccatactgcaattatcaggacaggaaatgattcaagtttggatagaactttttaacaatgaaaaatgaagagaaacaaaaccactttcacatggcaataattaaatttctgagtttacgtaaagaatcttatgaaacttctcattccaaccttttgtttcctttaagttctttattatctttgagtgtttagatttcaattctcgacagttcttcacatattgaatgagtttgctctcctatcacacagagatcaagttatctatgcattttacacttggttactttagacttgagtatttgtgtcgaaataccctcctttttaaatgtggttttggttgatgcttttggaatgaggaatttatcagctgtggtgactcgtatatactctgttagccagaaatactagcttactctttacccgaaaactccctattccaaaatgacatcacactatgagtttatgcctaatgaagctccagtaacatttgcttatttgcatagtagaaatactgtcaggtacacgaattttcagtaattttctcaatacctctatggtattactgaataggtatatcatgctcattttataagttcaaagaggctgagtatataaatacccaaatataatgaatgtttggcaggtaatgatcatctctatcattgactatgtttaaatactttttatgtattaacttattctctcaacaacccaataagctggggactattgataacattattttgccatcaagggaattgaggcataagagaagttaagtaacttgcttagtgccacacagatagtatattgtagagctgggatacatttggggcagttgggctccattgcctatgctagtaaccatcattctgcacttcctctagttctaaagagcaaatctcaaactcctacatgttttagggtgatttttaactttacacacaatggcagtggtcagtggtagaacagtaaaaggcagcaatgtgaagggggaaaacgatcagttttggagagtgtgttggatcccggttcagttattttactcattgggtaatcttgggcaagttccttaacttctctaggatgtctgttgctgtctacaaaacaagagtagtagccagtgtggtggctcactcctgtaatcccatagttttgggaggctgatacaggaagatcacttgaggctgagagtttgtgcccagcttgggccacatagcaagaccctgtctctaaagaataaaaaagtaaacaataaataagctgggtgtggtggtccaggcctgtagtcccagctacttgggaggctgaggtgagaggaatacttgagcccaggagattgaggctgcagtgagccaagatggtgctactgcactccagcctgggtgacagagtgagaccttgtctcaacaacaaacaaacaaaagaaatcaacaatgaaaccccaaaaacctacaacaacaacaacaacaacaacaacaacaacaacaacaacaaaaccaaaacaagaactccttcccaaagaaaagtagtaaaccattcatggttataagcattaaatgtgatgtcctattaaagtgtctaaatcatggtcaggaacccgataggtgcttgaaatctagaaatttcattcctacataagggccaattattgagcataggtcagatgaccagttaagaaagctgcggtgcagtaaattggaaagggaattggtgatgttggggaattcagggcaggatttgtaccccctaaaggagcagttcaaatctcaatgatgacttaggatgtaggtccttatggtgaacctgacaggggctgctgtgctgtgaagtattgctttgaaatcggggtcaggggtgaagcagctgttgacgagggtgcccctctcttctgacctcttggcctgccctttcttcttgctcctatgtagacactttcatgaactacacagtggtctcagagggctgcagaagctttatgtagagcagacgttcttgaactttcggtctaaagaccccttcgtactcttaaaaactctcagaactttaaagagcttctgtctacctggttaattctattgatattaagcacattagacatgaaaactgagaaattaaaaaaataaatttttaacaattatttaaaaatgccgataaactcattgcctgttaacataaatctcttttatgaaaacaattatttttaaaaaacgaaagtatcaaaaagaattacctttttttactttgtttacattgttctggaaatctctttaatgcattgctcaacagaatacagataagttctcatatctgcttctgcattcaatgttggagaagttctgcatcatgcggtctctggaaaagtccactgtacgtgtgtatgaaaaagacacataccatgtttgaattattatgaaagtagttttgaccttgaagactctgaaargatctcaggaacctttgagaactgataatataacgtatctttttcttggtaataatgtttttgaacattctcagtattccctctcagcttcctcctggtgcctgtgttcaagcaatcacaattgctaatgattcttcttgcaaaattcttaggtttggcaaccctggaaatagtagatttgatctttagctgtctccctcactcttatctttcctctttccttgacagctrttctttccttttcactcttggtggcacaagcttgggaggttttccatccaggctggtgcctcttaacttctctctctgcctctagggcctgacagctgccaggctgtcctttatctgacattgttcacagtttacttccttcccccaaagtcttggttttgactaaaatgtattaattcttggttatgttttataaagatatcaaaaactttttcaaccaaagtttaaaaaagaatttgcagggtgggggtgggcatgtgtaaagaatctcaggcatcttcactgatgaacttcagaaactgtgtcagtagatttctgatgccagccaggattgagtaataggccctagatttactttctcataagaaacaactaarttactctacaaaatatgcaaaaccagggtttttaagaattggacatcagctaaggaaggatagtgatccctgagaggcagaaaacaaagccctgtgacttctcctgcttactgatgtgagagtttccaggccatggcacagggaagcgtgacccaggcagagtcagtgagaagactacccaaagtcagaaaaagcgcctccctaaaagattagatgaaatagtggacaggaggaggaataattcctattctcaccagccagactggaaagtctcgtaattcatagggatttgttagaggactcagaagcatcaagcttcagaagtgggataaaatgagtcctagagtgaatggtgctgtggtcctgtctgccgagtcttaaaagcaagatccaaaagaatcaaactattctcaataactcaaatgcatcctaagacacaaaaatattcagcatctaacaagttaaaatccacaatgtttggcattcaaccaaaaaattaccaggtatgcaaataaggatgataataatgcagaggaaaatgagtcaaaaccaaccaagaactaatagagatgttagaattagcagacaaggacatggaaacagtttttataactgtattccataaacacagaggtaagtagagaaacaaaagacgtgaaaatgcctgcgtctaacttctagagataacaactacaatttctgaggtaaaaaaaatgactggatgagattaatagcagattagatattgcagaagaatagatcagtgaatcgaaagacataacaatagaaactataaaaaaaaaaccacagaggaggaaaaacaaacaagtaaagaacagagcatcacgaaacggtgggaaaatttcaagtcaccaaatacacatgtaattggagtcactcaagggaaaaagggagtgacaggaaaaatatttgaagaaataatggccaggagttctccaagctgaactgaaaattacaaacccacatacccaagaagttcagtgaaccttaagaaacttgaggacaaacacatcatttcatcataattaaatttcttaaaatcagcgataaagaaaaaatcttagaagcctgagggaaaaaatacgcctaccaagaaacagcagtgacacagatggtagcagattcctcatagaaacaatgcaagctagaagagtttggagcatgatctctaacatactaaaggaaaaaattgtcaaccaagaattttatacacagtgaaaatatctttcaaaaacaaagacacaataaagccatttcagatatataaaagctgaattaatcactaacagacctgcactacaaaaatgttagaggaaatccttcagacagaaggaaaaggatactagatggagatctggatctatccaaaggatagagcaccagaaatgccaaattattatttaaatgactttaaatgaaaattatttaaacagaagtaataatgatgtagtgtgaggtttataggatatgtaaaagtaaaatgaatgacaaaatagcacaaaagtcacgcaagggaaaatgaaactatactattttagggttcctgtatgtagggtgatacagtatcatttataggaacagttttagcactaaatacctgttttaaaaagaagaaaattgtcaaattggtgaccatagcctccaccttaagtaactagaaaaaggaataaattacacaccaaacaagcaaaagataagacataataaagatcaaagcagaaagcaactaaatagaaaacagaaatacaatcaaggacatcaatgacaccaaagctttgatgtcatttgatgacacctttgagaagatcaataaaattgataaacctttagctggattgactgtggattaaaaagagaagacagaacaatcaatggtaggaactaggtaatatcactatactacaccacaaatagtaaaagaataataagggaatactaggaacaaaattaggcataaaacatatacttttagatgaaatagataaattctttgaaggacccaagctaccagcttcattcaaaaagaaatagatgacttgactagccctctatctactaaagaaattgaatttgtagttaaaaatcttcccacaaggcgcagtggctcacacctgtaatcctagcactttgggaggctgaagcaggaagatcacgaggtcaggagatcaagaccatcctggctaacayggtgaaaccccatcgctactaaaaatacaaaaaattagctggacatggtggcgggcacctgtagtcccagctactagggaggctgaggcaagagaatggcatgaacccaggaggcggagcttgcagtgagcccatatcgtgccactgcactccagcctgggcracagagcaagactctgtctcaaaaaaaaaaaaaaaaaaaatcttcccacaaggcaaattccaggcccagataacacgtcttgtgaattctaccaaacatttaaagaaaatataatagtaattctactcaaactcttcsagaaaattgaataggagtaaatgcttctcaactcatgagttctccccaactctgtgaggctaatattacccagatatcaaaaccaaacaggacattacatggaaagtacagaccagtattcctcatgagcatagatataaaattctaaacaaaatagtagtaaatcaaatccaacagtatataaaaaagctaatgcatcgtgaccaagtaggtattatcccaagaatgtaagattggcttagcattggaaaaatccataaatgtaattcactatattagtgaaactaaaaaaagaaaaacaatcatataattgtctcaacagatgcagaaaaagcacttggcaaaatccaacatctattcctggtgaaaactcttagcaaactgagaaggaaacttcttcaatccaataagggatgtgtacgaaaggtctatagctaacatcatacttaatgaaagctatcctcctaggatcaggaacaaggcaagaacatccactttccccacttctatttaacagtgtattaagggatctagctggtgcaaaaaaaaaaaaatcaagatatgaaataaaaggtatccagattggaaaagaaaagaaattctatttktagacaacatagtggtctatgtaggaaacactatggaatctattaaaaatctactagaactaataaatgagttttggaggttataagatcaatatacaaaaatcagttgtatactagcaatgagcattcaggaattgaaatttaaaaacaatagccttcacaatagcatccagtaatttgaaaaacaggaataaatctggccaaagatatgcaagatctgtacgtgaagcggtgttgatggcagagactattctgcccctgagcccacgatgtgcctggcactgttcttgtcggtgttctctgcactctacccttcctgtcttaggctgctctctctgcagtctgttcagggtctttccaaattaccagctttttctgggtacttcagatacctgcatcactactttctttcttttctttctttttttttttttgagacagaatttcgctcttgttgaccaggctggagcgcaatggcacagatttcggctcacygcaacctccgcctcctgggttcaagtgattcttctgcctcagcctyccgagtagctgggattacaggcatgtgccaccacgcccagctaattttgtatttttagtagagacgggttttctccatgttggtcaggctggtctcgagctcccgagcttaggtgatccgtccacctcggcctccaaaagtgctaggattacaggcatgagccaccatgcccggcctgcatcactactttcaagaagatagcagagaaaacagaaaaagcaatcaatactttctcaatcaccatgttcttcctgagggtctctccttctcttgagactgcagaaggaagaaactctcatcctagtaaacttgtggctttcctcttcttttaaacttttacatgctgggactcattcttcgtgttcttaggaaaacctgggttctgggtgcatacctacacctgtttttcacgggcatcttctaatttagagactgtttccctgtgtcattattttcatgcccagatttagctgggatattgctaggttatttacaagcacacagctaatatgtcaaaggaacaaggcagaggaccataactcatttttttttcttggagaataaacaaaaaggaatgacaaaaatgtagaacatggtaagattttacaattttattggctaatataatgctatctaaaatctgtttttttaaaatcaaaaggtaataaacactctgttgctgattttatgaacctatgcctgggaaccacagtgttgcctctgctggatatcactgtgggggcagcagaactttgtgggcggtacctacaataaaaaatgctttacgctgttctttgtagctgactgcttctgacattctgagcattgatcgagttgcctatgaatgttttgggacaggggatgaagacactcctcacccctacaaagtacatgcattcctatctctgaagctcttatatttatttttactaaaaaattagaatataggcatgaatccatgtatttacaaagtattatgttaatgaatgtaacaattataatgttattcaaactgagaatctaatatacagaggatatgtgagagcaggtaggatttgatcaagcaatgaaatacagaacgaatgatcacctggttgatcaaaaggaaagaggaagagtgtgaagaagattcttgctcgagtacggatttaaaacgaccagattgtccattttggatgaagactggctttctagagaaggacttttgttctagagtccctgaattatctaaaccttaagcagctatgtccaatgaacattttgcggtgaaggaatgtcctatatctgttctgtctaatatgatagcctctagcaatgtgtgggtattgagctcttgaaatgtggctagtgcaactgagggattacattttttatttcatttaatttaaaataatttaaatagtcatgtttccagaggctacatgaattgcacagcacagatctggaggaataaaagggaatccagtagccaccttctgagactccatgcctaagtcacactcaggggaactctgcccaaaatcttgtccagttctgggtcctaagtctttcatgccattactggggaattcacttgataggcttctattattctctgtctcaggaggactcaagatcagtggctttggcctctgaggacaaacaagcttatattctaaatggtatgctgagcttttcagcaggtctaactatcccagagtaggaacaactcagcactgccatccaggctcttaacacagtaatctacccgtgatagggcaagaaacaaagaaggaatcagtggtcctatcgcctcttctcccaacccctgggcccgaggcagagaactttcctagctcccattgtccctcagggcaatcatggataacagtattttttttttttttttttttttgagacggagtctcactctgtcacccaggctagagtgcagtggcacgatcttggctcattgcaacctctgcctcctgggttcaagcgattctcttgccccagcctcccaagtagctgggattacaggtgtgcaccaccatgccaagctaattttttgtatctttagtagagacggggtttccccatgttggccaggctggtctcgaacccctgacctcgtgatctaccctcctcggcctcccaaagtgctgggattacaggtgtgagccaccgtgcccggctggataacagtaattcttgatggaaagccattcacctattgctgagctgttgccaagttgtttgttctgaagaaatacaagaggaatggttgggtgtgaatgtaatagttggacattagggaaatgattaagcaaatatggcactcctgcatctgaccagatttttcttcttcctttgctgatagtggcctgctcttcactcttccaagtatctttactagtggagacttacctctcatgggctctgttagttcccagaaaatcactgaatgacaacactagaaacaaaatcattctagttaacatttcctcaaaagtacatagttatagctacttcttttactcaaaatagtatattcaaaactaaacctatttgaccatctcatagctctcagcttttgtttgctggtcataataataatcttaaggaagccctttgtaattggacattgctcagaggtgatgctggagaagggaggataggtgttgtttaattctgagacaccttgcatgctagactgaagttatacggtacaagataagccatggagaactgtgacacattcctgagtacagtcattgttttgatgatctattattttgctagaatctaccctgaaacttgatgactcaaaacaacagtgtattattatctctcatgattttgtgggttgatgaggctcagctaggtggttctcatttggggcctgtcatgcagttgtagccagacagccactaactagaattgactggcctaacatccaagatggtgcactgccatggctggaatgtactttggctgacagctggggctgtggactggagcacctgtacatggtatacatgtggctcgagcttcctaacactatggtggtctcgggacagtcatggtccttacctggcaagctctgggcatcaagactgagtgttctaagagtcccaggaagaacctgaaaggctttttatgattgagctcagaaatcccagaaagtcaattccaccatattctattggttgaaattgtttgaacaagtcaataagccagtccagattcaagaggaggaaaattagactttacctctaaattagatgagaagcaaagaatttgcagttatctttagtttaccacattgatcttattaaaaggaagccacctagagaaaatacattgacagttatattcagaaagattaaaaggttgaaaggctccaacacaaaaatctagattttggaaattgcttgtgtaaaaggaaaagtgacaaaacttagagatcaattacaaaaaattgcagaaaaccaaagatggtgggactgtgtggaattacaagggaaagagtattacatttaagaataagtttaaaaagggttgtattcttcctacatgtctggcatatgatggagaacagaggttagaacaggcacttcttggatgatgggaagggctgccttttgggtgaccatagacagttcagttcctggtgcttcaaattttatgtgttaaagcaatcagaagccagtggcatgagagacagaggccactaatctggttctgttaggtgtaacagtacttggatgtcgccaagtctattggcctctggaacttgctgtgctatatctattaacatgggaaaaaccaggtgcaagaagcctctttcactcatttgccttcactgascaagattcaagctgcaattagcacaaacagttggctggtttgcctgtcacttatgtcttatcttcctcctcttattaaggaggttaagaaatggtttattgcctatgaccgtcttatgaaatatgtcacactttctcatcagctcttatttcctgttcacatgtggctttctggttggtaaaggttttattaaatcagaggaatttgaacggaaagataatcatagtagcccaccaccaattgcctagggaaagggagagtgttgagtagattgaaattgagaagttgtagtgagaaaaagtaaggcgaaatgtagataagaaaatagttacttgaaagtcagcagatggaaaatgtatgagaggagcgataaaaaacctaggctgtagaaggaagtccatctaggacagtggtttccaatctttgttgtggttctgtgagagtttactggcagtgccataaataacaaaaatatgtgtagcaaattaagaatcacagaggccctctgtgcaaaaatgtaattttctttatttctttacaattgaagccaactagacttaggaattctcatttccacctgatggtagaaaaagatctcactaatttagagttgttttgtccccactggttcaagactcagtctctctgggggtagtaacacaatctcttcagaattctttccttccaaaccctgcatttgttttttctgaaggatcaatggagttctttgggggtggtggggctaaagtggaccgagctgaagaatggttgtcctggtgtcccgggaggggttctggtccatgagttatcctctgttcttgaaaacttcagctaggaccatgcttgtcccatcagactaggtccaagggctctttggtcttcttagcttctgcactgccccctttgagtgtctggggactctcagctgctttacttgaacactctgggatgcactggacttttctcaaggcagcctgtcctcaggcccaggcatatctgctgccaggcctgctgtttggctcaggccatgttggacacgggggctttgctatgaccctggtggtgtccagaactaggctgggaagccaaatggcatccctctcttccagtcttctccatcaacctcttcagtcaggaggaggccaggtgatgcagtttggatatttgtccctgcccaaatctcatgttaaaatgtaatccccaatgttggaggtgggggctggtgggagttgtttggatcatgggggtagatccctcatgaatggcttgggccatccccttggtgataagcgagcttttgctctgagttcacatgagatctggtcatttaaaagtgagtggcacctcccgcacctctctctcgcttcctcctgctctggccacgtgacgtacctgcacctccttcaccttctgtcatgattgttagtttcctgaggcctcctcagaagcccaacagatggcagtgccatgcttcctgtatagcctgcagaaccatgagagaattaaatctcttttcttataaatttcccagtttcaggtatttttttatagcaatgtaggaatggcctaacacaccaggatttctcttattaggtggtgctgaagagtggaagctctgagtcactcctcagaaacctttcagggtctagtaaagagcagctccctccctctgcttctccccttcccacctgctggtcaactctgttccttggagtgggaacaaaaacaaatagctttacattaccatacattcttctgtactccgtggtttatgatgtaaaccttatggtctaagttgtccaatactttggctttggaggttcaaggaaaaaaaacataaaatacttcttctttcaagcctagccttaatgtttataatggacagtctttcaaaatgtcctgccacatgggccataggagatgctttatttttcaggcattggattatgttgtgttggtcaatatgattttgtttcatgtgcattatcagaaactcttcccaaagagggtcctgggatctgatcagctagacaagtggaggagaaactgaaaaccctcaggggacagggtctcagttaagtctcctgaatgataagcatttcagaggtgggagggagacaccccggaaggtgtccagaggctaacaatgctatttctgtttcttgtaagtttttgtccaagatgtgggccattggattgcatcactagcatacaatgtcagtgtaagcggtaggctttacactaaagcatgttgatgtgctcagagcatttttgtggtgctgagaccagagcagatagggatacagggatgacagtctccaccttacgggagcctcctacccaggggatggagtgagacaggcaggcacaccagttatccaaggaaaggaaataaagggaaggagagagtcagtgaaagtggtcaggatggctgagtgagggagaaggtgacttgaaggtcccagatagaacagtggtaataaggtgagaaagaggaggtcttccaattccatttctgtgttgggcgggtgtttgagagtcccacctgggtctagaggcctgcatgtctagcaggacactgggtaggagtggctgaacggggacaacacttaaaaaagacaaaaattacggattttatttctacatggttgcacaaatcaatttcactttctacttgtaaactgcttaaaaaccttcattatgaaaatggaaggacgaatttatgttcaccatcatagtgcttctgggctggttccacagcatggagccaggcccacctgctgtagctttcagaactgccatttggacacgtggttgaagcagccttcagttggaggattcacagtaatggcatcactgtgggagcttagaggaacaactgcttgcaaccccagctgcactggaattacctgggagctttaaaaacactgccttttgggcctcagccccagagactctgacgtgactgatctgaacacaggagtgtcatgtcctccggtgattctgagtggagtcaaggctgtgagaccttctgctgtataaaggaatattgagagctgggattgttaaggaattctcttaatgctacgtcactggcctctgatgtaagcctgctttctcgaggaaaaggaaccataaaagcttctggaaacagattgtttaagaatgagaaattgtcatcatgccaggttgcaagacagcttttagggcagatgagcttctgctgctcattccttcatcttttcctccagcctggatttgtccgggggcagctgaggctcaggttacctcaattcttgagtttctraagaggcatatccaggggtgggttacgagaacaagagcctgcccagtctgaaagggatgcaggaaggggcggtgtgtactagaaggaaggaagctatcatcatttattaaaactcttcttggaggatggcccatgaagacctccaaacaagctggaggggccagtcacttgctgaagactagcgaagtggagggggaaagcccgagggagytgcagactcgaccactgcgccctccyctcctctccctgcaaggagcccaaggtgtgatcctgccaggcgttcgttcgctgcatgaccttggccatccttccattcccctgggtgtgaattctcattggcaaagtgagctggtgggcataagtgggttttaagtytaaaaatttaaaaaccctgtctgcccccaagtgtggtatcaagattttatagtatgacacttaaattgcttttttcatccgggcgcgtaacagcaacaatgaaaccagcagataacgcgtgagtagtatcagctctgggcctggcactattttatatgtattagctcattttttttaaaaaactgttttcaaccactccatgagatgagtgctcttatgatccctttttcacagaagaggaaacggaggtacaaagaaattagtgcacaaagccagtcggagagagcccctggccaggcaccaagctccagaggtcgctctggcgagcgtttgcttcgggatctgatgccctggagtcgccaactcaattcgcgggtcgcagccaggctccatgggggtagtagagccaggtcgtagtggctaggtgagttgtctcaactaactctagtggagccgccgcagccctggaggagccgggccgcgactcgagagcgcccggcagctctccaatgctttggaaccggcgggacccctgcgggctacccggggcagggcggtgtccgcaggggtctgtccagccgcgcctgctcctccgggtggagagttgggacacccggccagctcgctcgcagcccgcggactggcccagccgagccgtctccgcccgttccccgcccccgcagcggcggggctagagccagagccgcgcccggcagttcccggccgcgagggcgggcgcagcttgtggccggcggccggagccgactcggagcgcgcggcgccggccgggaggagccggagmgcggccgggccgggcggtgggggcgccggcctgccccgcgcgccccagggagcggcaggaatgtgacaatcgcgcgcccgcgcaccgaagcactcctcgctcggctcctagggctctcgcccctctgagctgagccgggttccgcccggggctgggatcccatcaccctccacggccgtccgtccaggtacggggaagctggagcatccggggactaggtaggggtgagacggaccacagccttgacaccttcgagtcccccgctctgcaggacgccgtgagcgtcctccctaagttgcacttggttgtcagagtgtgttgtgtaagaaggggatggcggtgaggtctgcgtgtgtgtgtttcttgtgtggagcaagagttaacgttgttcaggtcgtttgaaggaacttgccagttgttctggaggggggttctaggtaggtgtgtgacttcccgtgtgaatggctttcaggttttctatccggctacgttctacaggttcaggagcgtccctcttagaggttaggctcaggaccgtcagtctccttaacaaggtaagggctgaggccttaaccacactggggagggtaacttgttgcccctccagataaaggatggtgctagggaatgtagctacaagcaagtaggcgctgagaagacactcattatttacaacagtcatgcccagcactttacagtttataagcccttgacagcaactggtcttttaccctccctacagtcttgtgaggagggtgctgtcatcacccctgttttacagcgggggaagcagaagtttaggtgaccaacttgttggaggatgatgtcctgaaggagggtaagacctctgcatgcagcccccctctgtcttccctcccactcgtcctgcctgccagggctttctcctctgcactgccgggaggaaggaaggccgctgggaaggcacgcagatgctggctcctgctgggctgtctctccactgccttatctttggggcagggtagcttctcagatggccacattcctgtgatttagctttacattctaggaactgaggcaagggacaccatgaacttgggctcttgaggtcatggagcaagggtccattcgtcacgggaatgtgatggatgtctcagtcgctgcggtttggtgccaggcttctggacattgaatgtatgaaacagaactccatgactattgatgagctgaggaaagccagaggtggcatggggacgttcactgtcctttttgccatccagtttaccaagcggctattggcattgttttctttctcaatcccttctaatttattgtgtgatatctcatttgatatttcatttaatattctgtattcatatccgatgttaacgtttatgctagacagaaaggtagagcctttgagaatggggtttgctggggcaggggtgtggaactctgatttattttcagtctctggctagctgccaagctgctgtgtgtgaagcgtctcctgcacccgtccactctcatgtggcctccatgctgttcaggaaaggatatttgatctgaattctcacatgaccttggcaggcccagagcagcacccccatttctaataggccctgcttgtatgtcataatgtgacatcaagttttttttttatggttctgaaacctgtgacatcttttgagtcaacctctcaccattgttgaaacactgcttaatagtagattcactaatttattaaagatttattgactatctactatgtgccaggcactgtggtgagtggtggggagacagcggtgaatacgacaagtgaaaacctctgtccccttatggacatgagtcttcttggtaagacataggatgtcagcagtctctcttcaaaaggggggtctttgaaatscgcccctttgtacaagggtgtggatgcactggctacctagaggacaccactcagcagctccaatggagaggacgaggagatgatgggcacagatgtagctctgtggttccctagagaatcgcagggctgctattctccaagtttgtggtgtcccttgcctcagttcctaggatgtggagctctaggaggtggagctacactctgtggcttggccatgcacagggaccagggcagatggaaaccctgtggctgggatgcatcagtgcgagctgagtgtccacctgcaagctgggacattatggagaagacatctcagtaataagagaggcaaagctggacaattgcggtgaaactactatagcatagtgggtggagaagtacagagatccttatattcttatgctacataatggatatactaggttcttgccattttaaaagaagttgtcaggggcacctgtggctcacctgccatggcacagctccaggatgctacccatctgttgccgtgaatgggtgcttggtttgcattttcttcttcttgaggttgtgaggtgggctggtggcacaagacaaggatctgcamtgtcagcagcctttttctcctctggttgtctgctgtgggtccaggaaatgctgctggagcctcccggccatgcctagtgcagggagcatgtgggaagccctggccccgagttatctcaccaggtactgaaaggggctggagctctttaaggtcccagtcgcctgcatgttggattctgtgctgtctcctcttcatgcacatccaggagctcacacatggcggcacgatggagacacctatcacttcccaagaggactcatgcccacgagcggacagggggtctcataaattaaaagtagggtaaaaggaaaacaagagcggagatgaagtggagtctgaaatgaggcttgacatgtgcagtgtaaaccctgatgacctagatgctgctaaagttactcaagtggggccgtgaatgtggagggaagcctgagtcttagctctgcctgcaccttagcactgcctgaagcactcagggaaatgccaggactggatgcagagcaaacaaactagcatctctggaggcgtgctgggcacgggtattttcaaagccccccaggtagccaaggttgacaacataaatacataaatactctttcctgtaggcagtgggaaagaggaaaccctgcagggcacagccagcagtgtcttcaagatgaaagcaaagtgctcaggaaaaaaagcattcttggcacagagagaagtgggaagtttcttttaaagatccctgaaaaagaggtgagaatagtgagttttcggtggtctcttgaaatgaccctccctgtaagcacagttcggtaatcatggttcagcgagctgtgaacaggaagagtctagccatgctggtctctgcacatttggcgtcccaaatgtgagaactcatagatccctgaaaatacagccaatgactaatgactaagagttaaatgaaaagttagatggtgtcactttccatcagtgggtctcacctcattaaaacccaacaccccccttaatgcaaatattttaaaacaccccttttataattttgaaacgatataataaaacttatctacaacataagtttaaaaaatcaatgtaatacttagatgttaaggagaaataaaagcaatttgtattaaaattatgcatttcagtgtgcagatgcttgagctaagctgaactacaacctagtgaggtgagccattgctttctatagtctgcaggacagctggcatggggtgggaacaggtgagtctcagtggccatccaaatgccactgaaggatgaatgactctcggttaaggtcttgatggtagccaaaggccattcttctctcaattttcacagtgattgcattcctgaaaaatttagtgtgtataaacttgtgccaacaatatatgtatttcatatgaatgtagaagggagttggggggctaggcttcaaacaytgtaaatatgtttccrtcagtatgaacgtctgtgagacctctggaggtcatgcaggacaagtcttttctgagcagaactgcctgtgttgttccggatgtcaagcatcgatggcctccaatgctaaatgcatcctgatcacccagggtccccttccccacaggttccgaaatgctccctcaagggccatacccactccactgagaaccactgctttccctgcattgctgggtagtgagtgattaaagtgccattgcaggcgtgggtgccgagatagcagggcaccggacatgtctaagccagccatcaggaatgcacttccgttgcttgctgtaggatggtagaggtcgagttagaaatcagaaaggttggtgctttgtgtgtgggggtgaagggccacaagggaactttgaggggtggcagaaatggtctacatcctgaagtattcctggtgcacacagttgttgcaatttatggaactgtccacgtaagttttgtgtgtttcaccatgagcaatatggtgaaaaatatttaccccaataaaaaaattatagaagtgaaaacaatgtaacgattcttgtagagaaggcttagtcctctgaaactgtctgtggatcccaatctgagaaacagctgttcttgccygactgggaggcagtgctccagggagaaaggtctctggttctcagtcaactttttgacaagtccagtgcaatagtggccttggcatcgtagaccctggtggctggagaggagatgtgttggagktataggggaggctgggaagcacaaggcagggcatttagaaaggggacaaaggacaagagatgaggcccatccctgtctctgggttctggttctgttgtccaggagccctagaaggtttgtaggggtgagatggaaaagtcagacttcaacctagaacctagtggtcaagaggcttggggtaggtccatccccatctgtggcatctggtgacggtgatcctgtctttctgtgtctcattgccacttttgcccttaaaatccacatgccttagttgaaaccaccaatcttgtggcttttcgccttgtattagctgaataattgagatttcatagcracacttgaaacctcttgggaaatttttactttatcttcatatccttgtgcatcctcaatgataaaaataaaactttccttctcccatttacatgggtaaataagccattgataactatgaacaaggctttaggattcctctactgataggagcattgccaggcttggtgtttcctgggctttctgagatggtgagtgagcttctgtttccctgctgtgggagtgtttactcatagtttggtagagctgtttctctgggggaaaatcagaggtgaccacattgaacacacagttgggtttttgggttgtgtgcacgtgatagagcgtgggtgactaatctccacgagatggaaaccattgtgtcacctttggaacacactacagtggtccccagcacgctctgtggttatttccacactttcctgctctagcttgggtagggaagttcctgggtgggctctgtgatcattaggggtaggtcactscctctaatttgccccacaggtatgagtgtgtggggctctgatgcttccatttctcatcagaattgcatagagattattatggacatttacttaggacagtgcctctcggattttacctcccagggattccttctgggaaataaaaagcaaaggctcaacctagcactccaaagcagcccactgcaagtgatgcttctttgaagcctcatgttttgtcttagatcgtggagatttttctttctgcttcataatatagccgtgtttgctctaatagaaaaataataactcccctgagaaaatctttggatgaaattagtaacctagggagatagacttcaggctctctggctgtctgtagcttctccctgggaatttgtggattctaagccagggcttgtgtgagtatggaggtctaaagttttttccataagtgtgtggttctatggctttgtaagtcccttttaccttctttttcaaactgacatttttgtttttaacaatgatggggactttttaatagctgtatgaatcttataacaaaggaataacacaggaggtcaaggctgcagtgagctgtaatcacaccactgcactgcagtctgggtaacagagcaagactctgtctcaaaacaaacaaacaaacaaacaaacaaacaaacaaacgggtaacaggaagacatcataattatgggcttggtttcagtactgtaacacattccccgtacatgtttccaccgattttcagtagaacacatgggctgtgacatttcatgagctaaagaacctgctttagcccttgttttttcaggactcattcatggtcacttctcagttatggcaaataagttggagcctaattttctaagtatctctccattacatcagatctacacatatgcacatattggttaatatttgggatgaggggctgtattaaatgatgctgtaaatgcatttactcattactccatgggaaggtagaagagtgtgttgctatcaggtggaaatgtagaaagtgcagtgaggattttcttgtaaatctcagatttggggcttggctatgtcaggtccctggaagaaggaggartcatttactgccrtctgttctctcctcttgggcctctgtagagatttggccctatgccttggcgggctctgctctgcagcttggccagacacatccctcagcatggcaagaagtgtggaaggtcaagaggatgtgcccacttggcctaatcctaacccaccagcacccctgttcttaaccatgtccctcatgtacctgggatccctgaattccctccccaaacaccctggaccctaattccagggcctgtgtggtcattcccatggactcaactgcctggttcatagactggccagggctgtacagagggggatagacacaggtggacttcgacacctacctgtgtgcatgctcagggycccttccaatatggaagggagctggggagaggctagagacagaggaatggagattaatgtagctagacacagcaggagccatgcggtgggactgctccgtgcaggtctcatggtgaggacagcgcagcctatgttttgacagacatggaataccaggtgccaggatgagcttcccccagctctgggcacctctgctgccgctgtccccagaagtggacctccagcaggttctgatactatctggggtgcgcctgctgtgtgccaccttgcctgtgcctagcttctatcctagaaggcagggctcacaatgtgggggaattcctcaggaataagaatggaattcctcaacattgtggaggaacgttgtgggaaattcctcaagaaaaagaagctgtttaataaatgcactgtggctacacagcaggaaaaatgcctccttcccctgcactgggccctaggccttgaggaagaaacctgggttcctgtgacagcccctctctccccagctgtcacttttcccgtgcgtgcactgggtatgaaattccttgtagagggacaggaaggtgctgttggatgaggtcagtatttcctggaaggggggcttctgttgggggccaatatgctcattgttaattcttgtacttaatttctacttttgtaatttgtttcacattacagtttctcattctgggactagtaggaaattactttatgcctcaaatatgcattttcattttgtctttaatcaacaagtaactttgtgtgtgtgttgcacgtgctgctgtagtcacgttgtgatacgccagtgttaccaaatacgtcatgatcaccaaacagcgatgggggctgtatttgggaagatcttcacaattgcaagcttttggatgtgattgtcacataaagccgtggtgtgctgcagtgaatggacaaggcctccggaagtggggatgaccagcctaggccttggrtcaccctaggatctggctgactccctgggtctggacatcagcatctcagcactgcccgctgtctttcctggaagctgctatggagaggatgttagccagtccaggggtttcacacataacatagatatccttgcttgaaggctgaacagggggaaccgtatgctatggcttattaatgtattgagtaagttaatccttttctctttcttgttttattttatgtggaaaattcaatctgaaaaataacagtggcatacacacatctgtgactttttaatgttactggtattttctaaaggtacgttttgaatcttactataagtcatttaaaagaattacgatggactttgattaactagttctgaataagagaggtttctttacctagtatgccttctggcagtaacatttcttagtctctagtcctattcctgtagttccctctcctcagggtcatccccacccctcaactctttcgacagccatctgggtgtgaactctttatctaactccttgtgtaggattctaccctctcttatatgattccggccatctccagaccccagtgacggttcccttgcaatcctattctctgacctacacccagtacccttattccatcctttctcttctttgattctaggttgggttttcatccccgtgtgtctcatgcaaaaatggtgggtaggtaggtaggtggattccttccctccctccctctctccctccttcctttcttccacaagtatttattgagctgttacaacagacatgcaagatgtgtaggatgggcctcctcatgggtgtgggagaggggagggtctgctctgcactgctttcttccctggcccaggtagggaaggccaacaactagggagctacccaatgttaccagagccagggggcccagagccagcagttcaaggcacctcggtgcattgcaccagggagagcctgtgtcactcgtcatgcctggctttggaggagcagatgtctgcaagggcgctgtgggaagcttctgatcagaatcagctctgagatggtcagaaatctcagaagcttccaggctaggattggaagaattgacttccagacccaggargtgccatagaggtgcatggaggtggaatggcacggtgcttataaacggcaaggtagggagccagcgctggacacagagccarctgaacagtgaaggcagaagagtagggggcgctgaccctcatcccaggggtcaggcagaaggggccgatgggatgggtcaggtgctgcagagatgttcagtgggctggagacagaggggtcttggcatggagaacctaggagggatagtggcctgggcagtgcatctcagaggagcagtgagcttagagggcacatggtggtcgcttcagcaatggatgagtggtggagacagtaagtatataaattcttaagtgaagtttctggggcagaaaaggagggaraatgaggccattagaagagtgtgggggccargtgcagtggctcatgcctgtaatcccagcactttgggaggctgaggtgggtggatcacgaggtcaggagatcgagaccatcctggctaacacggtgaaaccccgtctctactaaaaatacaaaaaattagccgggcgtggtggcaggcacctgtagtcccagctactcaggaggctgaggcaggagaatggcctggatgcgggaggcagagcttgcagtgagcctagatcgcaccactgcactccagcctgggggacagagcaagactccgtctcaaaaaaaaaaaaaaaaaaaaaaaaaaaaaaaaaaaaagaagagtgtggggagtcaccttctctgcaagaagcttcctgggcctcccaaataaatccatccctcccctccccctccccctctcccattccatacattttggtgccattcactatataattcccagcagctgctttcatatctggggcatactcacaggggtcagtcaggagggcactgtcctaggactgggagcgggaggatgtgggggtctcccctttgagtttctgctatgatgtgattccaattgatgggccaacacacctctgataccttgtgttatgctgtgtactgcctcaargtgaataatagcttgggatttagtttgtgtagtctaaggaaaatactttgtgttgaactagtcaggctgttttattgatggccattaaaaggccttgtgcttaggtcttacaagcttttcaaaggcccaaagaaatgattcagacaaaaaaaaaaattagactccaaaatactaaaagaaaactgcaaaaacaggtgaattaatggtgaaagatctgtaggacatagcagtaaggctaccacaacccagctttttgaggttgtcttaaattaatgtgatatggggtgtaggtatgttaacatgcttgataatggaagagtgaggatacctgcttcttaaacagggcctgctcatttttttctggcctctagtacatttctttctggcaaaactcaagctctgttttcacggagatgatgcactgagccatggcatccctaggtggtttgattcatttctgcaccccggtgtctagcaaagtgcyacgtgcatgtgtttaatcaaaatagcttgtggttgtcaagctctttgtattcttccctccctccctgtgatttgatttcctgaaagtatcctttccccaaggattatggaacatacacttgttaaacactggacccattttcatgatcatttaaatgtcatgacctttctgacaccttgatatggtttggctctgtgtccccacccaaatctcatctaaattataatccccatgtgtccagggagggatctggtgggaggtgattagatcatgggggcagtttttcctatgctgttctcatgatagtgagtgaattctcatgagatctgatggtttaaaagtgtttggcacttccccccttgctctctctcctgctgtcatgtaagacgtgcctacttccacttccaccatgattgtaagtttcctgaggcttccccagccatgcggagctgtaagtcaattaaatcctctttcctttataaattacccagtctcagatatttctttatagcagcgtgaaaatagactaatacatgcctcttgagatcctcacagcaattggtgcctttagacctcttcattcacacttcactcatgtgttcttccttccccaggtagacgcaccctctgaagatggtgactccctcctgagaagctggaccccttggtaaaagacaaggccttctccaaggtaacagggctgagtcaccccagggtcccaaggccggccttttctcacaaatagctgaactcctccactctcagatccaggggccctggactatctcccattgtatgcaaaaatattttatttccgttgacacattactctttggggcagcttgatggttttattaaattttggaaggaggcttcagccccagtaacagccaatgcctgtttgctttcccaggtcaccttgactgtgctacagtagagacctgggaaatggtgggttccagtgctgtggccaagctctccccagtttcaaccccttccaggccttgctgtccatttttactccactgtcaccacatgttcaaattcttgctttctgctcgagtcagtactgctcacctcgttccaagagatctgggtctatgacactgtgggtgacaccctctgagcatcttttccgagctgtctgtgggtacctgaacctgccccccaacctggcccttgccctacctgccccgacctcagcgagtctggcccagtctgtccctgcttctcccctctggccccaagtgttctcaaatatgcccccgcctgcctgtctgtcactgcagctggcccagccctcatcctctctcccatgaacctctgtggtggcctgctctccctggctcccctgtctccagtttatgttccacacaggtgccaaaatgtctgcaaaaaatggagatttaacatacactagcccttggcttaaaacctgtacatgcttctctgccacctgcaaatgacagtcccatttcctcagcaaacctctgcawgttgtgggaacttatggcttctcagcctcccactcggaacccacctctggtttatgctycagaacatgatgttgttggaccctcccctccacctcctccaggctgagttagcctctgtctcccctcctgccctgggcatggctcttccagtagacacccccacatcacagtctaactctgtgtccacattccctgcaactgctgagctcctggagccaggccctgggaaccttgttcctgtttttgttcccagagccaaatagatatttgatgtatgattgttgaatgcagcagtgagtgaataaagacatgaatggttaactgaaaacattttatcaaaactgttatttgtcatcagagcatgggccggtttccaacagctaacatttaggagtgaccatttgccaggcactgttctaagccctttgcatgtggccattcatttcacccacatagcgccatcaatgacatrctgtcactgcattgcttgtcaaaagggggaactgaggcacggaggctgagcttttactcaacatgccatctatgttgagggacttctgacttggatagccrttcaactgcsagcactatggaggccagtcaggcctggccctgccttggaatttctgtgttattcagggacataatggggtttgtgttgatttttgttgggagtgtgtgggttaatctaggtgcaaccctcacctccttcccttctgatgtcctcactcccattggtcatgtgacccttaacgcccatcccaagctcagtgccaattccttgccccagggtcctggggattgacatggatcccaaaagcccgctgctgagaggacagggccactcccacccccctgactgtttcccagagcagctctggggcagaagtaaacttggacccagggggcataaccctttgcccttttatagtctattagaggaggatgaggtctgacatcagctggttcattgccccttgtgccccttgagcacactggggcccagggagagtcacatccctgccttgtggtacaggccaccggccctggacctgtgattaaacattgtccacaattaatttggaattattatctcgtgatacactccataaagttcagtcacacatcttctttttcttctcccctgcctaatgatcagacaagccaggtcttgtgactaaatgaaccgacagctggcagtgttcatctgattttgcaatgcccttattttgttgttgataaactaatgcaaatagctggttggcctggaactggtgattgggaaacattttaacccttctttccttcctctctatcctaaagacttaaaacacacttcacgcagtcacagaaagagctcatagaccagactgcggggcttcaaaggcttctatcttatttaatcatctgtaaatagtttaaaggtaaatatggtaataatactagtattctagactattttgggaagccagctgatgtgaataaagggtcagagttaaaagatattgaaggaatgcagttttactgctctgaggtaggtttcaaggcttgagccaggcttagagatctttgtcctgatactggggataaagtgaagagaatatgaatgggtatgtctcgcatggttagaaaatctttttttttcctgtatttgtttaaaaagcattttgtaacttaaaaaaatacctatacaccttttttttttttgagatggagtctcactctgtcactcaggctggagtgcagtggcaccatcttggctcactgcaacccccgcctcctgggttcaagcaattctccyacctcagcctccccagtggctgggattacaggcatgcaccaccacacccagctaatttttgtactttttggtagagatggagtttcatcatgttggccaggcttgtcttgaagtcctggcctcaagtgatctgcctgccttgggctcccaaagtactgggattacaggggtaaaccaccacacctgaccataatacatcttaaatagaacattttccagctaatatttaaatgactgcatgtcattagaatctgaatgagtgttgtgttaaaatattttgtgttttcatatttatttacttacttatagctacggataagaatataggcaaatttaatctcccgtaaaaattaaaaggcagatgttttcaaagcacagaattacatggtctactctagacattgctcctaaggttgagcagaggggataagagctttttctcttttttcctttcctctttttttyatacaaagttcgttgtagatattttagaaagtatagaaagccccgacaaggggaaacccactcaacccaattttaatgttgttgtcatttcttttagtttttttgggtgcatttctatgtagctatatcctattgtacaagcaatttaggatcttgcaatataaaatgaaggcatgacctttgagctggccaaaagtatgggctgatttttgcaaatgggtcctggcagcaggggacataagtggggaaccaatccccacacaagcagaggtgagctggcttaggggcgagtgcatagctgactttggatgtagactagatttggggaaatttaaatggggtccaagactggaaatgtgtaatgggacagaaggtagaaatgtttaaaatcttaagttgttgagtttgttctcaattttgtgaaaactctttatccctttttgttccccaycccattttctaaccagaagtcaaatatgacaacattcatgatgtaraaaaaccarttcatcagtgtgacttgtgsgtgagggtggggacagggccggtgttggtatatttagttttagagatttgctggaaaagtaacatttttgcttttgtctttctttcrttcctccatttctccagaagaatatgaaagtgttactcagacttatttgtttcatagctctactgatttcttctctggaggctggtaagttaagtatttctttgtgytcttgtctgctaagaaaatctgttatttagaatacatgaagtaccttccctaacagagtcatttctcatactcgtctctgttgaatctctgggcacagagcctcctggtcatagacctgtactgctggaagttcctctcagcatcttcgtctcattctctcccatatagagtgggaaactgaggcctagtgaggctgagagcccaaggtcatgtagctagttttggaacaaaagctaaaatctaggtctccaatctaggtccaggcctctttccacttggctgctggttgaaagtgtgatatgggaaattctgactttcatttggaggagatattatgtatagtctttatgaacccacagctggaagtcatcaagatacactactttttctgtttctttccatttcttcattttctctaatcttttctctttttgccaggtgctagctactggggatacagcagggaacagtgcacacagaaatacctgcctgcatagggtttatattcttgtagaagagagagataacagataagtagacrtatattgtgtcatatgatggcaagtatagggaggaaaaaagagtataaggttttggcattacagtgggcagaaggttaattttttgaatgtggccagaaaaaaacctccctgagaagctgacttttgagttgaccttaaggaaggggaaaagagagctatttggatatcagattggggtgtggaaatattccagtcagcatgtgcaaaggcccagaggccaagagtatttggcaggctttcagaataaaaatatcagcatgtctggagcatagtgagagatgagggaagtcataagggaccaggctgtctgggtaatggggggatggcagagggttgattatatrgaatgttgygcccttttttagggtcttggcttgtagtctggctgggatgggaagacttcagggttctttgtttaagaccagagaggtgatctgacttacgttttgattcctgttttgagaatagatccgagggagccaaagagagaaatagagaagccagtgaagaggcaagccatgatgatggctttctctaggcaagaaatgttgatggcttgtcaaagggtggcaaggagaagtgagaagtagacaaattttgaaatattttgggaacagaaccaagagggatttggagttgggtcagatgtgagatgtgagggaaagagaagaatcaagaattatctcagggaattttggcctgcgcaaacgcaaggtgaaattgccattgatgagatggggaagatcaggttttcagactggatgtgttaagtttagctgtccattagatgtttaaaaggtgactttgactaggcagtctacagcctgagggaaaggtctgggttgaatatataaaattggagacctcagcaagcggctggtatgagaaccatgagactgaatgggatcatggagtgtagttaggaaagataagaactttaaggactgagccagagattgacttaaattccttggtccagtgagttttctcccctttgctgaggggctccatgtgtgttggagcataccttcaacattaaggctgtttaaggccttagccttcacttcctgcttgtgtatgacctcagagtcatccagaaatgagagcctggtgccttctatgcaatttcctgggcatgcacacagccctgcatacatgcccacccttctgggttccccaggaatgtgtcagagcttttcaaagccctctggaggttatggctctggtattgcagctttaggcagttgtaaaaaacaattaacactgagtttttccagcaaacgccttggggatagtgcttttgctgtggagctcttggtgaggtcaataacaccaccaccctatgaatgtgactttgaggacctgccagtcaagtcaaagagtggcagtgytctggaaatgggacttttcgaggagctccaaaccctctctcttcttgcaagcctgctggttttcaaagcctttgtgtctgcaaagctcttgatattcatggctgttttagagctgggaagagtaggatggaagtcatttaagttataaagctacaaaccctgctgatccgtgatttggcatgtttctgtttgtttccttattttctagtaaatgctcttctggttactgcaagcctttgatttttgaaattttttgccagtctttttgttgcctttatggaggaatgatttatgagacccccactccaccatattrgaaatcttgcaaattcaatttctttgaatagaaaatagtattaatagatatagggcaatccaggctatctacttcttctcaagggagctttaatagtctggaaaatttgctcatttcatttacgttattaaatttattggcataacattgtttataatattccctcactaccctttacaaattatttaaaaaagagatgtcatctcttttttttcctgattagtctggctaaagatttatcaattttattgattttgtgaaagaatctgcttttggtatctttgatttttcttcattgttcttctgttttctatttcattgatttcctctctgatctatattactattttcttcttacttctgttatattaattatgttttttattttctgtatcttaccatattttgacattctggaagatgtttcatatctagggagagactgctccaccaggggctaagcagttcytaggtgtgttgtggacagcttacagcttgcccttcatgtgagactgcttgacccaagatggtaccccactcacctccttatccaactctcacacacccaaaccaatgttaccccagcctcaatcaacacagggctaggtaccagagaactagggacagcctctatgcccaaagcctgcaaaaatggttcaaatgggccaatctgaaactgtttatgctgccctgccttgcctttcccatgggaaccccagtaaagatgctggcctaggctttccttttgtttctgcttctgcctcctaacccaatctggtgattctccctgtggttttgcgtggtatggcacaccccttctgtccgaaccactaagtaatacaaatctttcaattgcattagtctctgttttgtcactcagtcaccttcgtaaatgaagacccaggcatagaatctctgcttgctgcttactttggaattactttgttctttttctagtttcttaaggtagaagctcaagtcatcaatttgaaatttttaaaaaatatataggcatttaaggctagcagtttccctctaagtactgctttcattgaatgccataagttttgatatgttatgttttccttatcattcagatacaaatactttatattctttttgatttctttgactcatgagttatttaggagtatgttaattttcaaatatatagggattccttggatatctttctattattgatttctaatctaattccattgtcaccagagaataagttttgtctaatttgaatccttttaaatttactgagtcttgggttatggggaagaatatggaaaatttgctaagttttatgtgtgcactttaaaaagaatgtaatgttctactgttgttggttggaattttctgcaaatatcaattatgtcaaattggttgatagtgttgttcaaatcttctatgttgttactgattatccgtttaattttattgcttgttctatcggtccttgtgagtggggtttctctagtttcttgcagaaccagtttctctagttcttgcagttctgtcagtttttgcttcatgtattttgaagcactgttagcagctacataaacatttggtattattgtgttcctgttgattaatgacttctttatttttttaaaatttatttatttatttattcattcatttttgggacaaaagtctctctgtgtcacccaggctggagtgcagtggtgcgatctcggctcacagcaacctctgcctactgggttcaagtgattcttgtgcctcagcctcccaagtagctaggattatgggtgcccaccaccacacctggctgattttttttgtattttagtagaggtggagtttcaccatsttggccaggctggtctcaaactcctgacctcaggtgactcacccgcctcagccttgcaaagtgctgggattacaggcatgagccaccacgcctggccgacttctttatttttatgaaatgccccttttttcttgtaatatttttactgtaaaatctactttgataataatagtcactcaagctttaactaattaatttttattaaggtatagttgacaaaatcgtgtatatttacagtgtacaatgtgatgttttggtatatgtatacattgtgaaatggttaaccctagctaattaatcaaactttcttttcatgagtgttagcctggcaaatatttttcttttctttttaatctatttttacctttatttataaaatgtctgtatgtaggtgtatgtgtttatgttaggcaccacatagttgggcctttctttagccaatctgatcatttccrcctttcaatgagagtgtttagactatttgaaattttagtgtgwttattcatatattagggtttaattctgggatcttgctatttgtttttctatttgtcccatcaattctgttatttttttctctttttttgctgccttttagattaattggcatttttaggattcattttattttgctttttggctttttagtcataactgtttgttgtgtatgtgtttttttaatgactgctctggggcttaaatagccatctctaagttatctctgtctgccttcaggtaacactatacagtttcacatatagtatacaaagttaagagtatatacccatttctcctttcttgaactttgccctattatttccatatatgttacttctttatttgttttaaactttatagcattttattattttttatttaaacactcagttttctttaaagagatttaaataataagaaagatgatcttataattacccatttttgttgctattcattcttttgcgtagattcattttcatcttataatattgtgctttttgaaggaattaaatatttcttgtaatgcaggtctactggtgatgacattttacagctttggcaaatctgaaaaagtcagtattttttcctaaattttaaatatattttcatgggatatggaattctaggtagactttttctttcagtactttaacgatattgttttgctctcttctggcttgtattgtttttggaaagaaagctgcatcattttttgtctttgtcctctgcaataattgtgtcatttctcccgggctacatagaagattttatctttgtcactggttttaaacaattttattattatgtgtttgtagtttgctttatgtttcttttgcttggggttcattgtgatwtgggggcctatgtatacatcatttttgtcacatcttgaaaaacttcaaatatgttttctgttttccacatttttcttcttcagtgattcatattacatgtattgaagttgtcctaagtaaaataattccctgcccattttattctgttatttttgtctctgtgcttaattttggataatttctaatgctgtgtcttcaagttcactcatctttttttttcctgcagtatcaaatctgccgtgaatcccatccattgttttttgtaactcaacattattgttttcatctctaaaagttttttaaaatctctttcatgtcttcactaatcatgtttgatctttcctgtagcatcttgaataaatggaatacaatagtaataaactattttaatttttaaatttattaggcctattgtctgtgtcatttctgggtcagttttgactgatcgatttttttcctccttatcgttggttgtatgttactgcttctttgcatgcctaattatttttttggatgttagacattgtggattttaccatgttgggtgctggatattttcgtattccccagaatgttcttgagctttgttctgccacatgattgttacttggaaatggtttaatcctttcgggtcttgcttttaagcttaatkaggatcaggaaaaagtttattcttggcctaattttccctaatgactgagtcagaacccttctgggtactctgcctgatgccttatcattaatgaggctttccaccctggctgttgggaacagcaactgtttccagcattgggtgtgctccatgtgttactccctccagttcgtttggtagtcctccctctagccttgggtcattttcttatatgcttacactgactgatactcagctgaaaacttgggggagactctcagttatcccaagactctttctgcttgtcgttatgcagctctaagtacttgggtactctgccctgcaaacttttctacccaggttctcagctccatctcctcaactcactgggctttgcctgtgttttttctcggcaatgtcatggcctagctgtaattttggacacctcctttcttctccgtctttctgggatttctctcctttgttttctgatgttcaatgtcttgaatactgttgtttcatatattttgtccattttttagttgttcatgtgggaaggtaaatccagtttctattactccatcttgtactgaaaggcatgtctctcctcctacattgtccccactttttagatgagtgaaaagggggtgaaggatgttaaataacttgccaggggtacagcacacaggcaktaagtgatgcagctggacttgaatatgcttctcagactccccagataatgrtcttatcacaaggctgtaaagcttttatatgtaatgtgaattgatgtatttaataatcaatgtgtttcttcgwagatattaaatcaagacacactggcagatttttatgtaaattgcttccacccttcttccttttaaagataaatgcaaggaacgtgaagaaaaaataattttagtgtcatctgcaaatgaaattgatgttcgtccctgtcctcttaacccaaatgaacacaaaggcactataacttggtataaagatgacagcaagacrcctgtatctacagaacaagcctccaggattcatcaacacaaagagaaactttggtttgttcctgctaaggtggaggattcaggacattactattgcgtggtaaggtaagagaggaattagtatgttacaaacatgttctagtttcctgcagttgttaaggacagaaatacttttaataatgcttaacttacctattttattttattttagaaattcatcttactgcctcagaattaaaataagtgcaaaatttgtggagaatgarcctaacttatgttataatgsacaagccatatttaagcagaaactacccgttgcaggagacggaggacttgtgtgcccttatatggagttttttaaaaatgaaaataatgagttacctaaattacagtggtataaggtaattttattttaaatatgacatttcacttttccagaaaataaaatagttccctggacaatagaatgtatctgcaaagtacctttttattttgtatattgttttctctttaatggtgaaacttgatagggaacctaaaaagaattgtaagactgcattcacttaatttgaagcttaactagaaatttgtttgctgttgtttttatttaatttaataagatgtaattgagaaaagtactagaaatagatgtttaaagagaaggctgattataagcttaaggtattgaagatgtaactatttattacaaaacatactatgtgtgttttattgaagatatggtcttcaaataacctgctagtttccataactgtctgaaaagtgggttgactagctttccatgraacaccccatgttttggtaactttaatctacctagtctgatggaacttaaatggggaatcatcttgtagagcttaagacgtactaaatacgtaatatcaatgaagtgcagtattgttaagaaactatatagtgttaacatttttttcaaacatgtttttcttgcaaaataaattggccttcacttcatagtacaagtctcatagacttgaaaacttaatgtcataggaatatagttaactgtttccaaaaagccagtattaaaactwactatatgtaaggaacttttccagtcactttctaaaaatataacatttgctaaggtgaaaaaaatggagctcctttggcggtagattggggaaagttattggttattggttttcaatgcttctctctccctttrtctaggattgcaaacctctacttcttgacaatatacactttagtggagtcaaagataggctcatcgtgatgaatgtggctgaaaagcatagagggaactatacttgtcatgcatcctacacayacttgggcaagcaatatcctattacccgggtaatagaatttattactctaggtgagtcatagctccagccctaaaaggtttagatctgggaaggtccagagactgtgattctaatactactttcattatccatgaagaaaccaaatccaagacracctcaatgataccacaaaagtcacatggctttagttttgtttttttgttactaaatactatgtaatgtttttccattcctgcttcagatgtagttctaattaaatagagacattatgagctgtgttttccaactgatttaagagggttgttctttggcatggctaaaaatggttcttactgaaagctctggggctccctctggctggtatatgggaatgttctgagagcctgcacctggggaatctcagtgagtgtcagtgtctagcagcaagcatcggtgtggacactaatgagctttggaataagtcacatttccagaatctacctcctgttcattctgtgttaggtgttaacctctctaaccctgtttcctcttctgtaacaagatgatgcaatctcccaaggttattgggaagattagagatatggggtacacgaaacttgtgtacctggtgcaaagaaatgcttggtgcaaaacagctatgcaattaataggtgtaggatgattkttcttgttaattttcttgtgtctttcaattctgcgttaaccatgtttcatattgaaaactatatcacagcaaaatgaaacaaaatgcacaaattgccaggggatagtcagaatgctcaaactttttgtaaatattgagattttgtaagatttatgtaataaaataagagttattccaatcagaacttttttgcaggttataggggtgactattagtagttatgctgggacaacaggtataaattgggactatcccaagcaaactcagaatatgatcaccctataaatagcttcacttttccagttatataatactttattttcctaaaaatatttttattaaataaaagttaattccttgccatggtcccacaggcatcagtgaatcccaattttcaatggtctttgtatcaaaccatgttcttgagtttttagcagcctgtcattgggtagctctggtctgtctttcctgaaacatagtaacctaaccagcaagtagaacttgagagagaactgggcactggggactatttaagctaggttaagtgttttttttttttttttttttttgagatggagtctcgctctgtcacccaggctggagtgcagtggtgcgatctcygctcactgcaagctctgcctcccgggttcatgccattcttctgcctcagcctcccgagtagctggaactacaggcgcccgccaccacgcccggctaatttttttgtatttttagtagagatggggtttcaccgtgttagccaggatggtctcgatctcctgacctcgtgatccgcccacctctgcctccttaagtgctgggattacaggtgtgagccaccgcgcccggccaggttaagtgtgtttttgatattctctgtttccttttctgatcccatttgtagaaacaatatactctactcggagtgaggtaatattttgttttctttccaaggcccacaccaatgatgcctagcactttttgttcactcaaggattcaaaaatatttattgagcatttactatgtttcaggaactgtaataggtatacattagggaaaaaaacagagaatatcctaccttcatggtgttcactttttttttgattgggggaataccgagtgctcaattttatagtttctcatagtttcttcatggccacagataaacccctgaaaccaatcttttcataaataagtcagattaatttctggggctycttgatacttttttgcctattttaataaattacagcattattccataaccctgtagttctcactattgggtcattaacacagtcattaaatgcaagcaggtctagtattgactagcccttctggccaataacacccaattcaaggaagtgactttccactactctcgcctttgctgacatgctttcacttaagagaggcatttgtctggggacccagggtcctggtgatgtgtgtgtttttcagtagcaccccactctatgaattcggaaggtctagctctaccccgggattcacagtgtgctgtggcctctgcctcagctttcttccttcactttctgcctcctgtctcctggcatatgtgctttgaacacttgatggaatatctggccagaagtcatttagtatgttttgctaagtgttgtcgtcacttgagattctgatctataagagactgacaaaccttatggatgtttttctttcagaggaaaacaaacccacaaggcctgtgattgtgagcccagctaatgagacaatggaagtagacttgggtaagtgggcttcagtgagggtatgctggaatcggttttttttttttaaaacataagagtaagataaattgtatctttactatatataatctaagccatttactgtataaatctatcaatggagggaaagtgagacaaattatatcttaattttttgtatttcttgcctctatggcaaacatcttgccatgtctgatatctccagccctacttttctgtgaacacttattaccatgaaaacaccaaccagacaccaaggtcaaaaggcctaggaaccagcaatgccattgactggtacaggattggatttctttctttttttttttttcacagagttaaaatatttaatgacaaaaatagggtttgctgtaaaagtgaatcaatacagtaggtgttacttatctctgaattaaacaaaaattatatttgacatcttaaagaacttctgaagaattgatcattgtacgacagacatcagcagtgttacaatttcaggactggatttctcatgaccagatccaagctttgagtcggaagagtaaggctacaggccccaaagatggtagtcattctagaaaagtatttttccaagttagtgaacattttttattcaagagtaaagaaagaaccccacaagcatctagctctgcactgtttagtgcagtagttactaggygcatggagttatggacatgtacaattaaattaagtcaattgattcatttagttamattaaaaattagttcctctgtcacattagccatatttcaagggcttaatagccacatgtgacaagtgactactgtacagacaagcacaaatatagaacatttccaacatcactgaaagttctattggaaaccactgatcaagagagaaaaagtggttctttgtgtcagaggacccaaaataggttggccttggaattgtcctctgtaatagtaactgcatgacagcagtcaagaaccatacagaggttagaaggtatatgcttgtgatctgtgaattctgtacttggccaattctgtacttgttatttatggtggaaggtggtagaaagacattcttagacagaaacaaaaatgtcaaaactcaaaattaaatatgggccaataggctctagaacaatgtttctcaaccatctttttttgttttaaattgttcccctttagagtctaaaaagtcttcttccacctaattctctttcctgtctttaaatttcagtaccacagttatcttttatatttgctgatatactgtggccctttggagtaccacaaaccatgtaatatctaaggttttcttgcctcttccccaagaaccagtttttgccctgctggccwcagcccctgttgaaaatgcctgccctagaagtgtgtaattgagagctctgatgcctaggctgcattgatctctcaatctacaaaaaaaagcttcaaattaggaaataattattttaatgtattatattgacagtggatcagaagcatatagtaccctgtcataggattatcctgaagggtgttaaacaggcaataagatccaataccattactcctaaaatgacttagaaaaatagggattgagagatatttccttaacttaataaataacatcagtgcaagccaatagtcactaatattcttcatggtgaaatactatagaccttctcactaaagccaagagcaagacaaagatgcccatgtaaccactattactgagcacagtctagaagtgcctactaatgcaattgaaggaaaaaaacaaggtatgcttaccacaagggaaaaaagacatttttattattgtttcctgatcataccaatcccaagaaaattcccgggaaaaactagaattaattctgtataaattagtcagataataaattaacatttagaattaatgttctaaaatataagacttgtttagcaataaccagctagaaaacataataggaaacaaatgccatttgcaccagtaaatgtcttagaagtgtccataaaatatgttagaaaaactttgaaaatatgtggaatttataagagaggaaaaaactaaaaaaaccaaaaccctgaatattaatctcagaaaaactgaaatttaaagcatgcatccagccaggcgtggtggctcaagcctgtaattccagcactttggtaggccaaggtggacagatcacttgaggccaggtgtttgagaccagcctggccaagatgttgaaacaccatctctactaaaaatacaaaaattagctgggtgtggtggtgcacacctgtagttccagctgctcaagaggctgaggcatgagagtcacttgaacccaggaggagaaggttacagtgagccgagattgtgccactgcacttccagcctgagtgacagagcgagactgtgtctcatttttaaaaatggaattaaataatggatagagggataacagtttttaaaaaggaaggccgatgagcaccaagctaatgaaaagcatgttgattcaccgtgaattcaagaaatgtagatgaaaacttaagtgacattttcttctctcaaaaggcaatgtctaaccaaaaacacttgttatctggtggttttggggaaaatcgtgctcacatacactattggagagagggtagactgacacagcctcactaaagagagggggttagcttttaaaatatgtttctttaattcaatcttgcttctagattttaatacttcaggatgtgtacaaataaggctattcattaaaatattaatcataatagtgaaaaattaggaaattgtgttcatcaataggaaatagttaatcatagtgtatatgtattatggaatgctaagcagccatgacagagtctattttggaagacaaatcatgtgggcccaaattcccaatccacagtaattacaaaatagtaggcaaaaagaccccatttcaaaaactgcacatgttcacagagaagataaggaatgagacscataaggttactaatggtggttttctctgkgtggtgggtttagggtaattttcctttttctttgtgcatttctatatctaaaattttaattcaatagccatttattaatctagatagatcagaaaaaatcaattaatgttaagattaaaaatacattctttgcaggatcccagatacaaytgatctgtaatgtcaccggccagttgagtgacattgcttactggaagtggaatgggtcagtaattgatgaagatgacccagtgctaggggaagactattacaggtatgtatgctaagagttattcacattttgrtgttaaatcccacgtgatattttatataaccttgtcggttcagtttaaaagcaagtgttagttgctcctaacctttgctgcctttttttttttttttttttttttttgctaagctaagtagaatttataagatcttgtacatttaaggtaaaaaatacttgtcattgtggtgcaaattacagaccacttagaagcctttctcttacgttatacatgttgcaacatttcaacgaagcaattatctttcattattcttcatattcctcaagtagcttagaagagactcattaatgagctcaagaatcaggcaatccactgctctcgaaagcctctactggtttcctactgctcatctatgggacaaggatctcctggcttcccatgacctctccttcacaacacctgcaaagcactttgtcatctgccccaatctcctcttgtttagtgtctcctctgtgccccatggagaacacaatgcatttgtctacatttttcttcttggaagtggtaatttttttgctttctctgctactgagcctgttactgacagtggtcttggggttataaaatctcagattagtgttgccagcagtctgaatgttgtgactgtgattgggcagggtgattatttcagtggcaattttgtcacaaataaggaaatacacagggtatacaggtcttatttgtagttgatgcaattaacttacacaagtttatttactctctctctcgaatagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccaggtaaacaacaaactaattgaaatgcagttttgttttactgtagtaagattccatgactttgaagtttgaaatgccatttcctctgcttagaacacgcttcacttcctcattacttgggtaacttctatttctcttttactcttctgctgaactctctcttcttggaagcttttctgtcctgctgcctgcccttaacccagctctcggcccaaagagaggaggttagggcctctgtatgtacttctgtagcaccatatgtcacaggatctatggtacttcgttttctgtacttaactataaattctgtgatggtggcaaccatttatcttagtaatcattctatttccacagctaatggcaagttaggtctggtacattgtgggtacccaatgaactacattgatgatgcatagggtaagactaaatatccactttcaaagaggacatcagaagtcactgggtttcatgaattggtataataaaacataatattgaaagtatttgtgaaacattttaaggtaatttgtggtttaattaaacataggctattataattgcgtgcatggaagaatatctgaaagactctataaattaacttctatgtatgtttaaatactggcagcatacaaatagaaattacatttaaaagataacatttatggtagcatcaaaaatcatcaaatacttaagaataaatctagcaaaagctgttcaaaacctctgtaatacaaactaaaaaatattgagataaattagagaagaactaaatggaaggatatacaatgttcatagattgaaagactcgatattatgaagatatcagttcttccccaaatgaatctatggattccaaaaaatttcaatcaaaatctcagcagtatttgtacaagtgagagtcagtgtttgtatgggtgtgtttttgtggacacctgtaaaagtcatagggaactgtaaaggaccaagtatagtcatggtggtcttaaataagaaaaataaatctggaggattattactacagacatcatgatcttgtatgaagcgacagtacttaagaccgtaagtgtgaactatcatttgggccagctggatatttgtctggaaaatggtataacttgatttctgttttatatccaaatcatttaaattggaaaagtaaataaagcttttagattcccttttctggatgcttttacatggttcctgatatttagagggtactttctttttcttccctctttcttcttctctagccccctccccatcacctactccatctgctccccagcttcctctttaattattggataactaagtagagaaggaggccaggagaatgtggaaatgtgaaacttccctaagcctccacyttattcgctttccaccagtctttaactttacccaatggactctctgacctcagggaacttttgtaggcttttgagtgattttaacttttccctgttttactgtggaatgctctatcctgtggtcttcggtattatttcccatgttattgtatattatgctatttaggtagaaacttcatagaatgcaccttagttttmtcattgctttgtacattagtatccattacaaagtgataataatgaatgagttaatattgtctgaatgcaggccattcccagatatgggctctctgagacgaagatatttaatttgctgtgctcaaagttttaattctttttggttctaatattttttctcctttttttttctttttgctatagtcactaatttccagaagcacatgattggtatatgtgtcaygttgacagtcataattgtgtgttctgttttcatctataaaatcttcaagattgacattgtgctttggtacagggattcctgctatgattttctcccaataaaaggtataattttgtattccatgcagtatttcttgttggagataagggatagttaggagatgtagaagatgactaagagggtttttactaagagggtttctaaaatgaaaagtggcatatacaagaatactagttattcttacacagaattatagttttagaactcattaggctgaatatcattgttttctaarttcctgcctcaacattcatattggtagaataaacaggtatttagagcatctgtttataaattcagttatgcacaagccattggtaggccttgctctgtgatgaataggacagacagagatcataccttaatgaaagaaatgaaatgactagatcttcatgcatcagggaggttctctctctctcctttgtttaaactttgcgaaaaaaaaaaaaggaataccacaatatctaaaaaaaaatgaatggatagaattcagggctgagacctctggggaagaagatgaggacagggagactttaaggatggctctatactaagagtatacgaggcagcctccaaatagaagaacaaatttgcagtaaaacacaagaaatagaaaccttgtaagagatgaacactttttaaagggattatatttttggtattgctgcttcagtcatgccattgtataaaaaaagatgaatagttcattatgtaatgaatgtttgtgatactgactttatcaaatctcttatttttgccttgtggttctaaatacattatgtttttcctttagcttcagatggaaagacctatgacgcatatatactgtatccaaagactgttggggaarggtctacctctgactgtgatatttttgtgtttaaagtcttgcctgaggtcttggaaaaacagtgtggatataagctgttcatttatggaagggatgactacgttggggaaggtatgtgtgtaatggaacagagtaaaggcttattgttgtaaaactacttagtaaaatgtggattccatctttctagaagatcgtggcataggggtatatgtttcacaattttaagaacctcttcagaagtgtatgatgatttttacatttattaaatgcatttacttctctcatattttgtcagagcaataattaagtgattttcatttagttttgaaaaacttaatgactagttaaacccaacagttgctttacaactgatacaattaaacaggagtggtagagatcaaatgattgaataataagtttttaaaattccaacaaagttttctgagttctaaatgaaatatttgtcttttgagggccaatttttgagttagtctataaaatgggaggtttgcagtggctcatgccttttatctcagtacaaccctgggaggccagggtgagagggtcacttgagcctaggagtttgaggctgcagtgatccaagatcacgccactgcgctccagtgtgagcaacagaacaagagactgtctcttaaaattaattaattaaaaacatgggaaactcctttaattttaagtaagacaagaaaaaggcattaggagccatacggttgtgaaaagccttgtgtggctttggttcaggagrgaatgatgataaatagaattttacktactatattgtgcttcctgtttttcagacattgttgaggtcattaatgaaaacgtaaagaaaagcagaagactgattatcattttagtcmgagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacrtggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcrtggagaagttgccaagagttctttrggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccckggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatsctgtcctttgttattatcctgcattttacgtctttggaggaacagctccctagtggcttcctccrtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctyttgcctgcacccttcctcctcctttgcctaggaggccttctcgcattttctctagctgatcrgaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttatcctgagaatctgttctttgtccagtccacagcttacctgcacatttgcacattcccaggcctcaacaaggtgaggagaccttctgcagagagttcttcctgttgtggggaagcaggtggggaggagctggaggaggggaggggagtggaggtcagaggctattggcttaacagtgagccctaactcccttcttctagctaaactctactccctctgctcatttgcttctaaaatggattaaaatgtgagccttgtcaataactgtttattaacttcttatcaatttactattaacttatcactttacctgtccaaaaaatgataaagggaatatttgtatagacttttacattttacaaagcgcttttattttttcctttgacccagaaggtgggcaaaattggtgaacttgctgtccaaaatgcatgctctaaagcttgttaactctgatggtcagagatgacacccagtcagtgcctccttcttacctcacagcaatgctaaggggcaggtgactctctcagtacctggggagaaggggcaggtggcaggttggcttagagtctgagtccagtatgagcactgcctccaccagctacctggagtgaaaccttaggcaaagtatttgagcctcaatttactcattatataggtataatatctaactcatagagttaagattaaaaagattaaatatattatgacaagcctagtgcttagcataaagcaggttctcagaaaatggttgctttgttagtagcaattctatgaattgcttatctgaagccctattagaatctgcaaatggaaggggtagagaggacttataaattagaaatgacaattgacactaaggacaaagtacacaatgtcaaactgaagttgtataaccacagaggccaggagccctgtccagcccacagcccctccactggcccccaacctgaaagaatgtttctcactggaagagttcagggagctttgcaccacattttggttatgataccagttaatgtgaaaaccattaggaaaatcagtgctaaccaccatttaaaactcacacgttttcctctctttatcagataaattttccccagtaaatgcaaaataggtttttagggagtctctggaattattttacaacaggaatgccgtctggtggaaaaagacctggaactaaattcctgcactgtcacagctttgaaaccacaacaaagcacctggttgtatggaacccccattttctcatgtgtaaaacaggacttcctatgttacaagatgtttatatgtaggaagtctctgtccagtatacgggatagaatctcaaaatatattttcttagttttatcacttgatgagtacagataaaacaaaaaacttactcatccaaaatgtatatttttcaaattctagggttttaggtgtgtgcgggggttggagagtgatataatgctggtgttaactttttaaaatgatcacagctgctacttaatcccattttagcaagtcaggatctggtttagcatttttaatatagtacgttccccaagtagtaattgaaggacttctaagtataaataccatgcaattataaaatcagagatttcctccagcttatttgtcaaaagaaaatcttttcgcctttgacgtgaggctctgggagtgtggtgaggttggcttagcgtgcagggcatagggagcgtagcaggtggggaagaatgtggattgggctggaagggaaaaattgttcctctgttactaaaataaaatacatgaatgaatcaccatcatggcaataattcataaaatggagtacacatgaaaaaatgtatgtgggaagacagaggaaagggataattttttgatgtgataacattcattttacaaccaaagattgtgtgtgtgtgtgtgggggggggcggggtgtttaaattttaaggagaggaagagttacaggaataggtggtactatttaaaatgagtattaatcattcaaaacaaaaacatgctcatcttaccacatgccgctcaggtttcttctgaagaaggcttggctgctcaaagtacgtaaatcatacctataccttaaatctgagccccaaacattagcacagcagtctctcaaaatttgcagctgttagaccagttgagcctgtaccacctgactctagactcataggaggctgttgacatctctaaagctgtgttcaaccagttgagagattaatttacctacagggtgaagttgatgaagcttgtttttcttagaacctttgacctggaagtgatcccaagtgccatttggcttctgcttccgggtctgggaaggctacaatgataccattctacagtgttcattggttttcctgtcaatctacacatcctgaggatgagattccttaggcttctttagtgaaacggtattgcatgtttcacagcctgtgtggggacccactcctgctttggttcatgtagttaatccttccctggctaacactacattttccctccacagccatgttacgtcacttaccctgcttagccagggacagactgcagcttctcatttgctttcaaggctgtagacagcagccatctgtttcaacagtttttgtcgtcagatgctattccgtagtcctgccttccacactgtacttgattgcttctgaattcttgtctttcctaaaactggacccatgtcctctctcaaattcaaaaacacaggggaaatatttgtgttctcaagcgtacttttagatttttaaaaagtgctaaccaagtggttaacattatgctagacactgagaaaattacaaagtaagaaaaaacagaaatctagccagagaagaagagtgtgaagagaaagttgttcaggaaacaatctcatatgacagagggtcttaaacccatgactgaactatttggactttaccactaggagtaggtatatgggagatattggaggcaacaggttggaagaactttcgacataaagaaacacattgatagggcactattgtacagcagattgggaggaggtaaaaggttacatagggaggttgttaggaaggtggtagagtaatccccttgggagtcaattatatttaagacattttataaaataaattaggagaaacttctttttattacgaaagcaataatggtttgagagaatgtggaaatttctaaaacatataaggaagaaaaatgtcacccataacttcacaacctaaagataattattgatattttataacatttctatggatataactgagaccatataatacatggagtttaacactctttttaaaacttagcataaatatttgcccacattactattatacgaaatacaatctataagtagtcactaagtctatcaaatggatggtccataatctgatagctttgctgccttcagtggacatccagattatttctagttttagctatcagtagtcaaagtgcaatagttatcctttctcaaatatttttacttccctaatcatttgcttagcatatattcagagggcaagattccttttcaggttcttgatgttccatagagacatttgctcctcttacacaagcagtgtgtggcactgagaatactcattattaaatcattgctaatttgatagacaaaaaaaggttatcctttgccagttaactattaacatggttgaatgtttcacttaacaattacagttggaggcgggtggatcacttgaagccaggagtttgagaccagcctggtcaacatggtgaaatgaaaccccatctctaccaaaaacacacaaaaagcaaaaaacaaaaattacctgggcgtggtggtgcacgcctgtaatcccagctactaaggaggctgaggcagctgaggctattggcttcgtctgtgttattttattttggaatttacaaactgtttcctcctttgtgattttgcactagctgtttcctactttggggaaagcccttctcgcagacctccacatgctggactccttgccttgacaagggcctctgctgcaccatagtcccttctgaagggaggacttccccaacaccctctccatcacttcatcataattgctttcagggttctcaccagcctgaaatcatccttcaaaattttcttatttacttgacactagaatgactgtaaactctaagagggtctgtcttctgtacagctgtatttctggcactcagaatatcacctggaacacagtgggaactgtataaatatttgatgagggactgagcgaactaatgaatggagctcgagggagtgagtgattaagcccaggactgcaggaaaccaagtgctttaaggacctccttccagtctccctggctgcttcttccatttctagaagtccatttcatcccaacaatagcagtctgctacagaaatgctgctatatattcccaagcctcatagaggggaaatatgagaacttaagggccttaaaggtataaagatcttggtggagccccaaacacccaccccagcctaatactgggttttggaaagtttaattgttgcgtgtgaatatatttctgtttcattctcattgggaaacattatctgtgggatatggccaatgggaaataatcagatatttagttagaacaaataaaaggtagtatgcatcatgtaaaatataaatttgtatatgaaatctttaatccaaattgttgccctcctacccttctgaatagccgtcatatcctagtctgagggtcaaatagactgaaggtaaaattcaaccaagcagaattctgtaatgctttcatcacacacagatttgttgctttttgcctgctctcagaatgaagtgatgaatctctagaggaagttgatttacttcataaaaaaaaaaaccaactgaaaattatttcctatggccactgactaatgctagaaaacattaagaatattcccattgaaaaaatatctgcaagtgggagagaattagacaaggaggggttggtagggggatggtgataagcatctattacatattatacaccctgttatggaggctttacaactgccacctctgaaaactgggcataacctctcaatctaaatgtatataaaataaaatcacaggatagcttttacatcagagcagcaaaactggcaaaatttaaaagtctgacattaccaaatattggtaagaacatgaagcaatgaaattcttttcctctaaaggacatagctatggaaaaaaattagggcttttctaatacaattgaggatgtacctacccaatgattctgcaattccgttcactaaatggcctctgaaatactcgcacaaaaggacattaccagaatctttgcagcagcaccgtttataagagcaaaatataaatttggaaaaacttaaatgttcgaaggagatgaatacatttaagtttttttttttcaaggtaattgagaacctgcagtaaatattatggtttcctgttatttttaattgctaagtttacaatacccggaatcagttctgccttcaaagccaagtgttcattttccacgtatcaggaaacacatttggcatagagaccatcccaggaagttaaatttcagattctcagaattagtagcaaagtgcaatgtcagaagtgtccagtgagaggcactgcaggggactgggatggcctgtcttaacttcatacattttggggcaacaatacccattaaacttggcatatatactagtcctcaggctaagaaataagataggacacaaatgcatctattcataaagtgaaaatgaaaaaagatagcataaagatttagaaatacctttcaacactgctcatagaaataattctgaatgcaaatcatatgacttttataaaaatagtaacacttttgttttgttttggatgaggacataaacgctgaagaatatacatatacagaggaacctcgtttactgctgatagtaggggaaataaataataatctctatttatag

SEQ ID NO: 17734 - DNA, 55689 bp, Homo sapiens
ccctcagaggctgtacctggggaggaggtacctctcttcctccatttgacccaattctaaaccccctgtagcagtgacgtctgtcttcgtctcattccagtgcactttgtgaattctagagggctttcccagaaccaaggaaggctgctctgcccacagcaggccttgggaatttaacctccctgggagcagcctcaatgagtgatgctctggaactgctgggtcagtagcccagcccctggccccttggatgggatcatttgaagccctgttttctgcaccatttttcaagttccctggtggggctgagtctggttgcaaatcgtgaaagctgccctatagtacttttaccagctgcctccctttctctgtctcacttcctcattcccctcctgatgtcccctgcacttcccagatacactacttgcccctgaatcttgccccttgaaccatcacaccctgggactaccccaggtgccactctgtttgttgtttctccgcctagaaggacgggcacccaggaagcaaaacgggagggcagggaagggagggtgttctggggaggcttgacaagaaacgaggcttttaaaagaaacagcagcaaagtgccaggcctgcaccagccagcttgagtcacactccagggactcagcaaagcttgtccaccttcctggtccaccctgggcctgtccatcctggagtgaccaccgggcgtttccagtaaaaatcccttcacttcacttccgtcatctccgagtcaggcaaggtggtggaaaccggggaagacctcagcttcggagctgctggaatttgtgtgactcacgccctccagtggtcacttgacaaatgacatagggctcacggtctggggacttgagcttgttagggcctcagaaccgggagggtcccaggaatgcctcttctcaatgccttcctttgacagctgagtggagtgaaggccccacaggacacgtgactcgccacgggacatgcacacacacaaatagagagtaagagccacgcccctgtgtttccttcacgtcccacctttatcatttgtgtcacatctgcatgcacctatactgttatttgcttaaacattttaccttaaactggctctctttaaaccttaaatatatttctaaaataaaatttttatcactttctgtgaggcggggcacacagtaggaactccgtctcctccttccatggccttgcacagagctggcaccagacactgacatggaggggagaacattcaaccccaggtaatcctcagctcctaccttgatctcagtttcccactctctcattgtcacctctccttgcccctgggtgtactcacctgtagcaaaatgggtaagcacacagtgggcgcacaagtggggtccagtcaaggtctcagacctgggtcagtcctcagctttgccacttacaaactgagtgacattgagctggtcgctcaaactttctgtgtctcggtttccttattggtgaattggggatagtattataatagtacctgccacacaacgttgttggaggattaactgagataataaatggaaagcccagggcctggctgtatttatggagcaagcaccagagcaagtgcaagctgggactccagggttgtagccctgccaccacctgactgtgtggtcttggacaagtcatttggctttgcttagcctcaatttccccatctataaaatggggctagtgatcattcccaccccataggactgttgtgtggattaaatgcttggtatgtttaagtgccttgctcagtaaacgttagctctgatcaattgtttttgtagaaaagccttcaaagttgctaacttccgagggctaactggatctgaaccatcttcacagcctggcatagaaacagatcaaatcaatccagtggaaaatcaattccaggataatgagcccaagacattcccgtgctgattgctgtcagcatggtgcctaggacagcctgggaaggcagggaggagggcatttctccacagcagcctcggaacctctatcgccaccctccggggggcccacctgtcccccgcctgcccttcaaggtgctctttgatttctccccagmagaattcacctgctgcatccatcatcagaagaggccaggaatgyggcctgctgggtgggcagggccaagaagaaggcagccgtgcaggcccaggaagccgtaggagacttgccaacctccaggagggggccagccctggaccctgcagacaggcgctctggggagggtaccagaagctcactgtttgtcccggcttgaaggctgtttgctgtgtgaccttggtgagtctcctaacctctgtgtatcatcacaatcattatcactatttttactctcctcctcttcctatttgccggttaagagaggattgggatagtggtcatggttatacaacattgtgaatattctaaaaaccattgcattttacactttaaaatagttaattggtaattttatgttatgtgaaatttattccaattaaaaattaaaaatacatacatgaatttaatgttacaaagggagagagaggaccgggaatttaaaagcaggtgtttgtggtgggacggggacctgtctgaggaaggatacttcagaaggcaagtcctggcatccacttgctctttgtcaaaagggaaattgttactctctgactcccagcaaggataataaattcttacttggctgactttttgctcaatggctcaaagcattttcttgtatctcgtttatttacttttatttttatcaccttttgtcacgagaaaagtcaggcccagagagaagtggcttttccaagatcacatggtaggtcagcagtgaagctgtgcctcgaacctgggacctttcaggctaaaggaaaccagaacatgccacgcccagatatgccgatatggcatcctgattatctccagctgaaggcatttgagaaagagcagctagagagagggctatctgaactgccctgtcctgcctgcagcaagccataaacattccttggagaaagatgctttcccagcatcaagatgagaagataacttttatcagctcagagatggcaccagagccatctacaaatacaaacaaaccttgctatcctactccttagctcacttccacatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttttttgagacaggctagggtgcagtggcgcgaccatagctctctgcagcctctaactcccagactcaattgatcctcccacctgatcctcctgagtagctaggactacagtagctgggcatgccagcatacccagctaatttattttcaatttttctgtagagattggatctcactatgttgcccaggctggtctcgaactcctggcctcaagcaatctgcccacctcagcctcccaaattgctgggattccaggcatgaaccaccgtgcccagccatcttgtcactttctaaaatgcattgctcttcatggcagatgctccataagccagagttctaagccgcagcattgagttactttcactgaggcttctcctgcgtggtgtgcatcacagacattaacaaacttgcttttttttctctattattaatctgtcttttgttacagtgtctttcccaacaaataacttaagatgattgaggagaaattatatttccttcccagctggctaattccaaatgtgtcctcaagcctggtgcttggactcaaaccctgccacaggtcaagaatgccacaccaagcagacgctgtgttagaggggcacctgaggtgacatgtttgacagatcacataactgaataactgcattttctgaaggaaaatcaacgaagtgctttgaggccaagtagatgggattcttgaggattccatgaatagcaaatagtagtatccccctcagaggctcttgggtgggggcattaaatgtgttaatacatgtgtttgctgcaggtatagccagaatatgtgaaagcagctacagggaatagagtgtagcaaactcctaatcatccctcaaaaccctgccctggtgtcctctcccttgtaaactttccttgaacaaggcagaaccagctacatcagcaccataccatccctccatcactacagatatcactctgtactataattatccatttatttttctaggccttgcactccctaaggccaggattctgactctttccctgagtgctgtttacctgaactgaaccggcatgaaccaccacgcccggccatcttgtcactttctaaaatgcattgctcttcgtggcagatgctccataagccagagctctaagccgcagcattgagccgcagcattgagctgaagcctgaagggaagatggctttgatatgttaaaactcattccagtttactcctatttttcattcattcatccacacattcactcaacaaagatccttgagctctgatatccatgtcttttttgtggctcttagtttatctttgacaaagttaatatattatgctgaatttaacttgggaaagacaagaaggaaatgagtggacagtggtagcaaagtgttgggacggtgagatcaagggtgactttttttccctttgcttctcaacttctccctaatgtagttgttattttacttttatgatggaaaaatgcatatgtatgggaatactgtatttcaggcattataaggaatgaaattataggccgggcatggtggctaacccttgtaatcctagcactttgagaggctgaagtgggcagatcacttgagcttcagagttcgagaccagcatggacaacatggtgaaacccagtctctaccaaaaacacaaaaatattagctgggtgtggtggtgcatgcctgtagtcccagctactcaggaggctgaggtgggaggatcgcttgagcctgggaggcagaagttgcaatgagcagagatcgtgccactccgctccagtcttggtgacagaatgagactccatctcaaaaataaataaataaataaaataaatgaaatgaaattataagaaattaccactttttcatgtaagaagtgatcatttccattataagggaaggaatttaatcctacctgccattccaccaaagcttacctagtgctaaaggatgaggtgttagtaagaccaacatctcagaggcctctctgtgccaatagccttccttcctttcccttccaaaaacctcaagtgactagttcagaggcctgtctggaataatggcatcatctaatatcactggccttctggaacctgggcattttccagtgtgttccatactgtcaatattcccccagcttcctggactcctgtcacaagctggaaaagtgagaggatggacagggattaaccagagagctccctgctgaggaaaaaatctcccagatgctgaaagtgaggccatgtggcttggccaaataaaacctggctccgtggtgcctctatcttagcagccaccctgctgatgaactgccaccttggacttgggaccagaaagaggtgggttgggtgaagaggcaccacacagagtgatgtaacagcaagatcaggtcacccacaggccctggcagtcacagtcataaattagctaactgtacacaagctggggacactccctttggaaaccaaaaaaaaaaaaaaaaaaaagagacctttatgcaaaaacaactctctggatggcatggggtgagtataaatacttcttggctgccagtgtgttcataactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaaggtgagttgccttcatttctggggaagcggctgttttgagagggttttgtttcttcctctttgagaaggctcagaaaattgtgggaattttctgcctacagagagaaggtgttggaaagtctaggtaaaaaaatgccgacatgaggtttggtcatttgaacatggcatcttggtcagatttcttttctgcaaatattagctgtggttgttacatgacaaggaaaaactttctgaaaagttcaaaatgggagtttgtatctgctaagaattttttttaacagagattatcttatcagtccttataacatgtaacctccccacaaatcctggtaagatggatatattaaacccattttatggatgaataaatgagtttcagttaaataacttgatccaggacacataactggtagagctaggattccaggatttgaacccaggtctatggggctataagttcttttctttctttccctctttccttcctttccttcctgtcctttcctcccttcccctcccttcccttccctttctttcttttttttttttggaaacagccttgactgcccagcctcaagcaatccttctgcctcagcctcccgagtagctgggactacaggcacaagacaccatgcctgcctggctaatttttcaattttttgtagtcaaggtctccctatgttgcccaggctgaactcgaactcttggactcaagcgatcctcctgcctcggtctcccgaaatgctgggattacaggcgtgagccactgcacttggcctaaaattcttacatggactatattcactacactgtcttctaaagacagagtttttgcctctttgatcttcctcttgtctgtttcaaaggagatgatctcagatttcgagggatgagtgcatttttcacaaatatttcctccccacataataaaagaggagcaagtaataatgctgagttagaacaacaactgcaaaatctttaaaagaaaggtagctacagcttgagtgctttccccagtaayagacctaaaactacagttgataatgagagctgctgggaagtgtctttcagggtcaggcaaaggcacccctgtttcaacgacctccgggctcttcctcaccctgcctgtggccagtgatgaagcctggctgggtctggtgggccagcaggtcccgctaaggaggctcatggtgcatacagtttgtccttgttaagtggcgatggggatgggggggttcattgtttttccttaagattattaggtggctttacagaattgaagtctgtgtccgaaggctccccattccaaccccgaaatagagacagaggttgcaaagcattgatgaaggggctcatgctggcgttcatatcgattccccagtgagccaaccccactgagaagccctgttctgtaaactcttcttcaaccttccctcacctctgcttcycttcttcagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagcyccctgtgccacctccaggtgagttttccctgggggaacctcctgcttgtctccttgggcacccatgccctgtcggcaccgatgactcagaattcctctctctgctcctcctctctcacctgaggtctgatctcctcattgcttcttgaaagtccctgttggaattcaatgcagccgctgattattgggcacctcgctgtgcctgacggtatgtgaagaaggaagggacatggtgcggggctggccctgaagaagcttggaatctttggggaagaatatgggaaggagcttggcctgagaatgggaggcagtagagcctcgtggtgggcaccatggcggaggggtgggggtggagggtcagcatcctggcctgcgtccattccaattcaccgcttgctagatgctttgaatatcatcctggtgaagggcatcaggatgttagacaaactagttccaagccctgtgctggccgcactagttgccgggtgctgcctctagccagctgtgtgacgcagggtaagttaacctctctgaaacttagtgctcacctgtggtatgaggaacccaagggggccctcaccatagtgtgctgaggatgaaatgagatctacagcactcagcactgtgcccacacagaacagacacttagtccacatcagggttcatcaccatctactgagtacctgcccttgccagagctacacaggccacttgacagactttgcatctcaactgatctctgtggcggctctttgaagttcatatgattgactcatttcacagataaggaaatagaagctctaataggattatgacttcccccagcctgaatgaccggtaattacagagtttacagagttggaacttgagcccagatttggattcttcatgtccctcctccccgggcccatccttcctcccagggcagaaccaagagaatgagtcagttaatgaacaagtcaagggacaggcttgaggctcgctcaggtggaaagacaaagcaatctgcaataacgcaatagtgcaactgaaaccaaagcccccrtctacacaagaccaccacatagccacacaaccccaccgccccagaggagcctttcccatggactacaaagggtagggcgccccctggatgtgtrragcatgacggccctgagtgtatctgtcagaggcggcaaaaaatgccagtggctaagaggatgggcttggggatgagcaagtggctttgccactcagtagccctgtaacctttggcaagtcccctagcctctgagcctcaatttcctcctctataagaagagggtaacaatggtgatttcctggagttggaggaaggagtaaatgagctttcccatgtgagcaacttagcacagggcctggcctggagtaagtgctcagcaaatggcactgttggcattgctatcattagcggtggtgttggcagttaggaggtgatggagcaaaattgaacagagttccctctaggggcttcacagaagtcaggtggactctgtggcctttgaagtatgggtagaatgtagacaggtgcagaggagtagcaaggacattcaggaagaggggagaggtgagcagaggctcagaggcagaaatgagcctgactgtgcttggccaggagtgggctgggggctgggataggcaaagccaggccagagcacaagggcttgaatgcagggtaggagatttggactcgctctccctggcagtagggagccattgtaggttcttgagcaggacagtctagctgtggtgtggtaggtgaattggaggagaggactttgaaaccaggcagtctgggctatggcaactgaggtggctaagagaccaagaggtgagaacacagagttgatggcctctagatgtccagattctaagggctgtagaggggcagtggcttcgccccttccttctcttcatctcatcattgcagccgctgccagctgacctccctgactccagctccccacactggctctgagctctctcttgccaactggacttctagcaagtcacgcccctattctagagcctgcagtggctccccattgcctgtcaccacattaaagcttccacagagttctgagcgagcaccctacccaaatggagagcccatcccacctgcccatcccagccttcctcagctccccagtgcctgtgcatagcacattcctccctcagctcatccagacccaactcatcccctatttttttcttttctatttttattttttattattattatttttagacagggtctcactctgttgcccagacttcagtgtagtggctccatttcagctcactgcactgcaacctccacctgccaggttcaagcgattctcccacctcagcctcctgagtagctgggactacaggcatgtgccaccacgcctggttaatttttgtatttttagtagagacggtgtttcaccatattggccaggctggtctcgaacccctgacctcaagcaattctcctgccttggcctcccaaagtgctattacaggtgtgagccaccgcacctaggcttcttttttctttccttttcttttctctctttctctctctcttttaaagctgagaatcttgctctgttgtccaggctgccctcgaactctgggccctagtgatctatctgctgtctttccggatcaccctgaatctcccaaaacccttacggtgttggctgcagcctttaaccctcatccccacaccctctaatagcattgccagttatccctatgtctttgggggctgacttgtgtctttggaccattcaggaaatatgagttcagactccagggagggccctgagctgcagtggacatgtgacaaaccagctaacttgaccatgtttttccccctcctcttcatgctggggtgggctggcggaaaggatccagtcagatagaagaggggatgaagaaaaaaatatcacacatcaattcattcaactctcccaacgatccacaaggaaggaattttagytatcccattttaaagatgaggaccctgaagcccagaaagttaaagtaattttcaagatctcataattagcaaatgacagagctgggattcagatccaggcagtccagagggacccctgcatggggctgccacctttgtgtcctgggcatgtcacattccattgacgagtacatgcagatgcccactcccctggctctgtgctgggagttaagatatcaatgaaacccttctgctcatcagtgaattgtttgagccacttattacttacatacaccactgctaaaaacaatagataacatttataaggtccttagtactgtgtcaataatgagacaggaactattatccttgttttacaagattgagtgacttactggaggtcaattcctggaaaatagtggagctaaggtttgagtcaagtccaaactcataacatctacactatctgtgctctcccagagggcctactgtgtgctgcactgttcaagagacagagaaaaatgacccagttcctgctgtcaggaaggaaacggggaaacggatgtcttcctcgctggtttgggagacgtacatgaagaatgcgagttggagaaattgtgtcaggagtaggtgggatggagtgtagacaggaggtcgtagttgtgggtgtactgggaccgtgctagaggcctctgctggggagactgcagaggtgcctgggcaggctgtagtgtggggaggagttggggggaggaggtgggtccacccagagtgcaacatccactcaggtgagggaggggtgatgttactggaagaggaagcagccgtgcaaagggratttcatcctgaaagcaatgagagccaatgaatatattttgattttaaaaagtaattttctaatctgttcaggtgtcatgaaaccaagagcctattctaagtgactggtgattctataccttcgtaaacaattaggaaatgagcatggtgtgtgtgtgtgtgtgtgtgtgtgtgtgtgtgcgcgtgtgtgtgtacgcatgtgtgtattttagggacaaaggcaaatgtgggagcatctaggtgaagacacatggaattcagaaccaagtcgagctatgtgttgcttgctgggctgcagttggctagaaataaatatgtgccctctttcattctgctttaactggggttcgggatttaatgtgcttgcatactgccagaagggccccctgcatgttgaggtccagggctgctgccccatctgggtctggaccctacctgttatcttgcttgagataaggagcaccttacaggcggagcaaagtcaggaggctctgcgcagtccaggtagcaaggacaaggggcctgcaaggcaccggaaggggcttacgatccctcctgcaatattcctactagaagtcacccctaacccagtgctttctttggtttcttttctggaatcgcacagaacatgctgtatgtaacaagtaatataacacttcccgggacagccttgtgaggtggtgtgagcttaggctgggctgtggtcctggggctgctgtgtggccctggacaagatccttaatctctctggccccagctaatgcctcaataaagtggagatgacaacgtagagctgtctgcttaacgagactggacgaaatgacagaaaggaaatttgctctgtaaactagaaagcaccgcgcaatggtggtaattatcataagctttattgcgattttatggggaataaacaaacacgaggcccaacacgacccgggcatcttagcccagacacagtccagtgccatccaaactccgcggcagacgccggctgcgggcccctgggtgcttgggtcccgggatcgccggggaaggcagggaaggaggggcagctcggcccgggacatcgcgtgggtgaagagcccccgccgctgctcggctcgccccgcccccggggcgggggctgcaggctccgagcgataaagcgcgggcgctgggaggcgcgtggagccagcggagctgcgcctaaggagccgggccatgcgcgaggggctgggcgcggcgtgcgaggccgccgggccccggctgtgcaggctgctctgcaggatcctccggccgaagcctgactgctgcccgcgcagagccaggtaccccgcgggccgaagtccgccctgggagggaagcggtgggctccgagcccgggcggggccccatctctctctgggagaaatcsgagggcggggatgtgcgctctgtgggattcctgagggtttactaaaagcgttttcctcttttagaacgcttgagaggtcgcaattcaggagcccaggcggcccagagaaaccccccatgcactatgagaggcgtctatgcgggttcagttgcgctgcgaatgtttcagcacttgggagcttttgaaatttttcagcactggggttgaaagttgctacactctttggatcaaatatggttaagagagcaaggaggttcttgtttcacaaatgagatccatttcccagggcgccatcccccccaccctccccatctgtccccaccaccactcttggtgtaaggcgaggtaaacaggcagggaggcgtcggaaccgcaggggaatctggcccccaggtcagcccaggcaagccacagtctgcagctgtgaccggctcggctggtcaagggcttgtagaaagttctgggtctaagcaagccaccacactcacagcactccccacgcccccgacccctttttttgatagggtctcactctgtcacccaggcgacagtggcgccgtctcggttcaccgtagcctccacctccagggctcaggtgatcctcccaccttagcctcctgagtagctgggactacaggcgcgcatcaccacacacttggcaccttttttttttttttttttttttttgtagagatagggtttcaccatgttgcccaggctggtcttgaactcctgggctcgagtgatccgcccacctcggccttccaaagtgctgagatgacaggtgtcagccaccgcgcccagctgccagcactctctttgaatgcaggtccttgagggtcctcaggaccccgcacagctgtgggtttagtcaaattgcacgagcgtctgcggggtcagaatcaacaatgtgataatttggaaagaagtgtccagattctgaaggtgctcacctggagtctggtcaccctgtcaccctgtctcccagcagccagccagaagaaatggtgtgggaggggacttgggcaaaactttgtttattcatttttcaaatttaaagaattgtccaattatgaaaggaattcattgtcactgtaaaaagttggaagatgtggaaaagtataagaaaagttaaattgcctatgatcttatcacttaatgctagtcactgttaacatttactaacattccctcgaggtgtttttctgtgcttgtacgmacacacacacacacagccagcatcagactgtgtatacagtttaaggcattatttatatgagggcaaaactagacacagtctaacatccagccatggacaatgggaccaggctaatcgtggcccatctgtagagtggatttttagccaacttttaaaagtgatactttttaatatatggggtaaaatgattatgttaaatgtacaaagacattgcttctcaatctaaacagtactgtagatgtttctggtctgaagcttctgaaattgtccaactctacttccagaagtaagtgagaggaagcaagaatgggtgcagggtgggtgctggggtgagggggaatggcaaaagagcaagaggggcagttgtcccctggggaccccatcccccatacatcttcctattgaagcagccccatggtgactgctcagccatggcttatctgttctgaatatccagattgccatatatatatatatttttgttttgttttgttttgttttgttttgtttttttctggcaggccacaccagtctagaccaggtgtgttaaagaaaaaagtattcaatgatacttgttaaagaacagtatggaagtctttatttaggaccatctcaataggtacagggacctactgcagtggggtctggcagtggaggagagagattgggcccaaatccaaatacagcaggagcaagtgggaatttatagccaaggatcagggtggggtctgtggatggaaaattaccaagaaaaacttcaggcatagggggaattctgcctcacccaayctaacaggattcttgcttaggacaggctaaggtgatcagacatcgcctgggggaggatggaggatgaggaccctgatcagatggggaggacgacaagctatcaaggatggagggttcttgttaaactgactaagtagggattcttttgctaaaactgcatttttacaaggaaatgcttggatgggccccgcagaagattcagaagtctgagtaaagtttggctaagcaaagcatctttgccagttggcaatggttggtcacatggaaggccctttacagggttgtggaatcccttgattcagatataagttgctttctgatacatacttacatcctcttttaagacagtatctctttatagtaaaaaatcacttactgctactatgtaatgtatataattaatgatataatggtaacatatagtcatttttttctataataaaagcaatacatggtcatttatcgcatttcaacatcatagatacatatcaagtagaaaatgtgagaccctcataatagtctctaaccacctctccctcagatgcacaagcatgcataccctggaaaatactgccaagaacatggaacacaatatgctttcaaaccaaggtgccctggtgggatgattcttcctaggggaggcatgtgtgagtggtgactattcagttcgccggaatgaacctgaaatcccaaaccaggacaaacggtttctgaccggtttcagaatactgaatttttaagtaatctttaatttaaaaaattactttaagtaatgtttaatttaatttgtaagtaatctgtaatttaatgctaatttttacaatacttgtttttaccttggtgaaggtaagttgacatcttagatttgttttaaaataatgatgggggcagggaaggtataggtgaaacaagatcggccgtggattgatcactgttgaattgggttgaatctgggtgaagggcccatggaaggttattagactattctctctacttttgtacacttaacattttctgtaatagaaatgtagaataagtaaataaaccaagataaatcacgtgttttaaataaagcttaagtcatgaaaaacaagtggctggggctgggcgcggyggctcctgcctgtaatcccagcactttgggaggctaaggtgggaggatcacttgaggccaggagtttgaggccagcctgggcaacatggtgaaaccccatctctaccaaaaatacagaaattagccaggtgtggtggtgtgcgcctgtagtcccagctacccaagaggctgaggtgggaggttcacttgaacctgagaagtggaggttgcagagagctgagatcatgccactgcactccagcctggatgacagtgcaaggctctgtttcaaaaaatataaatcaatcagtcaatcagtcaaccaatccaagtggctgctgggcagtgctgctagtctgggaggcagagttgttggagccattctctgcccacccagcccctgtgccacgtttgtacttggcttttccagagggtgaaggagcattttccagatcctctatgggctgctgtttgggccagtagctttggctcagctctgctcatgcccttttggctctgcgggaggaagaakataagaggaagagggaagatggggatggggaggcagttggtcagaccraccatgaacaattcactcccaccctctggactcagtttccctatttgtcaaatgaggttactggcagagggaactccaagatgcccctccacccttggataccgcatctcatgctagctgtttcctttcacagtccagtgacacaggatgaccttcagtatcacaacctcagcaagcagcagaatgagtccccgcagcccctcgtggagacgggaaaggtcagtgagtcacatgggtgtgggaagccccttcctccctggtccaggcagatgcagacatagcagcctgttagagctgggctggagagggcaggaagccagggtttggatggagagtggagagtcccagacccggggtgttggggggaacaggtgggaatgaggaagggctttgggagagtgagacaacccccagtggtcgggagtggtggcccccaaggtgcactgacagctagcttctatctcctgggttccataccattctagagaggtgggcagagaaatgggtaggagtgggagagagggtggcttatatgtccttacatgctcccagggaaggaatgcagtggtgcctttctgttctcagtagtattggctctgacagtcatccttctcacctccaacttagtctttagtccctcctacagcagttcctctgaggaagcatttggcaaggccctgggtgaggagaggaccctggccagtggcccaggcacctggagctcttagcaggcactggcccaggtcgcccgggggctggaaacagaggagggacgtggagggacaccctgccctgtgtggccacccatagatccttccccactctaagacaaggcagggcctggggtctaggagagacctgagagaaaaccctgttttttccccttgcagaagtctccrgaatctctggtcaagctggatgcaaccccattgtcctccccacggcatgtgaggatcaaaaactggggcagcgggatgactttccaagacacacttcaccataaggccaaaggggtaagtctggggcttcagggagaaccacctttgtcccaagctggtgaagctgccagggctttgtggatcaaacaggtgtccccctgggcaaaccaaacaatcatctgcttgggcaaaggggtctaggaacagagacattcctcacagattacagtaggaagtaaatgatgccaactccctgttaaccaccccagtaaataatggataatccagaaggtcaaataaatgattgcagaaacaaattcatatctttcttagccggatttcaggataatgtcagggagaattttctaacagaactgctcagagctggactgtattacatcaggaggtagtgagctccctgtcactggaaggatttaaatgcaatttgatagattgcagaggggttcaagtatcctgtgagtggttggactaaatgtcttttcaggcttctttctgtcatgtaagtttttaattctaacttcaggatacattctatggttgtaaagtgggaaagaatggacaatttcaggaccatgaaagcaaaattatttcccacatgcccccaaaccaccacagttaacattcgggtgtacttcattcgtgtgtgtgtgtgtgtgtgtgtgtgtgtgtgtgcacgcgtgtgccttcctatgtctcatttcagtttgttttggccaaataccaatatcatgttcccataggagccatattggattgactttgctctggatctggagctggctggggagcagggccagagactgagtccggagtagggagaaaaacctgactcacacccactggggttcagccagtggaagagaggagatctaggtgggagaaagccaggtggwccccaaggaggaggtgccacaggggtggagaagaggtgcagggagccggagcagccagagaggagccaggtggccaggagagctggccccagaggagggtggcaagaggccgaatggcccaccctcaccacctgcctctctctttccagattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagagtaaggcttgcctcctgcagggtcgctgcctcctgcccttcctcctgctctcctgtctctacccatcaccctctgatcctagctagatcccttttctttccagatttgtggtgttaaatcactatgattttgcagagcgaaaatcacggttttctaggggagaagaccctggagcaggttctcataattgtgggataacgttgtacatagcaataccagttaaaagtgactgaattcgaaccctggctcccgcattgtgtctgaacgtcctcatcatattaatggcaaaaactgcaactacttttgcaccaacctaatataaaatggggataataacagaaggtggctcatgagatttttgtgaggattcagtaagttcagaacagtgtcctggcatccagagaccttgattgtgaattaatatggaccctttaattatgaaatgtttgagacagaaaggatctctgagaccacctagtcaggcccctactcctacaggtgtgaacatggaagctggtgacatacctgaagtcacctcattccagctagaagccaggccacctgactaggagagggcaggccattgctctttgccctgaccctggtggggttctacatttctggagttctcttcttttttctacccagtgaggcttccctgaggaccatgctagacatccttcatttctatggccaattggtcatttggttgacagacacacatcaggcactgagtatgcctcagccttgtgtcagacactggaatacaaagatttttaattgtcatttgccaattttattgccaacgtatacaattttaatcatccaaagagaggttgtatagcattgtggccttcccaggttcaaatcctagctgtgccccttacgagctgagtaaccctgggcaagttactttgtctctctatgccttgattttcttaccgaaaatggtgataataatagtacccaccttgcaggaggagggtagttggcgggagtttataaagatgaaaggagttaaagaatatagagctaggaacaatgcctgggccacagtaagcacgacataagtattagccattttcatgtttttagaacactgcgttgtccaaataaaatatgtggctatgtaatttaggcccctttaaaacttttaaaacaaaaatgcatgaagagattgtaagaaagaatgtctgaaagaaatggattgttttctttttgtttgtttgtttgtttttatttttgttttttgagatggagttttgctcttgttgcccaggctggagtgcagtggcacgatcttggctcacttcaacctctgcctcccgggtttaagcgattctcctgcctcggcctcctgagtagctgggactataggtgtgtgccactacacctggctaattttttttttttatttttagttgagatggggtttcatcatgttggccaggctgatctcaatcccctgaccttgtgatccacccacctcagcctcccaaagtgctgggattacaggcgtgagccaccgagcccggcccagaaatggattgttttctaggctggaaggggagtgttgctattaggggagagcctcacacagcactgcaccacacaaagtgagccacagacatgtacctgggactccctggcggaaagagtggcttctggtggtaccacctccacttttctttggcttttttttttttttttttttttttttgagactcggtcttgctctgtctcccaggctggagtgcagtggcacaatctctgctcactgcagcctcgatctcctggatcaagtaatcctcccaccacagcttcctgaggagctgggaccacaggtgtgcaccactatgcttagctaattttttaaatttttagtagagacagggtctcactatgttgcccaggctggtcttgaactcctgagctcaagcgatcctcctgccttggcctcccaaagtgctgggattacaggtgtgtgccgctgcacctggcccacctccagttttctacaaccctagaatgtctgagctgggagggaccgtgagtcttcagaagaggccctcatcttccagggtcggtggtcctcaaccctggctgcacagtagacttacctggaaagcctgcaaaattctgatggcagggtcccttgagccaagggcagcagaatctggggagatggggatgaggcagacatgtgtgtgcttcaaaagctccccaggtgattctaatgcacagcctggattgagcagcctgttaggggctgcctgcttcctgactgcaaacttcacaagatccttggcctttcagctcggttgttaattaatgagcctttcggggtccagggattttcctggatgggtttcattgggccacagtacttatgttatttatttatttatttagcataaagcacgtgtgcaccatgacactatgagattggtattattgttatcctcatcttacagacaaggcaactgaaatccacagaagagatgtaccttgctcaaagtcacacccttcgaagccccagagtggggattcgaacctaggcagctggtgcctgagcccttgcttttcccatcaatgctctagtacctagctgtgtggccttgcaggttcccaactctattctggacgtgggaggccttgctgttgtgtggaaggcaattgggcgggtgttcagaagcccagcagggctacagggccatgcttggtggtgttggaacccatttgcttctcccagaggaaaattgtatttttccaagtcacaagtacataccttgaacccctgcttccctgagcaagagawcctgggggtgtgaacggggaatggcagcctctcctcacagggaccctggcaatctaagacatgaccagctgagcaggttcagtggccttttgtatctgaagaatcatagcatatttagagattgtgacttgctgcatgttacatttaaatctgttcactgatgatgaaagccactcctttttttcagagctcatagacatcatagcatttctaatgccttagaaaatgactatatgaaaatggctatcacatctaaaactctgaaggaattggatgtgaatgtaaaaaataatcctttcttgcatatgcacgtgctgaccaccatgtgtgttggtggtgtgggtgttatggtgatcattactgttgtcatgctcaggtgcagaggggggaatattgctggaagctttgtttggggagggaggtctcccagcagtggggtggttcccacctcacccagyagctccttatggcaggggtgtccttggggataaatatcatcagtgttttgtctttgtgctttttttctctaatcaaggaaaagttgtcgagacactcttcatccacagaaaggccattttgttcagagttacccactctccttaatcaggagttcattctttaaatagttttgatgctgtttcaaaaggctttggtgctgaytggaaatctcaaggttgttgttgttgktgktggtggtrgtgtgtgtgtgtgtgtgtgtgtgtgtgtttcaaagcctttctgactgagtccctccctccctttgggatatttttgaagtctgggaggggaggagagaagcaagtttagaattgcatatggagtgactgaatgagcaattctgaggctgaggaacagcacggtttagagagactatgacgtgggcagctcttttctggccaggccctgggaccctgcagactgagctccgatagccaggtcccagtcctggcttgaccaggctcctgagaagggtgggcaggccctcaacatctttgggcttactgtccccgtagggtggaagatggaaggtcacgttgctgacagttaagaacctgggcttggcatcagggcracctgggtctgagtcctgactttgctctttcctgtacttatgttcctgggcctggtrcttaacctcctagagccttgagatccttggctataaaatagatgcaaaaatacctccctcccagactcagtgagaccctgcctgtgggttgcttcacccagtgcctggctcatgtgggtacccagtacaccggagctgccacggagggactggctcatctctcagtcatggcaaggaaggagggcactctactaactaatggagaggcaggacattgctatggctggatgggacactcctcccaggcttgcaagtgtctgagaaggattgcaccccttactgagatgaatatgattaaagaaaaagcacctgaaaataagcagtgttcccatgggctcaggactggctaggtagtatttataggactcaatgtaaaaatgaaaatgtgggctctttattttaaaatgattaagaatttcaagatggggacagcagagcattgagcgtggggtgcttctaggctaagtgtgaggtccccaaagccagccctggagggagctgtctctggtgagaggcatcttgcccttctgatgtcctatttcagttcctgcttctgtggattgaattaatccccrtgtaaggccatctcattgttgatcttcctgctgtcttcctgtcccccagggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtgaacttccttagacttgagcgggagagagctggaggcggccaggccctgagcagatggcttggaacagccacacagagctgtgcccaggcctcctgggactgaagccatggccctggatcctctcttacattcccaaatgttgagatggggcacctagggtccctctctagaagccttgaatcctgtttcagcaccagggtttctagctgcccattctctattgtgttaaattcaggagactaaatgccatcattagagtaaaccacgaccttgtttttattacacttgaggccgtggtgctgcaagatgtgttgttttcctccaatgcttgaattcttggctccaagagaacattttatttagcctagcctcctaggccatctttttgttggggartcatttgttgcaggataatatcaaaagcacttggacagagaaatcgattagaactgccagtgaaaccaactctggctgtgtagtatgtgctggtgtgggaaaggacctagcctggggctgtggcaatcccgattcatggtgctttcaagtcagrttttcttggaattctgggtttgctggggtcttctgagtggggttgcctgtgctcccctagagggcagccatgaaatgggagcggtggtgcagatgggaggctgaattcttctgcatggtgttgagtggcaggtgcagattggaggctgcactcttcggcatggtgttgagtgtttgtgtgttgagtgtttcggctgcactattgattcccagtgacttctgatcagcctcaaagcctctgtctacccagtctttgatgggcatggtctggatgggctgttgcaggtcttcgatgcccgcagctgttccactgccygggaaatgtttgaacacatctgcagacacgtgcgttactccaccaacaatggcaacatcaggtyggtgcacrtttcccagggctgcagaggggcttgccttgcctgagaatcttagccaaaagatgcagcacttgggtctaggggaggcatctccagctccaggagaaaccagggagaaagaaaaaagagaaagactcaggcttcttcggggacttccagtagtgagcccagcccctgtgagctcagctcccatcggcaacccatgcccttggtttccttctgatgtggagccacttggaggggatggaggatctttaagaagtaactgcttcactattcagggttggggctcccattttttagaaggcatgggacattaagaggttaccttcctctcccaaccaacgaggtcaaagctaataggactgaacagctcatttggtcattcattcatctttttgttcagcaaacactcagtgcctacctaatgcaactcaacacaggacaaggctgggagagcagggggaagatggggtatgggggggtaggaggaagagtgactaggaccctaagatgctgctccagctggtgtgagcctatgacctgcactagacaggcaaccagctaactcaactgcaaggacggagacataggcagtgagggaaagactggcagatcagctaaccctgcctgatggatgggaaggcccccttgagggggtggaccctgggtcttgagggagggcagcaggagaaggcatgtcaggaggctggctcagtcagcttgggatcaggggctgcagagcaggtagggtggagagggaggtagggccagtgcaggatggctgggcccccaccagggctaggtggtaaacagtactgttcctgtcctgggaaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcaggtacccggcccagcctcagccrcyggccattggggcggggagccccrtggtgagcgagtgacagagtggagcccagaggagacacgcagcccgggcttacagactcacagggcccgtcttgttccccagctgtgcatcgacctgggctggaagcccaagtacggccgcttcgatgtggtccccctggtcctgcaggccaatggccgtgaccctgagctcttygaaatcccacctgaccttgtgcttgaggtggccatggaacatcccaagtaagtaggctgagggtgctgggggcaagggcgagtcaacacacagcccttctcctttcctaagtgcggctccagccttccccataccttccctaaagcccagccagcagcaggtgacactcagggggctggccttcaaggactcttttgtcactgttgcattctgcagccattctgcactggcacctcgggcctcagacaggtggatgtgttgatgctgaggggaagcagaggcttaggcggatggggccccaggagcttgagaagcagtgactgcaggagaggaatgcattgagattctagaaaggagcagcccaggcctcttctgccctcctgccaatgctcttagctgtccctctcctgtcgggatcatatagggctgcagtgacttcaaragtcctactggcccagcccctgctctaggcagttctcataattgcaaaaatacctctgcgtattgagatttactctgtagcagacattgggctgggctcttcttcctggccgttgaatgaaccaaattcagtcctgactcacagcctttgtaytccctgttccctttgcatgacatgccttttcctcagaatttttctaggctcatttcttcttgtcaaaaggtatttcctataatgtcacctcctctgagaaggctctctgaccactcaagctagaggaggcccccttaccctcagtctaacacatcatcttgtttttatttcttatatatttgtttacccatttataatctagagtctagacattagactacaagttccttgagggtggagatcttttcttttctgttcacaatgtatacccaacagctagcagagtgcctggcacatagtaggtgctcagttataaatatttgtggaataactgaatatacaagtgaatgatattactagctttataataattccatgaatttgatgctatgtttctattctgataatggggatgttgaggctcagagaggctaaaaaacatcccaagttcacactgctagtcagaggcagaacttgaaccccagctttctgacactggagtccttaattgctctgttgtgttgcattctcagcatttagcacagagcctggcacatacttgaagcttaayataggtttgcatgaatgaatgagtgcatgaatgcataatttaataaatggcatcctatgtgtccaatacgtctctctggctgggattaactcagaatcaactcttggaaaggagttttcttgtttgactctttctgaagcttttttcttggtgggcaggtggggggtcagtgggaggccaaaggtgcaaaagtgaagcccccagcgccagacaaggtagttcacacctgtaattccagcactttgggaggctgaggcaggaggattacttgaggccagtagttcgagaccagcctgggcaacatagtgagactctataaaataataataataataataataataataataataaggaaaaaaattagctgagcaagatggcacatgcctgcagtcctagctacttgggaggctgaggcaggaggatcgcttgggcccaggagttaaaggctgcagtgagttatgattgtgccactgcactgcactccagcatgagcaacagagcaagaccaagtcactaaaaaaaaaataataataaaataaaaataaggaaggccccagttaaattgtgtctacctttttgccagatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgaygtccagcgctacaacatcctggaggtaacccagccagcccagctggccagatgaaggtgtgggcctgggggtggcttcagggaccgactygccgctatcactctgcctctgtaggaagtgggcaggagaatgggcctggaaacgcacaagctggcctcgctctggaaagaccaggctgtcgttgagatcaacattgctgtgctccatagtttccaggtatgtctggagttttgtgagtctgaagactttttggtgagaagcttaactgatccagtgacttatgtgatgcttaatttataagtaagcccccttgctcactctagaggtccagcaacaggcagctcctcacctcccaagactgttcaatccctgtacttgagcactgaattctgtcctctctcaatcgctcaaggactttactcccaaaaattttcctcttctctctctgtatcatcaatgtctctctctctgctgagtcattcccagcagtgtacagacaggctctcttagccccatttcaaagaaagaaatgaatagctaaccacataactcctgccaaacctcaggctccctccagccactgcctcacccttctgctcctttctacagcaaaactatggagagatctcattgtgcttcctcatcccccaactgcttcagcctggctgggcgacagagcaagactccgctcaaaaaaaaaagaaggcctccctgaccgtgccatgtaaaatgacgccctcaccccactgccaacctgtctctctgtgttagtcctttaaccattttatttttcttcaaaatacttcctcatacagttcctggcattatataggacatcgactttcttctttcttttcctttttttttttttgagacatcatctcactcggtcacccaggctggaatgcagtggcatgatcactgcagccttgacctcctgggctcaagtgatcctcccaccttagcctgccgagtagctgggactacaggtgcataccacgcttgcctaatttttatatttttagtagagatggtgtttttccatgttgcccaggttggttccgaactcctggcctcaagtgatccgcttgcctcagcctcccaaagcrctgggattataggcataagccacggtgccgggccagctttctttattgtttggtttcctccactagaatgtaagctccatggggcagggaccttgtctgtctgtttgctgctgcacctctggcctagaagagtgtctggcacatggtagatgctaaaataatttgtctttgaagaatgaatgatgagggccacatccgcgatctggcctggcacaaactgggtcttcagtccttgtctgacgtgtgcatgaatgagtgatgctgggaggggacctatgagctgtggctgctcttgcttgctgtgcgaggatgacaacctccacctcctcttaagcccacacacagccgctgggctcctgtgtagggctaagccctcaggcccatccgctgctcttactcatagaaacacttcccttccctgtgggaaggaggcctgagatgtaggaagatactactttagaagccacagccattgccacaaagctgacagatgccctggagaccccaccactggtcagtcattcattcattcagcagtgttttactcagcatttgcctggtgctgggcactaggctgggccaaggatgtgagtggtgaacagagtacagatgagcacacactgttccccatgactgggtcaccccataggcagatcaggcctgtgcttgacgggggaggggaagatggaacaggaagagccccccggtgtttsgggaagggctggctttgcaccacacatcctgactcctggggactcccagcaccagccctgatgctggcaggatgtggatacgtcccagaaaatctgtgagcctytgctgtctcctcaccrtggctgactgtgtccttccactgcctgagcgtctccaggacttcctcaccaccctccttcagggtaaacttcaaaagatgggcccttgtttcctcctctgtaaaatggggataatagtgcctccctcatctgaggattataagagttaagtaaaaatgcatgcaaaatgtttagctgcactgcctggcccatagacaacactcagtaagcaatgattttcttactgtttattatgttgtcatcatgatcgtggctaccactgagtttttttttttttttttttcctttggagatgaactctccctccattgcctaggctggagtgcatggtgtgatctcggctcactgcaacctccgcctcctgggttcaagcaattctcctgcctcagcctcccaagtagctgggattacaggattgcaccaccatacccggctaatttttgtaattttagtagagatagggtttcaccatgttggccaggctggtctcaaactcctggcctcaagtgatccacctgtctctgcctcccaaagtgctgggattacaggtgtgagccactgcacccatcctgtagctaccactgagcttagaactgatctggctcccaggagttgctgtgtcttggaagaataagtgaatgagagcccacgtccacaagagtggtggccggacttttatatacacatatataacttatgtatgtctattgaatttacaaggcatggctggccttcccaggcctgacaccagctggatcctctcatgcctccctgccttgactcatgcagtgccccactcaactaacttgcacccctctcacaagtctcccttcctctcaggagctgctcccgaaattcgccaactcaccctgggcctctgtctggcgttgtatcctctcytctgcccttccccagcacctttgcctgcctccatcagagtttctatcaggccrtgtgaaaatgactgattttccttggcttccccacccagttagactagactctaatgcagagaaagggctgtgtctttcccttctataacgccgatgccttatgcagtgcctggcagatggagattataagagcagctaatatttattaagcacttactatgctttgcttattccagcttattgcatcctttcaacaacctcatgatgtaagaactttttttttggagacaaggtcttgttttgtcacccagactggagtgcagtggcccaatcatggctcactgcagccttgacctcctgggctcaagcaatgctcttaccacatcagcctcccacatatctgagaacactggcatgtgccaccaaacctggctaatttttaaatttttttgtttttgttttttttaagacagagtctcgctctgtcacccaggctggagtgcagtggtgcgatctcggctcactgcaacctccgcctcccgggttcaagcgattgtccttctttagccttctgagtagctgggattacaggtgtgtgcctccaccatgcctggctaattattatattttttagtagagacggggtttcaccatgttggtcaggctggtctcaaactcccgacctcaggtgatctccccgtctcgccctcccaaagtgctgggattataggtgtaagccccgacagctggcctactaatttttaaatttttatagagacagggtctcaccatgtttcctaggctgatttcaaactcctgggctcaagcagtcctcccacctcggcctcccaaagtgctaggattacaggcatgagccactgcacctggccattataggaattcatatcactcccatttcacagatgagaaaacttaaagaactaattgctcaaggtcacatggcaaataaaaagccagagtttgaaccactgtgttaaacaaatgtctcttgactgaatgggttgccacagacatagaggccagtggctgccttgctggaccattccatggggtcagaccccacagcccgtaatttcagactgtgagtgattcgtctcccatacactacagttctcccaatgcttcagacctccccacggaggggtctggctccttcttggctgaggaggctacaaccccatggaagtgactcttagaactctccaccataaatggctgggatggtatttcctttacctgccaaaaggtgctgtggtttaagttatgcagatccagagagagccatttgctgggagtctggggagacctgtgggcatgagaggctggatattgccctcaaagacttaagggaggcccccatgggacctgtgggctgaccctgactaatgtgctttcttgggctctgtcagaggctccacaagcgccttccatttgggtgtttattttcagcaggcaaggagagggccaggagttgctctcccgtgttacagattgccaggccttcccaggcactctctgggagccctgcggccaaccggcccctctcctgattcccccacccttatctccactccctatcttgccttctgatacagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggttaggggccttcctcttctctccttcctgggggctcagatgtggytgtatgtgtgtgtgtgtgtgtgcacctcattgttacacatgtagggcacgacgggaagcaggagtatgttgttagagctttccaggccccactcaaggatgctgagcagcctttgtgcatttccacggagagtggcactgaaggaagtggcttccactgcaccgctagtggcctgtggctcagatggggggtctgtcattacacctgcttccacgggagggcccggcaacagtcactcagcagagtgttgaggggattggcccctgagtcagacgctattgattctgccacttcctagcaatagggtcttgggtgggtcctttcacctttctgagccctgatcttctcatctctaaaagggatgggcttcactccacgacggggggttgtgtggatcacaaagctggtgtatggaacagctcagcccagtgcccaatgcagaatgcattcagtaaccatgagctattgagaagagttcattttgtgccaaaaaggacttgggttggattttaagagcttccttcatctaaaggaagagcttcctccatctacaggacctcacatgcagggtgacggcatgtcctggagtcttgcctgttgtagtagcagctcttcttgctctcaaaggtgtctcggttgggactgtacattatgtcatctgcctgctgataagatgctaaaagcaaaaggagtgcagcctgttccttccaggaggacactaatgagaataagggttagccgccccccctcgatgtgcaggctccatgccgggcagtggagaggcaactctgggggagaggcagccacggccctcccttgtgggagttcagtgacaggggtggggcgcaggccagccttctctcccaggctcatgatgggtgtgaagggtcctctaccactccagcatcygcgagcygagccaagccaggaccccgccctgccctcacatctcctttcttttctgaaggtagaggcctggaaaacccatgtctggcaggacgagaagcrgagacccaagagaagagagattccattgaaagtcttggtcaagtgagtggcagtggcagtggctagtagtgatgtgtgaactatmtctctcccttctagtcagcctctgcctccagtccttgaagggcaagaacacarggaatggttatgctttttgcttttgtttttgagacagggtcttactctgtcacccaggctggggtgtagtggtgccatcacagctcactgcagcctctgcttcccgagctcaagtgatcctcccacctgagcctcccaagtagctgggaccacaggtacaaacccacgcctgactaattttgtttgttttttttgtagagacggggtctcgcagtgttgcccaggttggtcttgaactcctgggctcaagcgatcttcctgctcagcctcccaaagtgctgggattacagatgtgagccacggcacccagcctgggaatgtatattcttcgtggaatttggctcccagaggtccagtcgccaattccaagggtcccctgctgccattgttccaaccttctctctcctcccttttcccaaaggggcctatagtagtgggtgaggggaggaaaagggtgagttgtcacggtacatggctggtgagaaacgtagcttgcttttccctcaacctgccccacattaaacgctgtcccctcccattcccctggtcccccattttcttctggaaggctgactcagcacacagcgcctgcctgtctgtctgtccccacagagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggtactggctyagtgggatggctgttgttttttctgcttgtgtgcaggggagtctaggaaaagttaaaacggtttccccactcctggatgtctcagagtcttggatgtggtaatgtgcatcattaatctggaagagaaggaaagacttgtgtgcagggattccmaaacttacacagtagatgagtttttcatggtgttctggagaacacagtttgagaaacactttcacaatgaatccaggcctcaacatacatcagctgctctggctgaactttattcaggctcactgaacacctgctctgcaggatgcagtgctgcatgtgaaagggggaagagatgagtaagcttcagataaacaaaaaaaggccgcagagggtctgtctaagctctatcccctgccttcagcactgatggataaaatccaactcttagggaatggtggccacgtgctggaccagccccgggctctgaggatctgacagtgggtggcgcagagccaggccttgcccttggggagctctccagcatacaccccaccctcccctcccagcgcyctgcaaagcaggcgtcaatgccattgttaatgcacagaggaggaacctgactgttagacaggttgatgggttttccagggtcgcacggcttctgggagatggatgtgactctgaggacagggcacaggccagtgtaatgccacgatgggatgagctgtggtctgtgccacgtagaggcttaggccaagggggcactgactgatgaccaggtcggccaggttgctgaaaacacctcttgggtccaagcctcacctgctggctcccaggagtctggaactgccaggagagtggtggcaggtcccccatcctccgctgggtgggcctggatagaacagcaagatgagggcacatttccccggccattccctccaggcacagctgtgacctgctcattccaattttgtggaaatatttccacacacacaaaattgcaaatagtagtggacatggtgagaggcatttagacatgggaaaggcagtatttttgggacagatcttccagggcttgccaatgtgttaaccatagggcttaagcggggaaggagaacagaggatgatgtgttcaaattggttcattcacgtcctctgtgccacgcctgtgccgggccctgggagagacagatgagcacaggagccgcagcctgggggcagtgtgggaggaagcccagggtgtctgcgcagggtagggagggccctactgggagccgagggctgatgtccacttgggtgccatccaggttgtctgcatggataagtacaggctgagctgcctggaggaggaacggctgctgttggtggtgaccagtacgtttggcaatggagactgccctggcaatggagaggtgggtggcttgaggtctggctggtctagggggtggtagggcacgggaggacccaggaaagggtctgggggatgcggcaggtcctacggaggacatttgggagtcagtgctcaggccactccgggtcactcaggtcatttgccggcctccattgtaattattgccatatgggagtgccacctttcctatgacatatttaatatatttctgtgaatggcctacctgtttgtatttacaaattcatatttaaaggaaacttgtatcactctcacaaatggaargcagcaaaacataaattcaatgaaaacaaaatgaagttaatgaattttagctagatactattccctggccaaggcctgctctttgtttgttttgtttgttttttggtttttggtgtgtgtttgtttatttatttatttatttacttaggtggagttttgcttttgttgcccagggtacagtgcaatggtgcgatctcagctcactgcaaactctgcctccctggttcaagtgattcttctgcctcagcctcccgagtagctgcgattacaggcacgcgccaccatgcctggccaattttgtattcttttttttaagtagagatggggtttctccatgttggtcaggctggtcttgaactcccaacctcaggtgatccgcccgcctcagcctcccaaagtgctgggattataggcgtgagccaccgtgctcagctatctttgtttttaaaaaagactaataggcaatgagagaggtattaaaggtctattagcaccaatatgagactgtctctccagtgctccgaagratgaaaatgtaattgaaggggaataactaaaaaataaattatgaaaagggagtaaatactcaccatgggatttgacgctagttctgctgggtcacatacctcctggaatcatcttggcttcctggaaagccagccttatttcagagactgtaggaccaattgttgttgcttctaccgggttccaaacagaatcacggcgcattcggagcccctctggagaaggcatgctaccaggcaggcccctctgccagggctggatgggtgggggcccagctgttccaggtcccccattaagaggcagggcctacacaagttgctacagtttagttggagtgagagacaagctaaacttgtcagctgacaaccaggtccttggccaggtagccccatatgtaaaccaacttccrtggtgggctgtgagccttctcctgcaagctgtggccaggtttccagaagaaaggaaaaaacagtgtttttattcatcctggcttgagaactctgtcattccctctctttctagaaactgaagaaatygctcttcatgctgaaagagctcaacaacaaattcaggtaaagctttttccgttgtcctactcctagccctgccctgtggacccaaagtctgggttcaggggatggaactgggtgtgcacagggkgtcttctcagaaccgtgcaggcacagagacctgggtctaaggtctgtactcagaatgtgtcgagggtcaaaccacagaaaccaagtccctctcacaggtctgcaggccaagcatggggtggtcatgggagttggtgacaaggctgggggatggagaggaccagaagggggtccagctccattctccagctggagggggagagtctggggctggctctccaggctgttggtgctgggtgctgggtgccaggtgctgcttgcatgggacatgtgtctctgtgtgtgtcctcgggcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggtcakttcccagccagagctgccccacagcagggacatgacagggtgcattcatgcctaggacatctgtgctgggcgtcccaggtggcatgacctctgcctgtggtcctgtagatgtggtcccaggcatgggccagggccacaaacctgagggcttaggtcactgctgctctccctcagccccctagaagagctccaccttgtgcacacaactctgggggagaaggtggcacagatacccccctgcccttagggagcttctagtttaaggtckttcctccagtgactacctaggtcacctcttaactactgtgtctgtttcagtctcacagccatagagagcctggggacaggcaccacacaatggcggatccactttggatccactcagtatctccatagctctttattgctgtgattgccccagtcatttagggaactygtcactcatgcagagcgtcactcagcggtggtgcttaggagcatcagcttgcatcggggcaggcttggttccaaagcccaggcctcctccatgtggctccacaccaggaacataagagcaatcagacctcttccagtgtgggcatgaggatacaacaagatcatgtcaatattggcattcatartggtcgggcacagtggagcatgcctgcaatccaagcactttaggaggctgaggtgggcagattgcttgagcccaggagcttgaaactagcctgagtaacatgtgaaacctgcctctaccgaaaatacagaaaattggctgggcttggttgtgcgtacctgtagtctcagctacaggtacgggactgaggcgggaggattgcttgagcccaggtggttggggcttcagtgagctatgatggcaccactgtactccagcctgggygactgagtgagaccctgtctcaaaacaaaaacaaagcaatatttataatagtagcaatagctactatgtgccaagcccagacacctctttgagtccttgctgtcaccctatcaggtaagtgtgcttcgaagttacacgaaacmcacggctcagtgtttggcccatggtaagggcytaaaaagkggtagccccagtggtggggatgctgctgctgctgaccattaaccgcagtctgctccaccttcttccaggcagcctgtgagacgtttsatgtccgaggcaaacagcacattcagatccccaagctctacacctccaatgtgacctgggacccgcaccactacaggctcgtgcaggactcacagcctttggacctcagcaaaggtacctgcttctctgyagcacatggggcttgtttgtgttggggtctgagccctaagcccatggtcaaggagamccccaggtctttctgaacagagacagctggcctcggggcctccctctcactgcatgcaagagcctgttagggcataatactcaaggtgctgagggaggctgtttcaggagggagccccaggagggtggtggagacagaagggatcagcatccgccaagggcctactgtgtgtcagacactgtgcggggctcctggcccacatgggctaagtgagcctggacactcctcctgggagaaaggcacagatggagaaattgcagttcaaggaggtgaagcaagctgctagcctgtggccatgttggggtctgagccccagccttccagctgcgaaggcagccaagtgtcgtagagaaggtgtcacagaggcgattccaggctktagtggtgaactctccactctgcacccccaggtgctgtgccctgtgccctgtctaagatagtcctgaaggtttctgcatatttaagatatccccaatgtcaacaatgctctcctgtggatcccaagccatggagatgtcccgggactttccatttttaggttcctaaattgaatttcccaacacctagaagcaacacttagaagctgccctgtatcagatcaaggagcttttttttttttttttttttttttgagacggagtctcggtctgtcgtccaggctggagtgcagtggcgcgattcccgcttactgcaacctccgtctcctggcttcaagtgattctcgtgtagctgggactattggcactaccaccatgcctggtttcagtatgttggccagtctggtctcaaactcctgacctccagtaatccacccaccgcggcctccaaaagtgctgggattacaggcatgagccaccatgcccggyctggaccaaggatctttatttgtggaataaaaggaagaaaaagaaaaacccaacggccacctcagcaggatgccccaagggtggtgttcagatgtcactgactcagacatctgggggcttcccctacctacgctcaagaaccactttgccatttcaccgtctctgtgtcctccacagccctcagcagcatgcatgccaagaacgtgttcaccatgaggctcaaatctcggcagaatctacaaagtccgacatccaggtaagggaaagtgcagggcttcgtgggtgatactctgtcgattttattttaacgaatgaaagatcagaagaagtcagtctttgaagggagaggagaagagcatatgctggcattagcagccacactgtcggtaggaccggcccacctggtaacctgcggccacctgtgcttttacgtctactcttggttaaccacgagccacktttccagcttggactctragcatctgctccacttcctctccttcctcattgaactctttcactaaaaggagagtgcaagagagacttaaactgtttgattcattcttaagaactttcaggaaaagtgttggcagggaaggaaatttcccagctctgggaaagagccttgtggattatctgcaggtttcattgatctgtgctgtcctccccgcatgcattaggaaaactggccttggttctaataagaacagggtttgtcctggcaacaaggaaaggtttcttctgatatccatgtatgtccaaggcggatgctttctttaggcagaggctgtagccaagccctcggggrgctccaagggctgctgggaaggggtgggcccccctcctccccagagggaagctcctggggccctcttaagcacccctgcctgtggggatgcctcatcccaagctcagggtggtggcctagcttgtggaaccagccaggaaaatgaaaggagggcacatttcctggggaatctcgcctgcccatcaaggagccctggaggaaatcctgcaatgtcacctgaggcttcattttccttccccagccgtgccaccatcctggtggaactctcctgtgaggatggccaaggcctgaactacctgccgggggagcaccttggggtttgcccaggcaaccagccggccctggtccaaggyatcctggagcgagtggtggatggccccacaccccaccagacagtgcgcctggaggccctggatgagagtggtgagycccgggctagaaagccagtgctgcctggcaccctctggccgccccacctggctgaggggctgagcctgggcctgccggtgacagccatccctgtccttcctgctgagagggygggccaccaaagcttatgtgaaagcagctgtggaaacagtcccagcccataaggcatggccccctggccttagtttccctaatgataacatccccctcaatgcagtggccaaagtcagaaagtgggatgagctgggtgtggtggctcacgcctgtaatctcagcactttgggaggccgtggygggtggatcacttgaggtcaggagtctgagacaatcctggccaacatggcaaaaccccgtctctactaaaaatacaaaaataattagacaggaatggtggtacatgcctgttatcccaatcccagccactcgggaggctgaggcacaagaatcgcttgaagccaggaggtggaggttgcagtgatatgagatctcgccactacactccagcctgggtgacagaaactccatctcaaaaaaataaaaaagaaagtgggatcagagaaacagagcctggcagtgacccccactgtccaggagaaagtgagagaacctgagacgtggggacgacaagacagttgcccttgtgactgtagggtgaaggatgtggttcatcaggactctgttccagaggagagaatgtcaggctcttatttttacccagtgtttacaaagcatctgtgtaccaggcacggcaccaactattatggcacaatttcattcagtgctcatgccaacccagcaagataggttgtgctatcagatctgtttcacagggagggaagccaaggcccagaggcttcagtcacctcagaagtggggagccagggtttgaacccgtgtcttctggcaccagggtctgtgctgtgactgccctgcatgctgctccctgggacttccctttgggctcatctgctcacccagcacatcttggtacagcacccaggggactgcagtcatgggcttctctctaagtgaacaactggcctgtgaggtatccattagtctttggtggatttagtcattgtgagtctgtagatcaccagtgagtgtcttgctaaagttcaggtctgggccagagaaggacgtggttagtttatcaggaccacgccaacttactgcccctttgggggctggtgatcagccttccctggcagtcctttctccatgcgccaccttcttcctgccttttgctcttagagccaggtctttagagcctcctttcccctgcagctggagaatagagggtgtctgcctgggggcctcgctacctactgagaatcctgaatggggcctcttttccatcctgacaccttccttccccatccaggcagctactgggtcagtgacaagaggctgcccccctgctcactcagccaggccctcacctacttcctggacatcaccacacccccacccagctgctgctccaaaagctggcccaggtggccacagaaragcctgagagacgaggctggaggccctgtgccaggtgaagatcagggctggtgggcagtgggggtatgtggggggtcccagcatgtggggagccagagtccagagctggttttaactttcaagagggatccacaccaggttcccaaagtgagacttgtcaaaggctggtgggaagccaggcatcgtccgctggcccatgtctaggacacagttgtgttgagtgaactgaatttttccaagtgtctgcaggatgcaaccagagtgcactgccttgaacattagctagraaggggagccgcccttatccgtctttgctttccccaaaactggaataaacttgtcacttaagatgtattgggggatggatgatgtggatgaatggataaatgggcataatgggcagagtgacagatggagagctgaattaataagttaatgagagaatgcgttaactcacctgcaactgtctggttccaagtctttgcaaaaggcactggttgtcattattatcatcatcattatagctaattatctcaatttaagctacctccaccgccattattttgtggctgcaatgtactaacttggcacatgctttctcatttaattcccataacatccccacaagacaggcaatactgtccttgtttcacaaagggtaattgggacaagattccacagctagtgaggacacccagccaagatttgaacccaggtctgattggttccaaagccttgccccaaataaattacaataaagatttgacccctgcccatgagttgccgacagtggaggtaacacaagttagataaatgtactggactgagttcctccaggacaggcacttattttgtctcaagtttggtcgtctcagcaccatggacagtgcctggcacatggacttgtttgttgagtgagtgaatgaatgaatgaatactgggttgtgacagtcttttccccaaagcrggacaggcgccctgagtcactgacatcacccttggcttttagccctcagagtacagcaagtggaagttcaccaacagccccacattcctggagytgctagaggagttcccgtccctgcgggtgtctgctggcttcctgctttcccagctccccattctgaagcccaggttctactccatcagctcctcccgggatcacacgcccacrgagatccacctgactgtggccgtggtcacctaccacacccgaggtgagccaggggcagaggctctggaacagccccgctccgcccattattggacatctgttcatcaactcagattcagctccctcatcagttcaaggagggagggaacacccacagcccagagttgttaacagtattaggaggtgtgtgggagasatctstaggaaccaggcactaaaccaagccttctgtatgtatatgatcagttacattgtggggtaggcactgtgtgcattttacaggtggcacagaaagtcacactgttagtaagtggagagctgagattcagacctggatagtctaactgctgagtccaagtcctccaccactccactgtcccactactcttgggacaatttaatgagatcagatgtgaagagcactcaacccttggtaggaggccagtggttcttagtsttcccaatcatgcagcctgaacgcaggggagattcygcattgattattcattcactcactcagctattcagtgggtgcctggcactggggtgggtrtggaaatacaacagagatcagccctgccctcagggagcatctagaggcrgcagtggagagataggcatagaaataattagatgattytcattgtgctgaagccaagaaggaaaggtcagggtcactgagggaagcagagcagggggtgacgctgccatagagcgggaggccaacatctcgtccaggtggtctcggctccaccactggccgctgccccctgccctgccctctgtaactgagcattgcctgggtkggcaaagctgggagctgcccayacttccgagccctctgtcctcaagaagcaaaaacacagtttctaaaaccttggcagagactctatttgccctgctagagaacagccacccagaccaggagaggagaggcagacgtgtcctgtgagatcaaagtttaatcccgaggaaaaccagggggacctctgcagttggttggaggccttcytcaagtgctgggccattgtaaagggaacacaacccagagagacctcctgggtttctacaagcccaggagggcccactgaggaggaaagcaaggtgccagagcaggctgaaatgcgcggagctcatccaccacccagggttgctaccagcaagggccacgctcatgagcacgcacagcagtagccaccctgaggggccacttcatgctgctgtcagtggagctcagtggtgagctgggagtgttcccggagaaagtctttggaaggagcactggagtaggagtcagggaagctgagctgtccacctgattccaccacgacctgagtgacctttttcaartcacttttcctctccccgtctcagtttctgcttgggcagaaggagcaacttgcagcctctctaagtccctttcaacgttcctcasctccgcgcttacagagggtggatctcagaaccaggagracaaacagctgctcattgagtcctgagagtgcctgagtgggggcgtccaaggaggccgtggtgtgggcggagcagctggtacagtttgcgcatgggcagtggggggacgttggtcactttgtggtatcgttgcagatggccagggtcccctgcaccacggcgtctgcagcacatggctcaacagcctgaagccccaagacccagtgccctgctttgtgcggaagtaagcaccccttccactctgtcccctgtggggccgccgacccctgggagttccgggaggaaagggagggatctggggtttaggagacgctcggagccccttggcccataaagaaggcactgrggtcacactggtgtggctgcctgtagcagggacagcgatgacaggtgggtctcaagagtccagtgagcwtggcccttttwcagaaggacctgggggaggtgctggtgcctggacagaagtgaagcagcctgcaggacgtgggaaatcaaataggagcttcttgtcctctccaccccctcacgaccgcctcccacaggcccagctccccagccatcctgtgtgtgcgtgggcctggggtgtctgaggactggccccctcttctcctgtcctcttcagygccagcggcttccacctccccgaggatccctcccatcctygcatcctcatcgggcctggcacaggcatcgcgcccttccgcagtttctggcagcaacggctccatgactcccagcacaagggtaaggctggaggcttcccaggtgggaggggcaccagggggccagcrcctgcctaggagcagaactgcagccccacaaacggttcctgacctctctcgagggaaggcctcccaagtttgcttccctgtgcgggcctctgcgggttagaatggctgcctttccgtctcccgcatagtagccagggctccctctcctgggagtggaggtaacaggaaagtccctgcttttgatctccgattggctgagggaattctgcatccgcactttcagttctgtgactatggatgagtgatctgaatgcgctgggcctcagtttcctcatctgtaaagtgrggataatgctattaaatagctagtgggagtgaagtgagaattccagttgggcttggagccctggcgccctctggtggccaacatggtaacaacagcccgggactcctgcaggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtaaatgcagcctcaaagcaggtgaagcattacacacacaagctccactgtgagccctgggtccccacaggcccctcgcctccccgagccttcacctcctgagctcgaaaatgctggtaattcacaaccatcagagtgatgctgtgaagagcattacaccctctcatacagcagaagcgacagacctggagaggttcaggactaacctaggtcacacgcgggttaaccccagagcccagcctgctgaaggtccccagcaggccccctgggacacgcgactgcccggggagaggtggtccaggctggctacgctcaagccttgcaaggctggagggcggccgatgcttccaccacggccatcagaggggctcttctgtccccagggccgcgttaccccctgagcctggggtgtcagaatagactctcrgccttcacacatttgtcccatcagggcacctcttgggcccagtgctctgtgcccagtgctggggccactgggcatcctgtgtggagcaggagcagagagtccctgactgactcctggaccttgtatctggggagcccgggatccataccctgcagagacctaatgggtagactgcattgagaggctcccttttctggggtgtaggcagagccctgggcagggggactgccttcattgatgcctttttgaagcatggcaaattcagagacagtctgggatccccactggatggtcagcccctcgagggcaggactgtgtccagcatttatctctctaatcccagccgagccccaggggcatccatgcacctcatcctgagcctggccccttgcaaggtcctggctggaaggggactcactcctcaccccttagtgcccctctccccgcctccttgaggccagcaggcctgcctgcaagccttgtcctgagcagctgaggactgaacccactgtttcctctggtttcaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaaggtatagtagtgggtgtgtgggctgaaggtgccggccaagggcacaggccgttggagccaggaccaggggtggcaggtagacccaggggaatcaggcccagaaaggttctggaccccaagagaatcttagcagtggctgagatctgagctgggtgggctgtcagatggccytactgcacatcctggaccagttggcagctttgagaagtcgggtgaatgtgttccatttttccatctgtagaatgggggcaggagagtctccctggcctctccccaaacccccctttcagaaagtatctgtgtggccaaagcaaggctgtgaacacaggggagagcaaggctgccccccgtcagcctcgtgtgaacctcacacttcttatttacacccaggctggtgtctgctcaccctcatccccccagcaggaagggcttgcattttattgatgaagataatagtgatatttatcaagggcttacactgggcatactgcttgccaaggattctcatgtgacatttcattcagtcctgccgaggactttatgagggaggcacccccttttacagagggaagggggcctacggggaccacagcagtaaatgtgagagcctagagttcagtctgcctctctctggttccaaagcctgtgattgtcacttccatactctccctaagacacattcatacgttcaactgaacatttattgagcacctactatgtgctagggatagagcagtaaatgaatcaggcaaaaattctttacattctactggggctgacaaacccagacaagaaagaggtgtagtgcttcagagaaaaacagcaggaaacagcccagggaacgctggggagtgtaattttaaatagggtggccagggaaggcagagctggaaggtggcatctgagaataaacctgagatgrtgaggaggagccctgtggatactgaaggaaacactctgggctgttctggaggggcagcaggtacaaaggccccgggggtgggagttaagctggcgtgtttgaagaacagtgaggagataacaggcatttccccaaatgtgttcagtgggtcggtagacagttggcatcaaaaagattccaaggtcgaatagcctgggacatgcttagttaaggcaaggcaaacacgttgctttactacaagacttctgggagccttcagtatgctgctgttcatcaggacccttcaaggctggaaggaaagaaaggacgtagcatttcccaaacatatttatctcagagctcacacttcctggagtatcttgggtgggggatgaacgctgggcaggaaatgggtatgctaagtaaagctttggagatggttagagggcccgcaccagagcaggtgctgagcagsgttagggtctaaaccagattcaagcacaatctaagtataacagttgggaagacagatggctcatgaaggtccatgtgatagggaagctgggcaaccccaggggctcatcccagcctggacttgacacgttgctctctgtttttacctaaaagagccagaagcgctatcacgaagatatctttggtgctgtatttccttacgaggcgaagaaggacagggtggcggtgcagcccagcagcctggagatgtcagcgctctgagggcctacaggaggggttaaagctgccggcacagaacttaaggatggagccagctctgcattatcygaggtcacagggcctggggagatggaggaaagtgatatcccccagcctcaaktcttatttcctcaacgttgctccccatcaagccctttacttgacctcctaacaagtagcaccctggattgatcggagcctcctctctcaaactggggcctccctggtcccttggagacraaatcttaaatgccaggcctggcaagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcacactgtatgcgtgtgtgggtgttttgtagggaaagctcttctcagagtggggagctggtgggtgtcacagcctggacagatccccgacagagggacaccccagccagtccatggctcctctgaaatggctgccaggtgtgccagcagcagatggagcttcgtgctggtccaaagacctgtggtagggcagggggcgcaggcctgcctcccacacaaagtatctgaaacggggtctggtgagggtgggattgtcgcataaggccagtgtttcgaggaaggccttgagcttcttcttggacactgtcttagaaagcgttttgctctggggccaccagtctcatgcgagactgtgccttggccagtacggatgtggtccctgggaaggcagcgtgtcgaggcgagtgtgggccacagcatcctcgcctgagggactggggaccctcttgggtttggagcaggccaaggaagccttcttaggagagtgggccccgtttccttctcctggtcagaaccaaaaaaggagctcagcggcggccactggggtcctggcaacacacggctcccagcttaggtttggcctctgcctcctgggtgccctggccgacttcacccccttgcccgccaccttccccttctagcagtagcatctcaggggcaggagaaggggcagtgccaacctcaggctccaggaaagctccatgccctgcgcgacagccgtgcatctcagcaacaaggccaggagtccgctcccggaccagggctttccagctttaatgtgcgcacctcgtctggggtcctgtgaaaacagagactctgacctcgcaggtcgggtggggcgcgggatgctgcgtttccaacaaactcccggatgcagctggtgccactgctctgaggactactatggggcctgaggaactggattcttactgggctgagcaggatgtgttggcatcacctggatgcagagtcgggcttcctggcagtggcccagtggctggcagaacccaacacatgaacactgagccacttttcctatgcaagccctaacccctaatgccggagagacccacaatggaacacacacccagacggtgcttcgggttggcttctcctgacccccctccccaagccacctcctcccactgggacgccaggtctgaggaggcagctctgaccctgctgtggccctcacaggctctgccccagcccctctcccatctcggaggcatggggctgtttcctggggtaccccattaccaccttcctgtgtccgagactcctgcccaaaaggctagagccccagcctgctttctccaacaccctcgtgggatttgtgagggaccctctgggaggaggtgtgaggtcaggaccccctgcccaaagggagtccatgctttcccatcccactcctctcagcagcaccgccgcccgattccacagactccaaaatgtctccaaatgaattaaagaagccacggtcaacccacatgaatgtgccaacaagcattttcatttctttattttaaggacactgggaaaggagccagtcccctgaagagaacactctggtcagttggtggaggccagtgggatgccatcaggctggctttccaggagggggtgaagggttgatgcagggtgcaaggtgagagttaggttaaaggtcagaggggagggactgaggacgtcacctcccaccaggagtggacagctggtggcttgagactggggtggagctgcgtgggggatgggaggggactgagcatggggcttcatcttcactgcccactccccacctctccccagctgtgcccctctcatcagacccccaagagttgttgatctgggtgttgtggaccacagcgttctcatcaaaacggggattgaggtggaaggcgatgtggttcccagagtgcgggttgatgtggaacctggggtgggcagcccacctggacctttgtccactgagttctgggccttatttcctccccgtcatccacagcctgcccaaagccaggggaatggctggaatcaccttgaagggctctctcttcccagaggtcaactggagcccttagcttacctctgagcactgggcaggacagtgcccaacaggatgatggacttggatgggtacagccctcccggaatgatggtgacaaaaggcgtcggctttcagaaggagaggcatgggtcagccagtggcagccagggcagcccaccacacaaaagggaagattgtaccaggtcccatgaatttgggctgtcagctaagaagaaaccaacgatatctgtacttggttccataaaagccaaaggaaaactttccagtgctcctcatattaatgggcttagattagtgtcatgaaaggaactttggccaaacacaaaaagactcatctcgtggggtgaaaagggagagccatgcaatgcgctcgtattgacacgacagttttaaggttgaaagctcctctccacagtcttctaattcgctgggaagctttgaagcccttcagcttaccattttgaaagcccttcgcttttcattttgcaaggctagtggatacccccgaagtggcccttcacccccagcctgcccaccacaaacagaacctccgccctccctgagaaaycacttacataggtggggtgggggtacatcataggtgggttggcgggagtctgctgaaaagaaaccaggaaattcaatgggagagcgcatgtgtgcgcgagcactcacccacgcgcacccatgcattctagaggggctccactgtgaggctgacctcatgagcctttggcccttggactcccccatccacctcccttttcatgttagccttcctggaacttcctgccgtgttcccggactccaccacggtcacctgtccctcaacccctctgcaggcagccccactaacgctaaacttccggcctgatttgcaccagcaggagaagagcttaagcctatgatcggtagtgacatcctggggacccaggatgcagggccaggaacctcacatccgggtgctggggccactgcactccccacttggtgacagacagaccagtttccctcccggtctctagggggcttgcctcttccaccactggataaatcctgcttcttccagaatctctgctgtcccaaggacagctttagccacatgtcacctgagccaagcactcagcccctagtgtccccatcctccttgctaaaccgctttcttcccaactctagcgctctagggaatttagttcttggtgaaggaggacactgtgcagctgtgaactgaccagaacttgtagacttacagagaacatctgtccaggggcgctctgcactgtgtggatgactgtctgggtctggaagaaagaaaccaggtctcacccaggctctcacgtgtgaaaaccaccagctcccaccagagggcgccacacggcaggcaccctccagggggcgtaacaagcccaatggccccacagaccccacagagggtgggcccaggtgtctcttctctcaaggggatgagcgaggggcaaaggttagaaccctggagaagacagatggggacgctggtggctctggcccatctttcctctcggggaaacgtctctcagcctagcctccctttgcaggtgacagaagtgaatgtggggcatggtcttccgtggctgcccacggggtggcaactcaggttgtttcatcacggccagccaaccacatccaacccccaacctcaccaggccgggcagatggtcaagggcctggcctgtgccctccccactcccaatgggagaggcccaatgcctggccctgcctcctccatgagcccagaaaagccaaaatgaggacgatccaaaaagaaagcaagagacttacaatgggagccgggttggcaggccacacgccgggaggctggaggggtgaggagagtcagaatggtggttatcgcgggcaccacagaatgggaggagatggtggcaaaactccagggaggctcttgtgctcagaaatgcctccccggacacacccacctccctcttgctcccaagcaagccttcctgagcccgtggcacccagatttttacccccaggtgcacagggctttggggttggggggtagggtatccccattggttcctcttgagagagaggaggctgggtttgatagagacctcattgctctctgtagctcccacagccaagagcattacttccagtgccatattttaccactaaggtgagaagtggtatttgttgaaggcctactgtgggctgattcctgggtttcagtgctttccaatgagggaagcagcctcagctcctgtgtccctggtgaggtaatgaggcttagaaagattaagcaacttgcccaagctcgcccaggtggaaggcatcaaatccaaagtggcagccagttctgtctgactgtatccagcacactttctatcctccccagggccagggccaaatttgggctgcgctgcaaatgttccctggggctcgaccagtcctgaagtcagcgtggcaggaggcaggtgccctgtctgtaccgtgatgagccgtaagaagactgcatagacaaagcgcccctcctcccagtccccactactggagtggccagaggaagggctgctcacctccttgtcctggatcctgccccacccagtagactgttcttgccctggctggtatcccattctccctggctgtgtgaaccacattccacattcattcactgagtgcaaatgaacaaggcacagtcccggccctctgaagcctcatgggcatagggagatgggggtggagtgacggggacagacaacgcaaacacagttacaatggggtgctttgaactggcatggcacagatacgtacagactccgtggggtcatgggggagcgtccaacaatattccaggcggggaggactcccagaggagcgacatttaggcagagcatggaagggcaattaggcgtgtgctgggggcaggctggcagaggatgcttccgggaccagggacagcatatgcaaaaacatggtggcccgagagggccttgagtgagctgcagaggctgcgtgagctttgtggtttgggggtgaggcagcgaggttgattggggtcagactgggaggaatttgtatgccctgctggggaatttgggctttatttgaagggctgggggctgtgaagatttttaagcagggagagggtgtgatcagatttgcttataagaagcacttataagaacttaagtgcttataagaaccactgtgacagtggttgggtgtggggggtggggaactggacccctgtcgtcatggtgaggaatcccggaggcctgggccatgtcggtggcttcgggcctcttggtgccttggagagacgtaaagaagggggaatgaagaattcagggagacccccaggtccccagctctgggtgcccggcagacagacagggaactcttgagtgggcaagatggggcctgtaggccctgagtggcctgctggctggggccagcctctcagaccctcggtccttcctactgtctgctcggccacccagggcctctgtgttgaactcactttttgtctgcrccccctgggcctgggtgggaaacagacagactgggagaatggcaccgtggagaaggcaggctgaacagggactgtgcrggggttctgttaaaacaaaaggcaccgggcagtgaggagaagcattaatagagccaaggagaagccgaaaggcagaggcaagggcaagagggagagaccaggcaggcagggggatgaggcaagggggttagggccatgccaagatgggatgggaaagagccaggctctggtgagcagtgcaggggtgcggtctccctccagctcttccctccccattcacccacaggggagggagtcagggaaagagggaccaaagtcagagatgaggaccaaagggcgagaagcccagatttgctgagggcctactgtgtgcttcgct

SEQ ID NO: 17735 - DNA, 27509 bp, Homo sapiens
ccagcactttgggaggccgaggcaggtggaacacgaggtcaggagattgagaccatcctggctaacacggtgaaaccccgtctctactaaaaaatacaaaaaattagccgggcgcggtggtgggtgcctgtagtcccagctactcaggaggctgaagcaggagaatggcaggaaccggggaggcagaggttgtagtgagctgagatcgcgccattgcactccagcctgggcgacagagcgagaatccgtctcgaaaaaaaaaaaaaaatacacacacacacacaaaaactgtgttaatgcttaactacacaaaaatgataatcagataaatatgcatttatttagagaactgcatgttggtcagtccagtccctgcagagggaattcccagcatgacctcattcacttgtgaagacagagcaatccttgtgttttatttttttaagatggatctcactctgttgcccagactggagtgcagtggcatgatctcagccctctgccacctccaccttccgggttcaagagattctcatgcctcagcctcctgagtagctgagattacaggcttgtgcctccatgcccagctaatttttttatttttactagagatgaggtttcaccagtttgggcaggccggtctcaaactcctgacctcaagtgatccacccacctcggcctcccgaagtgctgggatgacaggtgcctggtcagcaactgttgtttagacatacacattttatctgctcgtccagcatggtcagccctccactttttaaattttattttatttatttttttgagacagagtctcactctgttgtccaggttggagtccagtggcgtgatttcggctcactgcaacctctacttcccaggttcgagcaattctcctgcctcagcttcccgagtagctgggattacaggcccgcgtccccacacctagctaatttttgtatttttagtagagacagggtttcaccatgttggccaggctggtctcgaactcctgacctcaggtgattctcctgccttggcctcccaaagtgctgagattacaggtgtgagccactgcacacggccttaaattttatttattatttatttatttatttatttagagacttagtctcactctgttgcccaggctggagtgcagtggcatggtctcggctcactgcactccacctcctgggttcacgccattctcctgcctcagcctcccgagtagctgggactacaggcgcccaccaccactcccggctaatttttgtatttttagtagagatggggtttcactgtgttagccaggatagtctcgatctcctgacctcgtgatccgcctgcctcggcctcccaaagtgctgggattacttattttgttttttgtagagacaggttctcactgtgttgcccaggctggtcttgaactcctgatctcaagtgatcttcccacctcagtctctcaaagggctgggattacaggggtgagccactgcaccccaccttccctctactttttgacggtttccttctgctatgaatgtgcatgtccagttgtctgcttcttagaactgatatttaccttcctcatccatcagccattggaggaggactgggaccgctcagattattgatctgacccattctttcggcagggtttcctggtggctgtcttccatcaccaaaactggaatcagaagagtttccatagccctttttttttccccacatctttgctgaagcagagttttgaaaaacaaaaccacaaactaagctattccccagaagaaatctgtaatcaaagataagctctgccgggcacagtggctcacgccttttggaggccaaggcgggcggatcacctgaggtcaggagttctagacctgccaggccaacatggtaaaacctcatctctactaaaaatacaaaaattagctagatgtggtggtgggtacctgtagtctcagctacctgggaggctgaggcaagagaatcgcttgaacctgggaagtagaggttgcagtgagccgagattgcaccactgcactccagcctgggcgacggagtgagacgacctcacaaaaatttacataaataaaataaaaagtaaaataaaaatacaaaagttggccgggtgcgtttgctcacgcctgtaatcccagcactttgggagggtgaggcaggcagataatgaggtaagaagatcgagaccatcctggctaacacggtgaaaccctgtctctactaaaaatacaaaaaattagctgtgcgtggtgacacgcacctgtagtcccagctatttgggaggctgaggcaggagaatcacttgaacctgggaggtggaggttgcagtgagccgagatcgcaccactgcactccagcctgggccacagagtgagactccatcttgaaaaaaaaaaaaaatacaaaagttagccaggggtgttggtgggtgcctgtaatcccagctatttgggaggctaaggcagaagaatttcttgaacctaggaaacggaggttgcagtgagccgagatcacacctctgtactccagcctggacaacagagcgagactttgtctcaaaaaaaaaaaaaaaaaaaaaaactaaataggccgggagcagtggctcatgcctataatcccagccctttgggaggccaaggcaggtggatcacttgaggtcaggagtttgagaccaggctggccaacatggtgtaaccccgtctctactaaaaacacaaaaattagccgggtctggtggcgtatgtctgtaatcccagctactcgggaggctgaggcaggagaatcacttaaacctgggaggcaggggttgcagtgagctgagatcgtgccactgcactctagccagggtgacagagtgaaactctgtctcaaaaaattaaaaaagaaattcagcaagtaatgagttaaggaattcgaatattaaggcgagtgacaaggaacgcccaggatgtggcccaggatggagtaggggggacactcatttaggagaaagctcaggccacaagacaggaggagccagccttgttggggttgaagggaagagcattccaggctgagggaactgcaaggcgtttgcatgggacactatgggatggcttctgcccttggtgggcagcctctggtctgaggccattctttggcctgcctgactgtctggcaaccgggaggaagccctgcccttcctggagacagaaacaaaggtctaggaaatatctgcttcccttttccttgaaaaacgcttaagggaacggaggactgggaggtgccgtctctctctgccagcctgccccctaccatagccatcccactcccatctcagaaagtgacccgccatcctccaaaaggctcggaccctgatcaaggagtcatcccccttgtcccagcacctccagttggcccagcctccaaaacggatgtcaaattcagccctttctccaaggacactgcccagtccaggccccactatcattcatctggactagaacagtcacctcctctcccatctcctggctgcagctcttgaagcctcaactgggcccctgtgaacacttgagttagggcaaggtccttcctctgctcagaaccctctatacctcccacctcgctgggcataaaagccaaagtcctggccaggcacggtggctcacatctgttatcccagcactttgggaggccaaggggggcggatcactagaggtcaggagttagagaccaacatggtgaaaccccatctctactaaaaatacaaaaattagctaggcgtggtgacgcacccctgtagtaccagctactcggtaggctgaggtgggagaatcgcttgaacctgggaggcagagtttgcagtgagccgagatcacaccactgtgctccagcctgggtgacagaacgagactggggttcagaaacaaacaaacaaaacaacaaagtcctcctcaggtgacaggaacttgcacctatctgccctgtcatctccctgcccgctcctctcctcgaatctctcctttgctaagcctgctccagccacactgttctcctggctgttcctttttttttttttttttttttttttttgagtctcactctcacccaggctggagtgcagtgcctctatcttggctcactgcaacctccgcctgccgggttcaagagattctcctgcatcagcctcccaagtaggtggaattacaggtgtgcaccaccacacccggctaatttttgtattttgcatagagatgggggtctccctatgttgcccaggctggtcttgaactcctgggctcaagtgatcctcccatctcggcctcccaaaatgctgggattacaggtgggagccgcgcccaggtggatttttgtctgactctgttcattcctgtgtccccagtacctggaaggacgccaagcacacagtaggcgcttaaaaaacattgagccacatgttgagaaaagaacggcaccattgtggctgcaagtgggacttgggccgcgcgggggagctcgcgcacctcgggccggggcaagagctcagtggaacccgcccgaggaagaacccgtggcgcaggattttcccaggccttctgaggaccaggggcgtcccccgtcccaccctgtgactttgctcaggccgttccggggcgggaattcagaactcctcagccccccaagaaaaaaatatccccgtggaaattccttgggaatgaccgaggcgggggaaatatgcgtctctggatggccagtgactcgcagcccccttccccgataggaagggcctgcgcgtccggggacccttcgcttccccttctgctgcgcgacctccctggcccctcggagatctccatggcgacgccgcgcgcgccccacaacaggaaagccttaggcggcgcggcttggtgctcggagacttaagagtacccagcctcgacgtggtggatgtcgagtcttggggtcacacgcacaggcggtggccaagcaaacacccgctcatatttagtgcatgagcctgggttcgagttgccggagcctcgcgcgtagggcaggggttcgagcgccccttctccctgcctcgcctctgcgcctgggggctgctgcctcagtttcccagcgacaggcagggatttcgagcgtccccctcccctccctcgtcaagatccaagctagctgcctcagtttccccgcggagcctgggacgccagcggaggggctcggcgcgtagggatcacgcagcttccttcctttttctgggagctgtaaagacgcctccgcggccaaggccgaaaggggaagcgaggaggccgccggggtgagtgccctcgggtgtagagagaggacgccgatttccccggacgtggtgagaccgcgcttcgtcactcccacggttagcggtcgccgggaggtgcctggctctgctctggccgcttctcgagaaatgcccgtgtcagctaggtgtggacgtgacctagggggaggggcatccctcagtggagggagcccggggaggattcctgggcccccacccaggcagggggctcatccactcgattaaagaggcctgcgtaagctggagagggaggacttgagttcggaccccctcgcagcctggagtctcagtttaccgctttgtgaaatggacacaataacagtctccactctccggggaagttggcagtatttaaaagtacttaataaaccgcttagcgcggtgtagaccgtgattcaagcttagcctggccgggaaacgggaggcgtggaggccgggagcagcccccggggtcatcgccctgccaccgccgcccgattgctttagcttggaaattccggagctgaagcggccagcgagggaggatgaccctctcggcccsggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcmgcctmgctatggctcccagcagcccccggcccgcgctgcccgcactcctggtcctgctcggggctctgttcccaggtgagtcggggtggggattgccgtcgggccagttctccgaagccccgggaggaccggctcccgggtcaggtcatgcatgcttaggtagctgtttatgggaaggaggggctagagacagcgattgaaaggcaacagccagtaggttcgaatccagaccctgcatacctccacgtgtggccttgggctatagattgcagctttaaaaaagggtagggggttggagatggaggggaggggcgggcctcgttttgttgcccaggccggtcttgaactccgggggtctagccttacctcctgcctcagcctcccgagtagctgggatgagaggtgtgaaccaccgccttgcttggctagattgcgtctcttacagtttctcagctgtaaaacgggaaacgttatagcggccacctggcagggtatcttggcccagcgcagcacctggccccaggactcgatcatgatggtttgggaacttggctctgtgccaacccaacaaggcttaagggacccccacccccctcaagatgtatattctgttcctcatcctctctgcccctggggaagtccagggctgcttctacttgggggaattccagagctgacttatccgtggcccaaagctgagaagtgggacgccccagcacaccctcccccagctccagcccagctagggaagagggaaggggtcagagggtctttcatggtggtgtaagtttggggaaccaggagggtgggagattgacagcttggttaacagctcaacaaagcctgagatccaggccagcacggtagttcatgccagtaatcccaacactttaggagccccaggcgggcgaatcacttaaggtcaggagtttgagaccagcctggccaacatggcaacatcccgtctctactaaaaatacaaaaattagctggcatggtggtgggcgcctgtgatcccagctgctcgggaggctgagggaggaaaatcccttaagcccacgaggctgaggttgcagtgaaccaagattgtgccactgcactccagcctgggagacatagcgagattctgtctcaaaaaacaaagcrttctgatccggactcagacccagatcgcactgctttctagctgagtaaccatttctctctatgaaatgggaatggtcccagaatctcccttggagaatgtatggagccagtgtcctcacacccccatccaagatagaacaaatctgagacaggaatctttgagtgaggcagtgctgggctcagacattttttcccaccttcggaggcagcagaatctgagggacctgatccaaataagccccttctttctttcttttcttttcttttttttttttttttttttttgagacggagtctcactctgtcgcccaggctggagtgcagtggcgtgatctcggctcactgcaacctctgcctcccaggttcaaacgattctcctgcctcagcctccctgagtagctgggactacaggcatgtgccatcacacccggctaatcactgtgttagccaggatggtctcgatttcctgacctcatgatctgcccaccctgcctcccaaagtgctgggattacatgcgtgagccacagtgcccaccccgtaagccccttctttcttacctgcaaggtagccagttgctacccatcctgtgctgagttacttgtattagcaagggatggggtggctatactcacccaccttacagatggggaaattgaggcccaaagagggggaaactacgtgtctcagggagtgaggagccagtctgattcctggagggctgactgtctccacctgacttcttaggagggaggagggcaccaacttcacattaaaatctggttggacacagtggctcacacctgtaatcctggcattttgggaggcttaggcgggaggatcacttgaggccaggagtttgagaccagccttagcaacatagtgagaccccatctctacaaaaatgtttttcagggccaggcgcggtggctcacacctataatcccagcactttgggaggctgaggcgggcggattacctgaggtcaggagtttgagaccagcctgaccaacatggagaaaccccgtctctactaaaagtacaaaattacccgggcgtggtggcgcatgcctgtaatcccagctactcgggaggctgaggcaggagaatcgcttgaacctgggaggcggaggttgcggtgaactgagatcgtgccattgcactccagcctgggcaacaagagctaaactccgtctcaaaaaaaaaaaaatgtttttcaaatattagccgggtatggtggtgtcctgtagtcccagctacttgggaggctgagatgggaggatcacttgagcccaggagttcaaggttacagtgagctatgattgtgccactgtattccagcctgggtaacagagggagacccgtttaaaaaaaaaaaagtgatggctaaagtccttccatggctccctattgccctcagtataaagaacacatgtggctgggcgtggtggttcacgcctgtaatcccagcactttgggaggctgaggcgggcggatcacttgaggccaggagtttgagagcaggctggccgacgtggcgaaaccccgtctctattaaaaatacaaaaattagctgggcgtggtggtgcttgcctgtaatcccagatactctggaggctgaggcaggagaatmacttgaacccgggaggcaraggttgcagtgagctgagattgcgccactgcactccagtctgagtgacaaagcgagactccatctcaaaaaaaaaaaaaataaaagaacacatctttagcatggccttcagtgctcacgggatcttcctgaattaatctccccctcttcatccttgctcactcagctccagccaccctgccccgggacatctgtacttgcctggaacttatttcccttttctccggacagccagccctttctcgtcatttagatctctgctgaaacattaccctgtcaccaaagcactgtctattctatcaccctgttttgtttttgtcaaagctcatattaacatcagttattaattatcttgtttgctcataatttttttttttttttttttggagacagagtctcgttctgttgctcaggctggagtgcagtggcacaatcttggctcactgtaacctccacctcccaggttcaagtgattcttgtgcctcagcctcccaaatagctaggactacaggcacgtcccaccatgcccagctaatttttgtatttttagtggagacggggctttgtcatgttggccaggctgatctcaaattcctgacctcaagtgatctgcccgccttggcctcccaaagtgctgggattacaggcgtgagccaccacacccggcctgctcatgaattttctctttaacttccacatcgaaggcaaagtattgtcttgttaaggctgtgcctccagcacccagcacaggctgggcgcacattcccttgatgaacctgatttgtaatgcctgtcgcctcttccctcgtttcttctaggacctggcaatgcccagacatctgtgtccccctcaaaagtcatcctgccccggggaggctccgtgctggtgacatgcagcacctcctgtgaccagcccawgttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactgtgagtaactgagcccggagggctggactaggcagaccsggtgggagagacgtgcaggggcacctgcagaggcctgggggaatctttgccacttgctcgtagggtcaaggaggggctccttgcagggcaggtggggacatccttggaaagtccctttgtgaatttctttgggtacaattaaagtatttacaggctgggtgcggtggctcatgcctgtaatcccagcactttgagaggctgaggctggcggatcacctgagatcaggagtttaagtttcgccaacatggcgaaaccctgtctctgctgaaaatacaaaaatcagccgggcatggtgtcaagcgcctgtaatcccagctacttggaaggctgaggcaggagaacgcttgaacctgagaggcagagattgcagtgagccgcgatcgtgccagtgcactccagtctggataacagagcaagattccatctcaagaaaaaaaaaatgccatctctctatgcctcactctttgaacatatgacacggtcctgcttcagacactttaataaaagatgcaaattaagccaagtgtggtggcttgtacctataatcccaactactccagaggctgaggcagaaggatggtttgagcccaggagtttgagaccagcctgggcaacagagtgagaccctgtttctttcttttttttttttttttttttgagacggagtctcactctgtcgcccaggctggagtgcagtggtgtgatctcggctcactgcaagctccgcctcccgggttcacgccattctcctgcctcagcctcccgagtagctgggactacaggcgcctgccaccatgcccggctcatttttttgtatttttagtagagacggggtttcactgtgttagccaggatggtctcaatctcctgacctagtggtccgcccgcctcggcctcccaaagtgctgggattacaggtgtaagccactgtgcccatccaagaccctgtttctaccggaaaaaaaaagtaaataatttagctgggcatcgtggtgtgcacctgtaatcccagctgctcctgaggctgtgatgggaggattgctttaacccaggggttcgaatcctaggagttcgaatccatcctaggcaacatagcaaaaccccatttttatttaaaaaaaaaaaaaaagatatgagttaaaactagccctgggatggcatttttcacatattggtaacaaacaaaagaattgatggccgggcgcagtggctcacgcctgtaatcccagcactttgggaggccgaggcgggcggatcacaaggtcaggagatcgagaccatcctggctaacatggtgaaaccccgtctctactaaaactacaaaaaattagccgggcatggtggcaggcgcctgtggtcccagctactcaggaggctgaggcaggagaatggcatgaacccgggaggcagagcttgcagtgagccaagatcgtgccactgcactccagcctgggcgacagagcaagactccatctcaaaaaaaaaaaaaaaaaaaagaattgataacagctgtgctgccaaggctattggaacgtaggaggtcctaggacagtgctgttgggagcataaataagcccaaccctgtggcgggaaattgggcatcagttctcaaaatgtcatgggctgggcacggtggctcacgcctgtaatcccagcactttgggaggctgagggaggcggatcacttgaggtcaggagttcgagaccagcctgaccaccatggagaaaccccgtctctattaaaaatacaaaaaaaactagccaggcatagtggcacatacctgtaatcccagctactcgggaggctgaggcaggagaatctcttgaaactgggaggcagaggttgcggtgagctgagattgcgccactgcactccagcttgggcaacaagagcaaaactccatctcaaaaaaaaaaaaaaaagaaataaaagaaggtatgttgaatatgagtggtatgccaccctcacattagggaagggcagtttcggggaggctgtatttatgtataaaatagccctaaaaggaagtgggagaaatgacaatattagctggctatgagaagagaggctgggaggctgtgggagagggcttgggtgtggagaattctttttgttttttcctttttttgagacagagtttcactcttgttgcccaggctggagtgcaatggcacgatctcagctcaccgcaaccttcacctcctgagtttaagtgattctccggcctcagcctcccgactagctgggattacaggcatgggccactacgcctggcaaattttgtatttttagtagagacagggtttctccatgttggtcaggctggtcttgaactctgacctcaggtgatccgcccgcctcggcctcccaaagtgctgggattacaacgtgagccactttgcctggctgagaattctttttttgttgttgtctttttgagatggagttttgctgtgtccccagcctggagtgcaatggtgtaatctcagctcactgcaacctctccctcccgggttcaagcaattctcctgcctcagcctcccaagtagctggaattacaggcgcccagcaccacgccyggctaatttttgtatttttagtagagacgggatttcatcatgttggccaggctggtcttgatctcctgaccttgtgatctgcccgcctcggcctcccaaagtgctgggattacaggcgtgagccactgcccccagccgagaatttctctttgcgtccttcctactttggggacttcgaatggtgggaaagagttatcaaggccaaaataaggaattcaaatgaaaacaaaacaaaatcaaagaagaaaaaacagaagagcactgggcaggctaggcacgtggctcatgcctataatcccagtgatttagaaggccgaagtagaaggatcgcttggaggccaggagttggacaccagcctgggcaacatagcaagaccccatatctacaaaaaataaaaaacctaaccaagcgtgctggcatactagtagtcccagctactcaggaggctgaggtgggaggatcacctgagcctgggaggtccaggctgtagtgagccgtgatgacaccactgcactccagcctgggtgacagagaaagaccctgtctctaaaaaataaaaactggccaagtagctttgggattagccttgggttccagtcccagcaaggcctttaatagcttgggacatgacttctgcatttactttgcaatcaggtgagacctcctctgatggggaaaatgacacggtgagtgacaaaggatgttctcctatcattgtgtcagggcaaggaagcctctgggtaaatgatcaaatgatcagctttgcttctgatttggagggtgggtgagcagatgctgaccttcccaggtgagggaagtccccgaacattcccagcagcttctggaaaccccagggaaacctctttgaaggtcttttctgcatctctgcctgataggtctttttttttttttttttttttttytttttttgacacacagtcttgctctgtcgcccaggctggatcactgcaacctccatctcccgggttcaagcagttctcctgcctcatcctctccagtagctgggattacaggcacctggcaccacgcctggctaatttttgtatttttagtagagacagggtttcgccaagttggccaggctggtctcgaactctagacctctggtgatccacccgcctcagcctcccgaagtgctgggattacaggcttgagccaccacgcgcggctctgcctgatagctgagagcatagaactccaggtttgagacctggctctgccacatttctccctctatgactgtgggtgccccactttgccttagtttttacctctgtgaaatggagcagatggctggcacaggtagcaaaggagtaaaagttatgtgggagggtggtacctgagagagactctagcttggtcttgccccacccctggtgtaaacataaagaagcctccctggatggctcaatcttctccaaaaaggttagaggtgtaattcctagaggaggcgaccactagctgggctttgaaggatgtgtaggagttcataaggacaggcattctgggcaggaggaacagcctgggcaaaagttgggagcagggagaaatcttgatggaggcaggaggaggaggaggtaggttggtgtrggccaggygcagtggctcacacctgtaatcccagtgctttgggaggccaaagcaagaggattgtttgagcccaggagttcgagaccagcctgggcaacatagcgagaccctgtctctaagaaaaaataaaaaaattagggtacagtggcatatgcttgtattctcaactactctggaggctcaagtgggaggatcayttgaacccaggaatttttttgtttttgtttttgtttttttgagatggagtctcactctgtggcccaggctggagtgcagtggtgccatcttggctcactgcagcctcctccacctcctgggttcaaccgattctgctgcctgagcctcccgagttgctgggattaaggtgcccaccatcatgcccagctaatttttttgtatttttagtagagatagggtttaccatgttagccaggctggtcttgaacgcctgaccgcaagagatcctcctgcctcagtttcccaaagtgctgggattataggtgtgagccactgagcctggtcaagcccaggaatttgaggttacagtcagctatgattgcaccactgcattccagcccaggtgacagagagagacactgcccctaaaaaaaaaaaaaaattgattgatgggaggaagggtgaggttggcagagccttgaatgccaggtggaggagctgggactttccttcttggggtgatagggagtcatggagggtttstgagcaggccagggattagatagctgaaggctggatttactggaagccaatgagcagttggctatggtccttgtccacgcggcccatgttgtgggcagtgaccgtattcaagaagggaaggacagacaagtatttgaatacttcagtgaccaggatttggtaaaggactgcaggtcagggtcaagaagaggtgagagcaggacagacttcctccccgctgcaccaggcagctgagctgggtttcctctaggggctgaggtttgagggtacctcaagttctgcaagagtctataggaggtggtaagagagaagagctggaggtcagagttttcttgactatatatatatatatttttttgtttttgtttttaacagcttaacagctttctgttttatttttagagacagggtctcagggtctcactttgtcacccaggctggagtgcagtggtacaatcgtagctgactgcagcctcaaactcccaggctcaagaaatcctcctcccacccttagcctcctgagtagcagggactacaggtgtgagccagcaggaagcccagctggttttttttttttctttggtgttttttgtttgtttgtttgagaccggagtttcgctcttattgcccaggctgaagtgcaatggcaggatcttagctcaccacaacctccgacccccaggatcaagctattctcttgcctcagccacctgagtagctgggattacaggcatgcgacaccacacaaggctaattttgtatttttagtaaagacagggtttctccatgttggtcaggctggtctcgaactcccaacctcagatgatccacctgcctcggcctcccaaagtgctgagattacaggcatgagccaccgtgcccggcctttttttttttttttttttttgagacagagtctcactctgtcgcccaggcaggagtgcagtggtkcgatctgggctcactgcaagctccgcctcccgggttcactccatcctcctgccttagcctcctgagtagctgggactacaggcgcccaccaccacgcctggctaattttttgtatttttagtagagacggggtttcaccgtgttagccaggatggtctygatctcctgacctcgtgatccgcccgccttggcctcccaaagtgctgggattacaggcgtgagccaccatgtctggcctggccaggctggtcttgaactcctgacttccggtgatccatctgttctggcctcccaaagtgctgggattacaggcataagccaccacgccatgccgaagcccagcttgtttttaatttttttttttttttttggagaaatgaggtcttgcaatgttgcccaagctagccttgaactcctggcctcaaatgaccccgccttggcatcccaaagtactgggattacagatgtgagccaccatgccccagccttgctttcttgagatacgatttagaataccataagattcatcccttttaagcacataattcaatgacttctgtacaaacaaccatgactacaatctaattttaaaatatttcaatcactctaaamaagaaacctcctgcttatgtacagcgactctgtctacctcttaagtgaattctcctacctttaatagccctattttacagttcaggaaactgaggttcagagagacaaagtcacttacccacagcaaagaagcaaggctgggtatcaaatgcaggacccccccggtcctgatgcttttttttttttttttttttcctctgagagagactctcactctgtcactcagtctagagtacagtggcgcgatctcagttcactgcaatctctgcctcctgggctgaagtaatcctttcctcacaagtaaacctcagcctctcaagtagctgggactacaggcacacaacaccacgcctggctaatttttgtatttttaggtagagacggggtttcactatrttggccaggctggtcttsaactcctgacctcaggtgatccgcctgcctcggccccccaaagtgttgggattacaggcgtgagccaccacacgcagcctttttgttattagactctgtcattactgactttttttttttttttaatagaaacagggtctttctttcccaggstaaagtacagtggcatgatcacagttcactatagccttaaactcctgggctcaagtgatcctcctgcctcagcctcccaagtagcagggactacaggtgtgcaccaccacacccagttaaccattcattcattcattcattcatttattttgagatggagtctcgctctgtcacctaggctggagtgcagtggcacgatctcagctcactgcaacctccacctcccaggttcaagagattctcctgcctcagcctcccgagtagctgagactacaggcgtgcaccaccatgccagactaatttttgtatttttaatagagacggggtttcactctgttggtcaggcttatctcgaactcctgacttcgtggatccaccctccttggcctcccaaagtgctgggattaaaggcgtgagccaccgcgccctgccaacctttttttratttttcttagagatgggggtctccctatgttgcccaggcttgtcttgaactcctggcctcaagtgaccctcttgccttggcctcacaaagtgctaggattacagcctgagccatcacacctggccaacaggtttttttttttgttttgttttgttttttaaagaatgtctaggccaggctcatttactttcacctgtaatcccagcactttgggaggccggggtgggcagatcacttgaggtcaggaattcgagaccagcctgggcaacatgctgaaaccccgtttctactaaaaatacaaaaattagctgggtgtggtgacacgtgcctgtaatcccagctactcaggaggttgaggcaggagaattgcttgaacccaggaggcagaggttgcagtgagccaagatcatgccatcaccctccagcctgggcgacagaaggagactcagtctaaaaacttaattaattaattaattaaaaataaaaatacaaaaattaacctggtgtggtggtgtgtgcctgtaatctaagctactcaggaggctgaggcaggagaatcccctgaatcccagaggcagaggttgcagtgagccaagatcgagccactgtttgcccagtctagtgcactgggctgctgaatttatttgaccagacacctagcaatagactttgaagttcttttccacttttcactctaagatgctgctgtcatgaataaggaatattttgatccccttcacaaacactcggggccctcttaccagttttcactgaagatcttgacattcctatctgcttaggtgtctgggcgtgtttgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaasgagctgaaacgggagccagctgtgggggagcccgctgaggtcacgaccacggtgctggtgaggagagatcaccatggagccaatttctcgtgccgcactgaactggacctgcgsscccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggacmgtggtctgttccctggacrgkctgttcccagtctcggaggcccaggtccacctggcactgggggaccagaggttgaaccccacagtcacctatggcaacgactccttctcggccaaggcctcagtcagtgtgaccgcagaggaygagggcacccagcggctgacgtgtgcagtaatactggggaaccagagccaggagacactgcagacagtgaccatctacagtaagaaggggcaggggcggagtggggcttcttgrgggtgtgacctgaacccggggcggggctcactgtgtgcctattccaggctttccggcgcccaacrtgattctgacgaagccagaggtctcagaagggaccgaggtgacagtgaagtgtgaggcccaccctagagccaaggtgacgctgaatggggttccagcccagccactgggccygagggcccagctcctgctgaaggccaccccagaggacaacgggcgcagcttctcctgctctgcaaccctggaggtggccggccagcttatacacaagaaycagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcrtgtttttccagatggcccccractggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcraggtgaccgtgaatgtgctctgtgagtgagccggcgggcagarctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccrggacagggcctcttcctcggccttcccatattggtggcagtggtgccacactgaacagagtggaagacatatgccatgcagctacacctacyggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggycccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctratcacattcaaggtcaccaggtacagttgtacaggttgtacactgcaggagagtgcctggcaaaaagatcaratggggctgggacttctcattggccaacctgcctttccccagaaggagtgatttttctaycggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcktgtgtgtgtgtgtgtatgtgtagacaagctctckctctgtcacccaggctggagtgcagtggtgcaatcatggttcactgcagtcttgaccttttgrgctcaagtgatcctcccacctcagcctcctgagtagctgggaccataggctcacaacaccacacctggcaaatttgattttttttttttttyyagagayggggtctygcaacattgcccagacttcctttgtgttagttaataaagctttctcaactgcctcagccttgtgtgagttgaggggaggtgtcacatccagctggagtcctttctaagcagccacagcctgatcctcccacttcctcccccaagaaaacattgtgggttgatggccataccctgaggttctggtccaaatcggactttctatgaccttctgggtctctagtgaaaactaaagactcctctccagaaaaaaacatttggtttctaatgaggcctggaatcttattcttgacctggggagcggaatccctttttgcagtactcccgggccctctgttggggcctccccttcctctccagggtggagtcgaggaggcggggctgcgggcctccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgttgttgttgttgtttttgcgatcactttctccaagttccttgtctccctgagggcacctgaggtttcctcactcagggcccacctggggtcccgaagccccagactctgtgtatccccagcgggtgtcacagaaacctctccttctgctggccttatcgagtgggatcagcgcgggccggggagagccacgggcaggggcggggtggggttcatggtatggctttcctgattggcgccgccgccaccacgcggcagctctgattggatgttaagtttcctatcccagccccaccttcagaccctgtgctttcctggaggccaaacaactgtggagcgagaactcatctccaaaataacttaccacgctggagtgagaccacgaatggtggggaggggagggtcccacggacatattgagggacgtggatacgcagaagaggtatccatgtggtggcagccgggaaggggtgatcagatggtccacagggaatatcacaaactcgaattctgacgatgttctggtagtcacccagccagatgagcgcatggagttggsggtggggggtgtcaaagcttggggcccggaagcggagtcaaaagcatcaccctcggtcccttgttctcgcgtggatgtcagggcccccacccaccgagcagaaggcggactcaggggcgctccagggtggctcgagctcacacacgctgagtagacacgtgcccgctgcmccctgggtaaatacagacccggagccgagcggattctaatttagacgcccgcgaacgctgcgcgcacgcacacgtgtcctcggctcgctggcactttcgtcccgccccctccgtcgcgtgccggagctgacccggaggggtgcttagaggtatggctccgcggggtcaaaaggagaaggatcagtgagagaggcatccccacaccctcccctagaactgtcctttccccatccagtgcctcccaaatctctcttagtccccaaatgtatccccgccctaaggggcgctggtgggaggagctaaatgtgggggcggrgctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgyctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagccccgctctggttcggggtggacagggcgggggcggagtccctggacctgagaaacggcctcctgtccctcccagctctgccctcgcctcgctcccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctgtgctgtgcaccatggtccacggactggcatcttccccactcgcggtccgcgaagactccatctctccaactaccctgactcagaggcgctgttcccgctccacccagarccctggcaaccgggtccctcagctgttcccgcggttccttccatgagcccagccttgcgtcccggckccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatggctctctgctaccacgtcccagagacaccctcgaggtttagactctgggagtgcgcctttaaaccggaggcctgggcacgacgcgggacgcctgggttctttccctggctgcagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctyggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggcgttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggatgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctgrtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtgkcccgagggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggctt

SEQ ID NO: 17736 - DNA, 23866 bp, Homo sapiens
gtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccaygccaagatcatggctgacaacccatcttgggatggcgagaagaccattatcatcacatgcaggtgggcctgggctccttgggaggaagtatggtggggcagggattgcaggccagggcccagaacagtggcctragctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatcgccctttgcacttggggcctggctggcttggaggtggcgcaggctgcatgaggcaggagccctgttaacattggctgtttccttctccccgaaggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccrtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggagttcaggggctggtttgttttttttttcccccccaaactcaaattctggatttaggtctaacaggaggctggactggagcggttcacagcaagatgctgggctcggctgtgaaggggggagtatgaggcccccttcctattcagggctttggggtagatagcccctggactcagtggagacctgaggcagggctgggctttcacactccgctgccttgaccacatttgctgctttttccacaaaactacttggaagctctcgcctcctttccacagttttgggagcagttgccctttcccgggtctaggaactctgtggcttgtgctgagcggctgcggtgtccagcccagccctttaagctttctgtgtcagtcctggtcaggaaaacaagcacacaggcaggcagtttgtgtacagccgggcggaggccagagaccggctgcctacctgtcacctctcgcctggagcgggccactgccaagttggccccatgactccaaacgggcggagcctggattgggcctgtggggagggctccactcaagtgaccacttgcagccctgaacctcagctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcggtgagtcatggccctcccttcgccacccacggggycggcagggccgaagcctgagacccgggtctccccagctgcaggtgtcgrcgcagccggcggagcaggagctgcggcggctgcgggaggagaacgagcgcctccgcagggagctgcgcgcggggccacagggtaagcgcagccccggccagggcagggcgggtgacgacctgctcgggtcctcccctccctcccgcgggccgcgcgccgccgccgctaagaacgccccttcctcagaggagcgcgcgctgctgcggcagctcaaggaggtcacggaccgacagcgggacgaactccgggcgcacaaccgcgacctgcggcagcgcggccaggagaccgaggcggtgagggcggggcggggctctggggcggggcgggggcggagcgtggcaggcgctgggcggggctccgggggcgggggcggagcgaggcaggcgctgggcggggctccggggggccctcggtgccccgcccaccccaccctttgctccgctcccagttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggtgagtgccgtatgagggcaaggacccagcccaggacgcagcgtccagccctcggtgggcactcaagcaaggtttgcatgctgcacagcaggtcggccaggaagcggggaggtggcagacagatctgcgcccccggccggcctcggcccccgctctcagctggagcactgctctgttatctgttagggcacccttgtcccccaagtctcccggcccgtcacttcctctagcattcccatgatggccctggggcgggggaacgccagccgaggcgaccctctgactgtgcctgtccttccaaaggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcggtgaggacgctgggaagccggggggcctccgatcaccccacctcattctccagtcattgacatgtccacagtgacatgtgccaggcctgcgctgggaactgggaggacatgaattgtacagcccttgccctcctgcaatgtcatccagacaggggagagggacagtacaaagggttgcagctgcagcagccagggaatctctcctaggagggggccacggggccacctaatttaaggtctgagggtgtcagcaaggcagagcgcttcccgtgttcagggaagagctgcgtgcacaggtaccaggagtgaggactgcggctggcatctccactgctggcatccccatggctggcatcaccagggctttctccctccctgccccttttctttagggagctgctcacagaccaccrggtcccyrgccttctgctcgaggccatgaaggtggctgtccggaagcagcggaagaagatcaaggccaagatgttagggacaccagaggaagcagagagcaggtaggtccctgcctgcattcccacggagccaggcctccctccctcattctgctgagcctgatgacccagcctggtcaccctctgagcccattgtctcagactgaggctgtcaccccaacccggtcaccccttgagcctccctagcctggccgcttctagggcctgctgacctgctctggctgtgtcccatggccgctgtccagcctgcgcccttctccctggatctcaccactccccttgccttgcctgccatccattctgcctgacaacactgcctctccacattcattcttcaagttcctgtcttggctgggtctgtttattcttacgggggtgaaactgtagccgcggctgtgtcagggcctgctgtgtgtcaagctataaaataaacccttggcagggcgcggtggctcacgcctgtaatcccagcactttgagaggctaaggtgggtagatcacctgaggtcaggagttcgagaccagcgtggccaacatggtgaaactccgtctctactaaaaatacaaaaattagccgggcatggtggcatgtgcctataatcccagctactcaggaggctgcggcaggagaatcgcttgaacttgggaggcggaggttgcagtgagctgagatcgcaccactgcactccagcctgggcgacagagtgagaccctgtctcaaaaaaaaaaaaattaaaaattaaaggctcgacatcctgcatctccccagggttgccttctctccagccccgggggccctgcagtccctccatcccccctgctggattcctgttgtccctcagggccttgatcaatggccctcacttctcctctctcctctgtctcagtgaggatgaggctggcccatggatcctgctctccgatgacaagggagaccatcccccayccccggagtccaaaatacagagtttgtatgttggggaaaggggaaaggcaagagtgtggggagggaggaagggccctggctggtccttctcaggatcccctttcccgcttctctgcccatcaccctgctgtgcttggctctaagcacaccgtcccctcctgcttctctggccctggcccccatcaccttcacactccctcaggctgccctttcttccccctctccccttttctcaccatcccctgccctcacccatatccttgacctctctggcttcctggctcaaagtgcctctggctgtctctctccagctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtaccgagcctctggggccagatataagagtgcctctctgagtctcagtttccccatccatgaaatgagagctgactgcctagctcccagggctttgtgcagacggcctgagctcatgtaataaagaactgcccgtaatacacagaaactgttcctcgcctgtctgtccatgtctgtgccacctcccaaccctgccaggagcagaggcaggctgaggggtcctcgctggtctccttgctcagtcactgggtggggtggcttcttgcagctcaggccttgctttgggagtgtggcctgatggaaagccgtggctcccagcctcagtccacccccttccctggccccggcacccagggacctgcaacttcattcttctggcccttccaggcccaggccagtcagccctgccattgcctttctttccctttctttttttgagtgtcagtctttccagccaccccctccctctcagggaggtgcctcgtggcagcccgcccctcyggcctggtttcctcaggaaaagccctgagaggaagcagkgagggggttgggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcaggtgggtctcgtgggagtctgatgcgtgtggccagcaggtgggtctcgtgggagtctgatgcgggtggctgaaccggtgttgaggccgttaggggaaggaggagactaggaagggggcttaggctgaaaggaagggactgctgatggcggtctggcaggtagtggccagccagggcagatggtggaagggtcagggaaggagaggggaggggctggggaccctagctgtaaagatccattaggcctccccagggggctaaggcagcctcccccactgcagccagagacagtgatccaccttcctcagggccaggctgcaccccccaccatgtccggctgacccctttttgccccacagcccctctgctgagctgcagtgctgcgcaggctggaggcagaaggatcaagaatgcaccatccgtgagtagccaggacagaccctcagccaaggagaagggaggccgtagcccagtgacaacccttccttcctaccccatggggcctgcccctcctgawaccaggagtcagggtttctcctgtgacgcacycccaggcctgaaggggcacctcttgaggaggcatggcccctggagccagtgagagggcaggggtgtcccctggtcctgctcccgtctttccaacctgggtggggtgtctttcagccatctgtgaggggccggacgcctgccagaaagacgaggtgtgtgtgaagccgggcctctgtcgatgcaagcctggattctttggggcccactgcagctcccgtgagtctcaagggccagatgaagttgctgggcagagctgggtacgggggcagtggtgtgggagcaggcgaggcaggtagccatgcagcctcaggacagcagggccagaatcccccccagcttcactgaggaattgcggtccagagacaggaagtgacacacactcccgggagatgacctgagtcaccgggtttttacccacatccacaaagcactgcccacctgagcatcttcctcttccacttctcagaaaacctgtgattccccttcattgtaaaatgagtgtattacttgcctttcccacatataccttatacatgggcagtggatggaagggggcccctggctgggctctctgccctctctggcagaaagagagggaagggaaaggggttgggaagcaggagagccagagggtgggcatcaggaatcaaggaatcactaggggaaaggtggcttctcccgacaccctggcgggcagtatccaggcctgagatcaggagaaagccagctctcctccagcccagcagagatccatctcggcagggaggagcaggcatggaggaaggcccaccaacctcggtgccacgctctgggcaagtcccctgcccactcaggatctctgagtgtgttctggaatgtgaagtggcaggctgagcctcccactaatggctaagggttttctgtaggtcagagcggagcaggaagtgagtgttgcccaggacaggctgccggatgttctgagggtctgtccccggctcttggaggatgggcccagcgccccttttccttgaggaaggggacgcagggtaagggtctgcgcgcggccctgagcccgctgacccctcccgtccccacccccgcaggctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacaggtgagcgggcggggcggggacaggtgggctggcggggcgggggcggacacaagtgagcaggcggggcggggcggagacaggggggcggggcggagacagggggcggggcgaagacaggtgggcggggcggacaccggtgggcggggcggacaccggtgggcggggcgggcaccggtgggcggggcggacaccggtgggcggggaggggggccggggtggaaactggtgagcgggcagggtgggggcggggcgggcacaggtgagcggtcgggggagggggcggaggcggacacaggtgagcgaggctgcgcggagacctgtgagcgggcggggcggagcggagacaggtggccgcggcggggcgccgggaggaggggtcagggcttcgcggtgctcctctcaaaaaacatacaaagcagaggaacgagaaaggggaaaagtcggataggtggggtggctcacacctgtaatcccagcactttgggaggctgaggcgggtgcatcacctgaggtcaggagttcgagaccatcctggccaacatgctgaaacctcgtctctactaaaaacacaaaaattagccgggctgcgcctgtagtcccaggtattcggtaggctgagacaggagaatcgcttgagccctggaggcggaggttgcagtgagccgaggtcgcaccactgcactccagcctgggccagagagcaagactccgtctcaaacaaaacaaaacaaaaacttttaaaaacgctttgttgccccaggtccagcctcacctgctcatttcattgattactgctgtgcaaaatatactagcactgctagcaagccatatgtaggtaataagtggatcgagtccaacaatgatagactgggttaagaaaatgtggcacatatacaccatggaatactatgcagccataaaaaatgatgagttcatgtcctttgtagggacatggaagaaattggaaatcatcattctcagtaaactatcgcgagaacaaaaaaccaaacaccgcatattctcactcataggtgggagttgaacaatggaatcacatggacacaggaaggggaatatcacactctggggactgttgtggggtggggggaggggggagggatagcattggcagatatacttaatgctagatgacgagctagtgggtgcagcacaccaacatggcacatgtatacgtatgtaactaacctgcacaatgtgcacatgtaccctaaaacttaaagtataataataaaaaaatatatataaatatatttaaaaaaagaaaattaaaaaaatggtttcttacaaaaaaaataataaataagtggatcgagtgaccaagggtcctgagcaaggtccctttagggctcagtggctttcaaactttgactggctgcactcacagtaagaaatttcatccctggctgggcgcggtggctcacgcctgtaatcccagcactttgagaggccgaggcgggcggatcacctgaggtcaggagttcgagaccagcctggctaacatggtgaaacctcgtctctactaaaaatacaaaaattagccgggcatggtgttgggcgcctgtaatcccagctacttgggaggctgaggcaggagaatcacttgaacccgggaggcggaggttgcagtgagccaagatcgcgccactgcacgccagcctgggcgacagagtgagactcagtcttgaagaaaataataataaaataaaataagaaataaaaatgctggtcaggatcagctaaatggcttttataaactgcccttcttctcccctactaatgggtctgacccaagtatatgatcccagctagttaagcatctgagggagaaacttcaggtaactattaggcatcaatgggaaattaagatatggcaaatgtgaaattatattggtgacaacagtggtctccaaccttttggcaccagggactggtttcatggcagacaatttttctattattacactgtaatctataatgaaataataatatgactcaccataatatagaatcagtgggagccctgagcttgctttcccgcagctcgagggtcccatctgggggtgatgggagacagtgacagatcatcaggcattagatcctcgtaaagagcatggaacctggaccctcccgtgcgcagttcacaataggactggcgctcctatgagaatctgaggccaccactgatctggctggcagcggagctcaggcggtcaggctcccctgctggtcatctctacgctgtcgcccagttcctaacatgccacggactagtaccagtccatggcccagggtttgaggacccctgggtgaaaacactttacattttttgcatttcgtgtgatggggtagaagacactactgagtcccattcatgccagacctggggacggctcagtgtggaaaaaggaaaagtgaaaagagcaggagggaaggcctggcagacctcgcaaatgggactcagagcttggtggtgactcgcctgccctggctgggctgctggctcctgatggtcctgggacccagggaaagacggtcacagagcagatgcctggaaggaaagggatgggatcctgtaagagccctcatttgtcctcattgtacaacgtggggaaactgaggctcaaacctgcctgacccaggtgggacccgaacactctccagggcccccgaaggcctgcgtggagtacaggggtaggagggggtgggcgctccatccatccacccccactgttcccacgaagcccttctcttcccagctgtggccgctgcaaacacaatgagccgtgctctccagacacaggcagctgtgagtcctgcgagccgggctggaacgggacccagtgccagcagccctgcctgcctggcacctttggcragagctgcgaacagcagtgccctcactgccgacatggggaggcctgtgagccagatactggccactgtcagcgctgtgaccctggctggctggggcccaggtgagggcaccattctgttcagggtggggtacaccttcccccaggaccctcagctcagcggctctctccgagagcaccaccctccccgacacacaggttcatgcggccccaggggcctccctcctgttgaagactgggggagagcagtgggttctgggggggcctgggcaggatcccagctccctcccctctgaggcttcctgccctcctcgccctctggggacttgtagtctgtcacctgctggatttggccccaagttcaaggccctatttgcacctgagcttcactgctgaggagtggccagttgggtccttgagtccaggagcgtggggcggaggggtggggccccacagtgggggccaggcctgccttggtctccccttccccgagtcttgcctcaccccaggtgtgaagacccctgccccactggtacctttggggaagactgtggctctacctgccccacctgtgttcaggggtcctgtgatactgtgacaggggactgtgtctgcagtgccggctactgggggcccaggtaaggatggggatcccgggggcrggagagtgccaggggcctaggtcagggctctgtgcagcatttcctgaacttccctggacagtgcccagaaatctccctgcccgtctcctgcctgcctcccccacttcacccagccctcagcctgcctctccatgtcactccatagctgcaacgcctcctgcccagccggtttccatggaaacaactgctcagttccttgtgaatgcccagagggactctgccaccctgtctctgggtcctgccagccaggtaaggtggaagaaggctgcggggtgcagtagccagggaaaggcgggcccttcacatgggctccagggcaagttcctcaccagggagtctgggcccacttcagagatattcttttttttttttttttttcccttaagacgaggtcttgctctgtcacccaggccagagtgcagtggtgtgatgtcagctcactgcaacctccacctcccaggttcaagccattctcccatctcagcctctcgagtagctgggattacaggcgcacgcctccatgcctggctaatttttatattttagtagagacagggtttcaccatgttggccaggctggtctcaagctcctgacctcaggtgatctgcccacctcggcctcccaaagtgctgggattacagacgtgagccactgtgcccggcccagagacattctttatacctgagctctgtgtggatgctctggggccccctgaagatgtgacagagcccccgcccctgcgaaaccaggctagagccgtgaaatgggcagcggggtggctggacactgacatggcctcaggggcaagaacctgtggaggggacacgccagcagaggggctgcccggaggcagggagtgacccccaggaagaagcttctgggtagcaggcaactcagagcaaagacaggatgtgtaggagacaggaaggcctgaatatcccccgtttctggctcccccaggctctggcagtcgggacactgccctcatcgygggcagccttgtgcctctgctgctgctcttcctgggycttgcctgctgtgcctgctgctgctgggccccccgatcagacctcaaggacaggtgaacgccagcccgtcccttccccacacagctcaggccacagggtgggagcaggggggcatctggtttccttgtggggtggggagggctggccttgttgcccacgtgggtcagaggtgatgggggtggggagggctggccttgtcgcccccgtgggtcagaggtgatgggggtggggagggctggccttgtcgcccacgtaggtcagaggtgatggaggtagttggcagtgcccgtggcctggagacactggagacaccgggtcagctgcctgccctcctcggaagccttcaatgaggaagtttctgagttgcatgggcaccaggctggcgaaccggagcctgcagcgggaggcagaaagctgacaccggcggggaccagaggaggagggctgggaccacggaaggagcagcccggctctgggccaggagggaaagagaccaggcctcagatggcccacgaaggaaagagacatcaatgtctgtgcagtggtttagcagagagtgtagctgcctgagagacggagaggggaggaagggttgggctggtggggcccgcgcagggggcttacgcagagctttgttcctttatgaaacctcgtcacattccaggctcctttgagactcacagcagcgtggaggtttggaacagggagtgtggggccgggaggataaatgtcctcaattcccagaggacattgaggcccaaggtgatctagttggtactggcacacaggaagcccctctccacctttttggactctttgtctggtgctctcttactagttcctgccctagtccaatagcacatcctcctctgtgcttgtgcggcattcacagaggagcagatacagttgcccctggcccagggcatagagcccagggtgggaagaagcccctcgcagggacacgaggacaggtgcaaaggctgttggaggaacagtgaagagcagagcagtctcctccacatgtgggggtagagcagagtgggaacaagggaaggcttcctggagggggtgtcatttgagacaggtgsgccgggcgcagtgactcacgcctgtaatcccagcactttgggaggccraggtgagtggatcacctgaggtcaggagttcaagaccagcctggccaacatggtgaaaccccgtctctactaaaaatacaaaattagccgggtgtggtggtgcacgcctgtaatcccagctactcaggaggctgaggcaggagaatcacttgaatccaggaggcgaaggttgcggtgagccaagatcgtaccactgcactccagcctgggcaacaaaagcgagactctgtcccaaaaatagagagagagagagagagagaaacgtgagctgaggctcagctaggatgataataacaaagacctgccaggtcctgcaaaaagctcagatagatgatagatagatggdtagatagatagatagatagatagatagatagatagatagatagataggatctgttttacagatgcggaaactgaggcctagggaggtgaagtgtgaaccagagttgttactcrgctgtctgactctagagccactctttgttctgtggcaggcctgaattgtgggctcaatcatttggattttattctgtagtcaatagagagccactgaagccactgaagtagaggcagtcaccctgtcacaccctgccaaggtgacccaggtcaccgtgggtctcatgtaytgaccartgtccctaccctcctccctcaggccagcgagagatggagctaccgtgtccaggatgaagctgcaggtctgggggacactgaccagcttgggctccacgctgccctgccgttccctcagctcccacaagctaccctgggtgacaggtcagtgggcgctgggggccggggtctgggattggacagggctttgcatcaggtyctgcaggcgcytgatctggagtctctacagtctcacatcacgacccggaggtccccttcaaccacagcttcatygagccgccctctgccggctgggccactgatgactccttctcatccgatcctgagtctggagaggcagatgaggttcctrcctactgtgtgccaccccaagaaggtagccccccaacagcccacatagcccctgagcagccctgcccaccacgaccccctctttagtcctccagcaaagttatttatttttatttttttttgagactgggtcttgctctgtcgccaggctggagtgcagtggtgcgatctcagctcactgcaacctctgcctcccgggttcaagtgattcccctgcctcagcctcccaaatagctgggattacaggcgtgcaccaccacacacggctaatttttatattttagtagagaccgggtttcaccgtgttagccaggatcgtgatccacccgcctcagcctcccagagtgctgggattacaggcatgagccactgcgccyggccagcaaacagttattaagggcccattttgtgttagtcactgttcttggctccgggcatgcaagagataacaagacagattcctatcctcaccaggcttagagtcagaygggcagtcatcagacaatgacaggacacagtgatatgtgtttccatgggggacatacaagtagggactcatttgctagccatgttggggtgactggggtcagggacgatgtgtgtggcatcccagtcgagtctagcagaatcagtaggagttggccaagtgaaagtcagggagaggagggaatggtgtttcaggaagatggaacagcatacacaaaggcccagaggtgagagggatgtggctgtgtgccatygaaagagttttagcttggtaagagtgtgacagtatttcaaagtagggagaggtggtgagaaaagagtatagagaccaggtgtggtgactcacacctgtgatcccagcactttgggaggctgaggcgggaggactgcttgaggccaggggtttgataccagcctggccaacatagtgagaccccatctctacaattaaaaaaaaaaaaaaaagagtgtagaagtaacagtgtctacctgaattggtccttctgccactctcctcatccttgccctcttccttgccctatttttgaggcctcctggaagatgctgagctgtgggtaggatgcattggggtggccagttcagctccagccaagctcttctgtctcctctgccagggatggtccctgtggcccaggcagggtcgtcagaggccagcctggctgcaggtgctttccygccccctgaggacgcctccacgccattcgccatcccgcgcacctccagcctagctcgggccaagcggccatcggtctccttcgcrgaaggtaccaagtttgcaccacagagtcgccgaagctcaggggagctctccmgcccgctccgaaagcccaagargctctcccggggggcgcagtcgrgtcctgagggccgggaagccgaagagtccacaggcccagasgaagcagaagcccccgagtcctttccggcggctgccagtcccggggattcagccactggccaccggyggcccccacttggtrgccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctgkctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaargcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaawttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgtataaagtaaaacggagatttcctttctccccagaggcgtctgtgggtcaagagagaggtagaatctacttttccctggcagctttttggtcttgtttgaattctttgctcacatattacctagtcagaaaagaaaaggggcaaccctccccccgagctttatttttttttttttaagatggagtctcagtctgtcacccaggccggagtgcagtggtatgatctcggctcactgccacctctgtctccccggttcaagcgattctcctgcctcagcctcctgagtggctgggattacaagcgcccgccaccatgcccggctaatttttgtattttttggtggagacagggtttcaccatgttggccaggctggtcttgaactcccaaactcaagggctccacagcttcggcctcccagagtgttgggattataggcatgagccaccgcgcccggccaggggcagccccttctatctcagtgctcagagagtctcatcaacagttgaggtgctttctttcagatgtttttctgtgtacatgtcaacaaatattttaaacaaaaaattttagcatactaagcatactgttcctcagcttctttttttttttttttttttctttttgagacgaagttttgctctgttgcccaggctggagtgcagtggtgcaatctcagctcactgcaacctctgcctcccgggttcaagcgattctcctgcctcagcctcctgagtagctgcaattacaggtgtgtgccaccacacccagctaatttttgtattagtagagatggggtttcaccatgttggccaggctgttctcgaactcctgacccgcctcggtctcccgaagtgctgggattacaagcgtgagccaccgcggccagcctcaacttgcttttttacttaacgacatatcctggatatagttcaatgtccataaatgtaaagctaactctctttatttaaaaaatgactacatgagattccatctagcacaattatttaaatcattcccccgccaatggaaggttgggttgttctgatctgttttgatacaataagcaatgacatagtatacaactttgtccatatttatttatttatttattttttgagatggagtttcactcttgttgcccaggctggagtgcaatggcacgatctcagctcactgcaacctcggcctcctaggttcaagcgattctcctgcctcagcctctcgagtagccgggactacaggcgcatgccaccacgtgcagctaatttttttgcatttttagtagagatggagttttgccatgttggccaggttgctctcgaactcctgacctcagaagatcttcccaccttggcctcctaaagtgccgagattacaggtgtgagccactgtgcccagccactaaagcttctaaaaagtatatataatttttgtgtgtgtgtttagccatcaacaattatatctcattacaatttaaagttctatgagtattctaaggttgtttcttttccgtcttggctcactgcaacctccgcctcccaggttcaagccattcttgtgcctcagcctcctgagtagctggaattacaggcgcccaccaccatgcccagctaatttttgtactttttgtagagatggggttttgccatgttggccaggctggtctcgaactcctgacctcaggtgatccacccacctcagcctcccaaagtgctgggattccaggtgtgagccaccgcacctggccatttgccccttttcaggagttcatgttttcattccacaaactcatattgtgcaactgctttgtgcttgcttctctatcaagggctggtcatacaaagttgaataagacaccgtcctgcccccaaagagttcatagtcaattagagaggaaggcaaacagacgaatagctaattataaaacaatgccagcagtggacaaataaagtgaacagtattaatggggagtggttagggaaggcttcccagcggaggtgctgtccaaaatgaggctatgtcgcgagctagaggagagagaacagcaggtgcagaaaccacaggcaattccatgtgactggagcatcggggaccaggcaggtcagatgtccttcagagggagggagagggaggagcctgtgtgggtcaaattggggaactggaacttttaaattttgtttatttttttgagacggagtctcgctttgttgcccaggctggagtacagtggcacaatctctgctcaccgcaacctctgcctccccagctcaagcaattctcctgcctcagcctcccaggtagctgggattacaggcgtgtgccacatcacccagatcttttttttttttttttcttttcagacaaagtttcgctcttgttgcccaggctggagtgcagtggcacgatctcggctcacttcaacttccgcctcccaggttcaagtgattctcctgcctcagcctccagagtagccgggattacaggtgtgcgccaccacacccagctaattttttgtttctttagtagagacagggtttcaccatcttggccagactggtatcgtactcctgatcttgtgatctgcccacctcggcctcccaaagtgctgggattacaggcgtgagccaccgcgcccagccatttttgtatttttagtagagacagggtttcaccatgttggccaggctggtctttaactcctgacctcaagtgatctgcccgcctcagcctcccgaagtgctggtattacaggtgtgagccaccgtgcccagccaggaactggaactttatcctgttttacaaataatagtttctgaaggattttggcagaagtcacatttacatttcccttagtgccctgggatgagatgggggctggatttgaggaactgaaatctgaaggtggctcaacaacagtagttgcgggcctaagggcacagatggaccgattaggtaaatatgtaggagatacagctgtatcagtttgatggggatgcggtgagggagaggcagaatcacagcgactgcctaacaaatgtctgatgaaaggatggttctcagcagggcactgtgagtcatgcctgtaatccctgcactttgggaggctgaggtgggaggatcacttgagcccaagacttcaagaccagcctgggcaacagggcaagaccctatctgtacaaaaaatacaaaaattagccaagtgtggtagcatgcacctgtggtcccagctacttgggaggctgaggcaggaggatcacctaagcccaggaggtcgaggctgcagtgagctatgatcatgccaccacactccagcagtctgggtgcctgagatcctgtctcaaaaaaaaaaaaaaaagaaaaagaaaaagaaaaaagacagggttcttggtatctaacttcagtagacagtagtagtatggttatctgagagaaaatgtggaggacagttctgggggatatttgaggcatgtttgagccctgcagcgccgtcaggctgctcaaagaggagggaagggtgaagaaagagatttttcagatggcagttgaaaccttgggagtgggaagggttccacagggtgaggaaccgggtaggctaccagctggagccgccccccagcaggctgacagctccaagcgttgtctgggggaggttgccctcgccaggtggcccgggcggattctagacagtagggggcacactcggactggggcaggtggagcaagaggcgtttggggctcccacagccctggggtggtggtggggttttatttttggtttttattttggtagagatggttctcgccatgctgcccaggctggtctcaaactcctgtccccaagtggccctccgaccttagcctcccaaaccgctgggattccagacgtggacaccgcgcggcagccctggggtgctaagccagccccccggagcgagccagggtgaccaaggcgattctggggcagtcagagggtcttcccgggtcgggttagtgcctcgaatccgggggacgaagacggggagctgagctttcggagcccgggcttatcagacggggacccggagccccctcgaaccctccctagcttgtaccagctggcggacgtggcccgtagcatcgccctgcagaggggaccttccctgaaagggacggggaacggggtgaaggtggccagcgcgggcagggagcacccagatgacgatcaagggtggagggtccccggaggaccgagcagtgcgtgaacacgggcggagaaaggtcagtctgatggggggagctcaggagaccccatcctaggacgggacagaccagccccaaatccccttgcagatttccaagggccaacttccagggaccgggcagacgccaccggggagaggggaaggggtcggtgcatcagcggggggcgccacggctggaccgggtccgggatcccaggccccgaatacgccgggacgggaaccaccggggcgggggagcgaggaaccaggacccaaagcccgaggcggcggggacggcggcgctgcgtggggaggaggcggggtggggattcgagagtggaaccaccgtgcggagccggcgcatctgggcgtggtgacccgcgcgcagggggcagctggggacggcggggcggccgcgggagagcccggctgggggcgctggtggcccggcggcttctggggggagtccgctgggggccgggacgcggagccggagccccagcctcgcagggtcaggccgctggagaggccgcggggcgatgtcgccggggattcccggccgcgctgtgactcgggttgaaggctgcaaagccgaggcccggcccgcagcgcccaggcccctcccgtcccccatctctcttgtttgtctccgagtccggccggaaccggcttctgctcgcggcggggcgggcggggggctggctgctgattggtcgacgcctgtttccagccccgctcagccaatcagcgggcggcagtgttttcttcttggggtcggaataaaagggctggaataaaagagggcagaaaaggcgccgggcgggcccgacacacgccggaggagccgggtgagctgcagcagggaggggatcgcggccggggcgagggcgcgggggcagaagcggccgccgaaggggcgtagggagaaaacgtgggaacaagaggagagagatggagcgatgagrggccgccagggaagagatgacgaacagatgcgggctggggaatggaggcgcgggggtccgaggccatggaaacgggcgagttgccgggggaacgcccgagatgggggtcgcgcggctggctcgcgccgccggtttgaaccggctcctcgtctcccacgctgggttcgcgtggccgcagcgcctagcgacctagacggcggccaatggcgcggcagttcctgcgccgtccggccaatgagcgcgccggggcgggccgttccgtaggtctgggcgctgatcttgtggttgaagaaaccagctctggggaagggtctcgggcgcgggcgggagggcacctgtcagggtccctgggagaggcagccctcggatctgcccctgcccacctcacgctgcgttccatgctggccccaggcgatgtcagtcctgctgcaggccaggactagttccacggccctgagcatgcgttagccccttcttgcctccatgcctcagtttacctcggagtgagctgcgggagacgtctccctgcctggccggggcggctctgtcgtagcggagggcagcggtacgagccggccgcgggctcggggtgtcccaggtccgggcagggctggggttcgcttcctctgctgcgcgcaccggccgccgcggccggggaggggtggcaatcccgagccctgcggcagcggtcggggctgctgggggcggccgcaggggctgggcaagggccggccgctgacgccgagttctgtgcgcaggtggtgcagagccggagccggagccggagccgcgccgcgccgcaccatggcgcy

SEQ ID NO: 17737 - DNA, 25322 bp, Homo sapiens
  misc_feature (1)...(25322): n = A,T,C or G, or insertion/deletion polymorphism (see Tables 1-2)
gctgtcgctggctccctccagagccccagggaaccctcagctcaaggtgcccccaaattctaactttccaagaaagtgtcaggagggctctggggtcagcctgggtgttaatcccagctctgctgcttgctggccccatgaccttggtatggttacttcacttctctgagcctcgcttttcctgtttgtgaaatggggacaatggcagcatccaccgcatagggttgttacgaaggtcaaggtcgtcacgtgcacgcctggcaccatgcctgtgcgtagttctcaagttagagtgacgactgggttacggatgctgagcgtattaaaatgaaccaacgtgaatatggtgtgtgtgggagggtggcggcttgtcacccacccaggacggcctgtctccctggagagaaactgcggagggaactgggaaggccttggggcccaagggtatgcagaaggacccaggctcctgctgaggctctcctctcccgggacaggcggtggagggcagcgtcctggtcagctcctcctctgaccattccttgaccgtctggaaggagctggagcagaagcccacccatcactacaagtcagcatccgaccccatccacacctttgacctgtacggcagygaggtggtcactggcaccgtgtccaacaagattggcgtctgctccctgcttgagccaccctcgcaggccaccacgaagctcagctctgagaacttccgcggcacgctcaccagcctggccttgctgcccactaaacgccacctcctgctgggctcagacaacggggttatccgcctcctggcatagactgaggcaggagctggccgggcaagggtgggaagacatctgcgggcgcgtgtccactcaccctgttccctgagcagcagctccctccagggaggccctgggtcccacgccctgggtgcccacatggcctgccaactagggcctgcaaatggagtgggggagtcctggcccctgaatcaccagagccaccaagcctgccagaggggtctcattcatggcttggggacacagggctcctagcaagcaggaagttaagagcaggaggaagcgttgctaccttcacttctccccagctctgccctctgggtccacatgaggacagggaagctcgggaaggggaagggagactggccctgcccagccggtctctagcccctcagcccccgctgggcactctctgtcccatccctctaggacagggaagctggcctggtccagggcactgatggtgcttggattccagcctaaggaaggctggccgtggtccaggagttaagggcttgggtctggggtttaagtggccacccatccaggccctggccagtgtgggaccgggacgggaaggaagaaggaggctaggagcagggggaaaaggtgcacttggccagtggcgcctgccaggagtgagtccatgcgttgtctgcccacccctaccacagtgtttgtgccttcagctgagggggcagcctctgggccctgaacccctgctggggctccacgaccctgagagaaggggtgagaagaatcatctctgcacctcgggtctctgccagaggaagacttaagcatccctgcgacctcacattctagacagagatgaggtccaggggttggcccctgctgccttctcacaatttgcaatagatgtaaataggaccaataaatcctttggaagagccatggggtgaactgaggcttgtctttttttttttttttcaatagagatggagtctgactatgttgcccaagctggtctccaactcctggggctcaagcgatcctcctgcctcggcctcccaaagtgttgggattacaggcatgagccaccacgcccagcctgaggcttatcttgctggtggtgtcagggtggggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggagtgaggagcagcacagtgagggtgggaggcggcctgatgcagggagtgaggagccggacagtgagggtgggaggcggcctgatgcagggagtgaggagcaggacagtgagggtgggaagtggcccgatgcagggagtgaggcgcaggacagtgagggtgggaaggagcctgatgcagggagtgaggagccggacagtgagggtgggaaggagcctgatgcagggagtgaggagccggacagtgagggtgggaaggagcctgatgcagggagtgaggagcaggtgtgagggcgggaagcggcctgatgcagggagtgaggagcaggacagtgagggtgggaaggagcctgatgcagggagtgaggagcaggtgtgagggtgggaaggagcctgatgcagggagtgaggagcaggatagtgagggtgggaggcggcctgatgcagggagtgaggagcaggtgtgagggtgggaagcggcctgatgcagggagtgaggagccggacagtgagggtgggaaggagcccgatgtagggagtgaggagcaagtgtgagggcgggaagcggcctgatgcagggagtgaggagcaggacagtgagggtgggaaggagcctgatgcagggagtgaggagccggacagtgagggtgggaagcagcctgatctttgcacgggctgccaggcttctggttcatacagccccaggtcagtttccagaaccctcgctcttgggtaggggaaagagacattgctctggagtggcaggacggtgggagaagttgagtccctctcatttctcctccctcaccccctgccttccatcccagtctgaaggcagccaacctgatcctgggcttggaaggttgggggtgggcttcctatcctgggctctctgcataggctcttgtggcttcccctttcctcccctcaggagcgggaggcagctctctgggagaagaaaggacattgggagtgagaatctggatgtgcctcagcccagctctgtgtccttgggcaggtcacatggcctctctgagcctggctgaaccagggataatccacacctcgtggggtctctggaaggcttaacacagtgctaggttcctgtgctttctggatccgccctcttggctagccagatccagtctcttcaactctctcctcctgaactttctctttccaggctcggggggggggacccaaatatagggggttctgcgtggctgcctcagggttagatgccctggtgggaaaggggcttctggcttcaagatcaatgtttaactggatgtgcaagtcaatatttaccagaagagaaagcaatctgaacaggggttggctgagagtaaaggtcctggtgggaggggaggggtgggctgggccagctggagcctgggcagagagtgaggagcacccaagtggggccagaggaacgttgtgtgtggcagcaaggagcccgcagaggtatgaggggaggggctgctcggcctgctccttgggtaggagaggaggagggagctgcctccctggctgaggggtctgggatttattcaggaggcctgtcactccccagcctctyctgggacttgaaaaactggagcctgttcttggcaagaagattctaatgcccaggtcggagtcggggccctggccaagggctcttgtgtgggatgggggtggggccggggggaccaaaggatcctccagaagggttggccccaagatgggggtgggctggaggtagctgagacctgctctgacttatcctcctgagaccaacacctgcccttcccagagccagcctggagcagaggcctgtgatgctcctaagtgcagaggtggctctggccagagtcattcactgggctctgctgctgggtcaaaaggcagctctctggctgccttgccacccatggtgagacctcagggcctcacaggtatgtccagccttgtgggcaagacctgaccagcctgagaaagacgggttggggccaggcgtggtggctcatgcctgtcatcccagcactttgggaggctgaggcaggtggatcacctgaggtcaggagttcgagaccagcctgaccaacatggagaaaccctgtctctactaaaaatacaaaattagccaggcatggtggcacatgcctgtaatcccagctactcgggaggctgaggcaggagaatcgctttaacccaggaggtggaggttgcagtgagccgagatcgtgccattgcactccagcctgcatgataagaatgaaactccatctcaaaaaaaaaaaaaaaaaaaaaaaagacaggctaaatggatgcagcaggctgggtaggagctctgtgttggagctctgcggtggaggcttcagggcaggcttcccagaagaggtggccttgagccaagctgaccccagccatcgggggagtgccaagcattgtactcagggtttacaaagatggtcttatttatttttttgagacagagtcttgctctgtcgcccaggctggagtgcagtggcgtgatctcggctcactgcaacctccgcctcccgggttcaagcagttctctgcctcagcctcccgagtagctgggattacaggggcccaccaccacgcctggctaattttgtattttcagtagagatggggttttaccatgttggccaggctggtcttgaactcccgacctcaggtgatccacctgcccctggcctcccaaagtgctgggattacaggcttgagccaccgtgcctggtcacaaagatgggtttttgcgacgcgcaaaggctcccgaccggagcacacgccggctgacctgactcgaggaagaggagccttcacgtgcgtcctgcacccttggccctgcgagactaccgtgaaccccgagaagggatcaggcgccgatctgaccaaccggaggcgggataagccactccctaatannnnnnnnnnnnnnnnnnnnactgctgactctggggcaagggcagagaatggggcctcccaagggaggagacagccacaaagactgtgatggggaacgtgatggggcagtacccaacaggcaggagaagggcacgtagccacaaagatggtcttttgccgggtgcagtggctcatgcctgtaatcccagtactttgggaggccgaggcaggaggatcacctgaggtcgggagtttaagaccagcctgactaacacagagaaaccccgtttctactaagaaatacagaattagccaggcgtggtggtgcatgcctgtaatcccagctattcgggaggctgaagcaggagaatcgcttgaacctgggaggtggaggttgcggtgagccgagatcctgccactgcactccagcctggtcaacgagagcgaaactccgtctcaaaaaataaacaacaaaaaatcccaaaaagacggtcttattttggtcctcaccatgcatgtgagaagagtgagggacttgtgccaccgtttkacaaggtaaggccaagcctggtggagttacgggaaatgccgaggtcctttggcaagaggtagcctggattcagacacagatctgattcacagcgcagggccttgtagaatgagaacgtttttgatttggtatctccctcctattcaccaaaacaccctcagtgcatgaaatgcatgaaatatgaaacaccagaaactaaaaagggggagaagccagggcggatgtcccagctgcaggagtgggagccgctgctcgtgtgtttggggtctgttctgattctggagcctgcttcttccccttggcaatcatgacccaggacttggcgttatctgtgatcgcgtgggtaggattccctggcgggcgtggggatgtgagatgggaacagagctttctgtccctgccacaggaacatggygctgctctgggggctcctggtgctcagctggtcctgcctgcaaggcccctgctccgtggtgaggctgggctgaagtcaaggtggggtggggtggagggggaagaagaggggcgttggcatggagggagggcttggctccgaggggacctcctatcctcatccctttctccacagttctcccctgtgagcgccatggagcccttgggcyggcaggtactggggagtgaggagcctgtgatggggggaaggtcccgggggtctcactggtggcttgggcagggtggggggcctgtgggaagggtcggtctccatctgcttgctcctttccgcagctaactagcgggccgaaccaggagcaggtgtccccacttaccctcctcaagttgggcaaccaggtacaaccaggtggggctggggaagagtgggcggggctagagggaggagggcccatcggcaggggtcggggggtgggggcgcgtgctgaggctgaggctctggagtccagaggccagaagggagagagggtggggaggaccgaaggtgggcgccaggccccagaatgccagtgccctccgtctgacgctccctcttccctggggctgggacaaggccctgctgtcctcaggcacaggggctgtgacaaggccttcaacacagaacctggagctgaccccttgacctccctgacccctgatctgtccytgcaggagcctggtggccagactgcyctgaagagtcccccaggagtctgcagcagagaccccaccccagagcagacccacaggctggcccgggccatgatggccttcactgccgacctgttctccctggtggstcaaacgtccacctgccccaacctcatcctgtcacccctgagtgtggccctggcgctgtctcacctggcactaggtaccctggcaccacttgtccagaccaagagagctggaggccagtaggaactcastactccartggttctccgcgggcggttcctccaccagggtcacgtggctgtttggtaaaaatgcagattcctaggccggggcggtggctcacgcctgtaatcccarcactttgggaggctgaggcgggtggatcacgaggtcaggagttcaagaccagcctggccaacatggtgaaactctctctactaaaaatacaaaaaatttagctgtgcgtggtggtgcgcasctgtaattccagctactcaggaggctgaggcagagaactgtttgaacctgggagttggaggttacagtgagccgagatggcgccactgcactccagcctgggtgacagagcaagattccgtctcaaacaacaacaacaacaaatgcagattcctgggcccccacccatctgtctatgtgaatcagatctcagggactgggccggggaatctgcttatttacaagtcctcctggtgattttttttttttttttgagacagagtcttgctctgtcacccaggctagagtgcagtggtgtgatctcagctcactgcaacctctgtctcccaggttcaagcaattctcctgcctcagcctcccaaatagctgggatcacaggcaccagccaccatgcacagctgatttttgtatttttagtagagacggggtttcaccatgttggccagggtggtctcgaactctcgacctaaggtgatcaacctgcctcagcctcccaaagtgctgggattacaggcgtgagccaccgcgcccggcccctcctggtgattcttatgcaagagtttgctagctacactctttcccactgtgctggagggtctcactgtgggaaacggaagcccagagagggaaggtaacttgyggggggtgaggtcacccagcctgtcagccacaggggtgagagycacgcagaacagatccgtggctgtggaaggatggcgtgtggtcccgtggacgtcctcgtcacgggtatccaggagggactggagtgggcagtgggggtgagaaaggacccgcagccgggcctcagcctgtgcggtgccctccaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggtaggcgctgatggcagggagctccctcagtcctgccctgggtggaggagggtgagagcaaggggctgggcctctggtakcgagtaggggcgtgtctggctgtggagcctggagccctgggaacagcttgtgctgcctccgtgcaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtgcgctcctcctcctctcagatcccccaccctgtaggctgagctgggacgtgcaggcctttttgttttttgagacaagtctcgctctgtcacccagggtggagcgcagtggcgcgatctcggctccctgcaacctccgcctcccggattgaagcgattctcctggctcagcctccccagtagctgggattacaggcatctgccaccacacccagctaatttttgtattttagtagagacagggtttcaccatgttggccaggctggccttgaactcctgacctcaggtgatccacccacctcggcctcccaaagtgctgggattacaggcgtgagccaccgcgcccggccatgcaggctttgttctgagggtctcctttcttcctcagtctgggccatgaggcaggaggctgtctgggtgtggtggggatgggtgcccaggagccagatgagttgttctagagtgaataccctgggaacaaatggtctgaaaagatgcaggaggggctgggcgcggtggctcacgcctgtaatcccaacactttgggaggccgaggcgggcagatcatgaggtcaggagatggagaccatcctggctaacacggtgaaacccccgtctctgctaaaaatacaaaaaaattagctgggcgtagtggcgggcacctgtagtcccagctactcgggaggctgasgcaggagaatggcgtgarcccgggaggcggtggagcttgcagtgagcggaggtcgtgccactgcactccagcctgggcgacagagcgagactccgtctaaaaaaaaaaaaagatccaggaggaggttcctaggagaattgcaggggttggggaaaacacaagcccagatttcaaaaatgctacgggaaagagacctyagatcaattggatgccagctagcattccctggggtcttggcctccaccgctgtctcatccttgaatggattctgggtgggacrggcaacgggctgggggtgcagagcccaagctggtccccatcgacgtgacccctgccctctgccccaagctggtccccgtcgacgtgacccctgccctctgctgggtttcaggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtcacccttggttgtccagcaggctgggcctgaggctgggaggtggggaagggagtggacaggctgtggagcaggcacagggatgggtggaggctgtctcgccttccttgcctccacgtcccctaggcaggcaactgcaaaaggtcccatgatcccccatcctacctggcaggaggactgaggctccaggctctttgaggtttagtaattcagtgaaaatatactgggcatttgctgtgttccagatactgttctaagcactagggtttttgtggagcatgagggaggccaggtctctgctcttaggaaggaggatacacagtgcaacagtgaatggacatcaacacaggaattccagacgctgggaagcgctgtggagggaaagctgaaaaagaaggtgattttggccgggagcggtggctcacgcctgtaatcccagcactttgggwggcccaggcaggtggatcataaggtcaggagtttgagaccagcctggccaagatttgaaaccccgtttctactaaaaatacaaaaattagccaggcgtggtggcaggtgcctgtaatcccagctactccagaggctgaggcaggagaatcacttgaacccaggagggaaaggttgcagtgagctgtgattttgaggtcaggagttcgagaccagcctgaccaacatagcaaagccccgtctctactaaaaatacaaaaattagccagccatggtggcgggcgcctgtaatcccagatactctggaggctgaggcaggagaatcacttgaacccgggagacggaggctgcagtgggctgagatcgcaccactgcactccagcctgggagacagattgagactccgactcagaaaaaacaaaggctggccttgaactcctgacctcaggtcatctgcccacctcggcctccctaagtgctgggattacgggcatgagccaccaggcctggccttatttaggcattttagagtggtaagggagaattctgtgaggagggggcattgaattgagactcaggtgaccgttgttgataagggtttattacaagggcccatggactttggggcagcacagggaccaccccacggccatgtagccactcagggtctctgcagcccccagcctgggagattccacggggcgctcacacagtgctccttagaaaggaggatctgattggattggatttctcagcatcttgcgtggaacattctgattggataaacttcttttttttttttttgagacagagtcttgctctgtcacccaggctggagtgcagtggcacgatctcggctcactgcagcctctgcctcctgggttcaagccactctcctgcctcaacctctcgagtagctggaactacaggcatgcaccaccacgcctggctaattttgttcgtttgtttgtttgtttttgagacggagtttctctctatcgcccagactggagtgcagtggtrcaatctcggttcactgcaatctctacctcccgggttcaagggattctcctgcctcagcctcccgagtagcttggamtacaggcgcccgccaccatgcccagctaatttttgtatttttagtagagacggggtttcaccatattggccaggatggtctcaatctcctgacctcgtgatccgcctgcctcagcctcccaacgtgctgggattacaggtgtgagccaccgcgcccggccaatttttgtattttttttttttagtagagacaggtttcaccatgttggccaggctgatctcaaactcctgacctcaagtgatccgcccgccttggcctcccaaagtgctgggattataggcaggagccactgcgcccagctctgattggataaaattccgtgccaggctgtctcaggtgtggcctctcttgcttctagcctaaatgtggtccccttggcctgggtattgatccccgggccagacagctgtggctgagatggctgtatttgttagcttcccaaggcaagtgtgacacagagcacagccgcttctgcagggaggagccagaagccacttgggcagccctcctgggagggggctgtgggtgaggctggcccgggaacgcgtcctggcttccctgcagctcattctgaaaggccagtctgatccacctccccgaggctcccctttcctgcttcccctttcctccaggctgtgtcctgcgtactcttccttcatccttcgtctcctttccttaggccccgtcagcctttcttgtcctcaggccctctgcagacaggcccaaacagccagaacccggggcttatcctcccacgggcaggggttctccacacgggtactctgcctggaacccaaggagtcacagctgcaggaggccctcgagccctgtggtgtccacactgcttttgctgcagaatcccttcaaatcaaatcttaatggctgggcacggtggctcacgcctgtaatcccagcactgtgggaggctgaggcaggtggatcacctgaggtctggagtttgagaccagcctggcccacatggtgaaaccccgtctctactaaaaatacatcaattggccaggtgagatggtgagcgcctgtagtcccagctactcgggaggctgaggcaggagaatcacttgaacccgggtggcagaggttgcagtgagccaagatcatgccactgcactccagcctggacaataagagtgaaactctgtcttgaaaaaaaaaaaaaaagaggctgggtgtggtttacaggctcatgcctgtaatcccagcactttgggaggccaaggcaggtggatcacgaggtcaggagattgagaccatcctggctaacacggtgaaaccccatctcttctaaaaatacaaaaaattagccgggcgtagtggcgggcacctgtaatcccagctactcgggaggctgaggcagaagaatggcgtgaatccacgaggcggaggttgcggtgagccgagattgcgccactgcactccagcctgggcgacagtgcgagactccaactcaaaagaaaagaaaaaaaaagaaatcttaagccaaatcacaatatatttacacagctggcaaagtcacaagagggaggtgwgggagggtggggcgggcagcactcggcagtggctcacccacagaacccagctgtggtatgacagccagtgaccctgtctgtggtacatctggagaagctgagacaaagacaggcgattccttacgccgggtcacacggccagctggtagccggtgaagagagaaaaccaccaggtattattgagcaccgtctgtgacagcggacactgctacaatgttgttttttttctttttttgagacggatttttactcctgtcccccaggctggagtgcagtggcttgatcttggctcatggcaacctctgcctcccgggttcaagcaattctcctgcctcagcctcccgagttgctgcgattacaagckcccgtcaccacagaagcccagctcatttttgtatttttagtagagatgaggttttgccatgttggtcaggctggtcttgaactcctgacctcaggtgatctgcctgcctcggcctcccaaagtgctaggattacaggcgtgagcccccatgcccggccacactgctagaaactttaaaagcatctcattcggttacgtgtccgcctgcagtgggacaggtagtatgactccaccccactgtgaggaagtggaggagcagtggggtcagtcacacgcctggcaggatggccaggagccccattgtctgccttaggagcacctgctggccccacccccacttagcttcggggctttctgtcctcatgctcttcccttcccttttctgtaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggtaaggaggagggtgcgggcgagcccccgaggtcaggctgggcagggcgggtaaggaggaagcgtctggctggcagtggagctgagtcagagctgtcctgtgtcctgctcttttccagggcttcgggagcrgggagagggttgaatatgagcccccagaccctctgtcctagaggaagttggggtggcccggggaatggggctctgctttgctgcccaagacctcgcattgcaaggagagtctgggtagagagcctgggatggcatgtgagcctcgctggcttccctggaaggggaaggaggagaagctggggtgtcacactgttaaagaaatgctgggtggagtggctcatgcctgtaatcccagcacgttgggaagctgaagtgggtggattgcttgagcccgggagtccgacaccagcctgtgcaacacattgaaactccgtccctacaaaaaatacaaaaattagccaggtgtggtgcatgctactggggaggttgaggtgggaggccctcttgaccccaggtggctgaggctgcagtgagccataattgtgccactgcactccagcctcagcaaaagaactaagaccttgtctcaaaaataaaaataaaggccgggcatggtggctcacgtctgtaatcctagcactttgggaggccaaagagggtggatcacctgaggtcatgagtttgagaccagcctggccaacatggccaaacccrtctccactaaaaatacaaaaattagccgggcgtggtggcgcatgcccataatcccagctacttgggaggctgaggcaggagaattgcttgaacctgggaggaggaggttgcagtgagccgagatcacgccactgtactccagcctggatgacagagtgagactccatctcaaaaaaaaattataataactaaaataaataaataaagcatctatccttcagccatttgctaagcagctgctgtattccaggcactgtaccaggyaccgggagcccaccatgtacaaacagctgagtctaatggggtgggcagacgagcaatcacatacttactacagcataagcgataagacagagagggcttctctccagctcacctgggagaacactgaaaatgtaccttggttggactttagagctggggatcagggaaggcttcctggaggaggtggtgtttaagctgagtcttggaaaccggataggaatgaagcaggtatctgtgagttcaagctgttccctggccaggatctcagacaccctcccaagcagctccaggagcctgtgaggccaagggcagctctgaccagccatctctggccctgggcaggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgargaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtgggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggcctggctggtttgatgtcaccgttctgggcatgggtggggacaagtgaggatggtggggaaggcagggaggcggccgcagggtggactgtgctgaggaaccctgggcccagcaggggtggcagcccgcgcagtgccacgtttggcctctggccgctcgccaggcatcctccaccccgtggtcccctctgacctcgccagccctcccccgggacacctccacgccagcctggctctgctcctggcttcttcttctctctatgcctcaggcagccggcaacagggcggctcagaacagcgccagcctcctggtttgggagaagaactggcaattagggagtttgtggagcttctaattacacaccagcccctctgccaggagctggtgcccgccagccgggggcaggctgcygggagtacccagctccagctggagacagtcagtgcctgaggatttgggggaagcaggtggggaaaccttggcacagggctgacaccttcctctgtgccagagcccaggagctggggcagcgtgggtgaccatgtgggtgggcacgcttccctgctgggggtgcagggggtccacgtggcagcggccacctggagccctaatgtgcagcggttaagagcaagcccctggaagtcagagaggcctggcatggagtcttgcttcttgcaaacgagccgtgtggagagagagatagtaaatcaacaaagggaaatacatggtctgtccgaggatgagctgccggagagcaatggtgaaagtgaagtgggggagggggcggggctgggaggaaaagccttgtgagaaggtgacacgagagcacggccttgaaggggaagaaggagggcactatggaggtcccggcgaagcgtggcctggccgaggaacggcatgtgcagaggtcctgccgaggagctcaagacaagtaggggacggtggggctggagtggagagagtgagtgggaggaggagtaggagtcagagaggagctcaggacagatcctttaggctctagggacacgataaacacagtgttttttgtcttgtcaagtgtgtcctttttatttttttgaaagagtctcgctctgtagcccaggctggagtgcagcggtgcgacctcggctcactgcaacctctgcctcccgggtccaagcaattctcctgcctcagcctcccgagtagctgggattacaggcacccgccaccacgcactgctaatttttgtattttagtagagaccgggttttgccatgttggtcaggctggtctcgaactcctgacctcaggtgatccgcccgcctcggcctcccagagtggtgtgagccactatgccctgcagcacttgtcaagtctttctcagcgttcccctcctctccactgcagctcccagtgccccagtctgggcctcgtcttcacttcctgggatccctgacattgcctgctaggctctccctgtctctggtctggctgccttcactgtaacctccacccagcaggtacctcttcagcacctcccatgaacccagcagaataccaagccctggggatgcagcaacgaacaggtagacgctgcactccagcctgggcgacagagcaagactccgcctgaagaaaaaaaaaaggaccaggccgggcgcggtggctcacgcctgtaatcccagcactttgggaggccgaggtgggtggatcatgaggtcaggagttcaagaccagcctggccaaaatggtgaaaccccgtctctactgaaaaatacaaaaattagctgggtgcagtggcgggcgcctgtagtctcagctactcaggaggctgaggcaggataattgcttgaccccaggaggcagaggttgcagtgaaccgagatcacgccactgcactccagcctgggcgacagagcaagactctgcctcaaaaaaaagaataaaaataaaaaaaaggaccagatacagaaaacagaaggagacgtactatgaaggaaattggagagcttttgggatactgagtaactcagggtggcctttcccaggggacatttagctgagagatagacggtatgaagacctgaccgttcagaaacaggggaagaggcagcagcccgggcaaaggcctttggggcaggaaagggcttggatcactggagaagcagaaagatggccagtgtgaccagagtgtgacaaagtcagagaaaaccaggaagatggagctggagacacaggcggggccagatcacgagggtcctygcagaccagagcaagggtttggattttattccaagtatgaagggaagctgctgaagtgtgttttcctttacaatttgtagttgaaatataatatgcaaagtacacaagtcttaactatatgtaagcttaatgaatgtttccatgaaccaaataccgctgtgcaaccatcaccagctcaagagacgaacccttctccctcctcctgactgccagtaacatagtggttcagctcaagaaacagaactcttctgacttcccctaacatagcgggttttcttttttgttttgttttttgttgttttttaagagacaatgtctttattatttttatttttttttatttttgagacggagtcttgctgtcgcccaggctggagtgcagtggtgcgatctcggctcactgcaggctctgccccccggggttcatgccattctcctgcctcagcctccctagcagctgggactacaggtgcccgccacctcgcccggctatttttttgtatttttagtggagacggggtttcaccgtgttagccaggatggtctcgatctcctgacctcgtgatccgcccacctcggcctcccaaagtgctgggattacaggcatgagccaccgcgcccagccaagagacacggtcttgctctgtcgcccaggctggatggagtgccgtggtgcgatcacagctcgcggcagccttgacatcctgggctcaagcaaccttcctgccttggcctcccaaatgttgggattataggcatgagccactgtgcttggcatctattcatctttaatgtcaagcaggcaattgaatatttgatcagggatagaattgtctatttgggggtatgcagnnnnnnnnnnnnnnnnnnnnctggagtgcagtggtgcgatctcggctcactgcaggctctggcccccggggttcatgccattctcctgcctcagcctccctagcagctgggactacaggtgcccgccacctcgcccggctatttttttgtatttttagtggagacggggtttcaccgtgttagccaggatggtctcgatctcctgacctcgtgatccgcccacctcggcctcccaaagtgctgggattacaggcatgagccaccgcgcccagccaagagacacggtcttgctctgtcgcccaggctggatggagtgccgtggtgcgatcacagctcgcggcagccttgacatcctgggctcaagcaaccttcctgccttggcctccattggattaagataccctgcttggatattcatcaagggatatagagatgtgcttcatgtcatggaactgggccgggcgcggtggctcatgcctataatcccagcactttgggaggccgaggcaggcggatcataaggtcaggagatcgagaccatccgggccaacacggtgaaaccccgtctctactaaaaatacaaaaattaggcaggtgtggtggtgcgtgcctgtagtcccagctactcagggaggctgagacaggagaattgattgaacctgggaggcagaggttgtagtgagccaagatcgcgccactgcactccagcctgggcgacatgagcgagactccgtctcaaaaataaacaaaaaaaagtcatggaattgatggaaattgcctaaggggagatgtagaagaaaaggggtctcaggatcaagccagcagagaaggcagaaaaggtaaggtgtgtgaggtggcagaaaaagggaagagtgtggacagtgagggtttcaaggaggaggaactgtctactgcctcctgccaaggacggaggtgtccactgccagttgacataaggtcacccatgaacttggtgacaggaatttcagtggagaagtggccacagacacaagtctagaattgaaatgggagccgaggcagcgtagacaaaagaggaaactgctccttccagagcggctctgagcgagcaccgagaaatgggcagtggctttaggggatgtagcgtcaaggaagtgtcttttaaagaagtcgggggccgggcacggtggctcacgcctgtagtcccagcactttgggaggccgaggcaggcagatcacttgaggtcaggagttcgagaccagcctggctaacacgatgaaaccccgtctctactaaaaatacaaaaaattagctgggcacggtggctcgtgcctgtaatcccagcactttgggaggcagaggtgggcagatcacttgaggtcaggagtttgagaccagcctagccaacatggtgaaaccccatctctactaaaactacaaaaattagccgggagtggtggcacgtgcctgtaatcccagccagtcaggaggctgaggcaggagaatcactggaatcctggaggtggaggtggcagtgagccgagatggtacctctgtactccagcctgggggacagagtgagactccgtctcaaaaaaaaaagaaggtggggaaggatctttgagggccggacacgctgaccctgcaggagaggacacattcttctaacaggggtcggacaaaagagaactcttctgtataatttatgattttaagatttttatttattattattttttatagaggcaagcatttttcaccacgtcacccaggctggtctccaactcctgggctcaagtgtgctgggattatagccatgagtcaccacacctggcccagaaactttactaaggacttatttaaatgatttgcttatttgtgaataggtattttgttcacgtggttcacaactcaaaagcaacaaaaagcacccagtgaaaagccttcctctcattctgatttccagtcactggattctactcttgggatgcagtgtttttcatctcttttttgtatccttttggaaatagtattctgctttaaaaagcaaatacaggccaggtatggtggctcactcctgtaatcccagcactttgggaggccgaggcaggtgatcacctaaggtcaggagttcaagaccagcctggccaatatggtgaaaccctgtctgtaccaaaacacaaaaacaaaaacaaaaacaaaaattagccgggcgtggtggcgtgctcctgtaatcccagctactcaggaggctgaggcaggagaatcgcttgaacctgggaggcagaggttgcagtgagccgagattgtgccactgtactccagcctgggccacagagcaaggttccatctcaaacaaaacaaaacaaaacaaacaaaaaaacaaaacaaaagctaatacaaacacatatacaatagacaaaactgtaaatattttattatttttattttttttagtagagacagggtttcaccatgttggccaggatggtctcaaactcctgacctcaggtgatccacccacctcagcctcccgatagttaggattacaggcatgagccaccacacccggcctaaaattgtaaacgttttagaagaaagtatagatgaatcccttcgtgatctcggggaagaagagattttttaaaaaagataccaaaagaagcacaaattataaaagaaaagattgaaaatgttggtgttaaaattaaaaacttgttttaaaacaagcttgtgtaacccatgacccacaggctgcatgtggcccagaaaagctttgactgcagcccaacacaaattcgtaaactttcctaaaacattatgagattttttttgagattttgttttgttttgttttttgtttttttagctcattcggtatcattaatgttagcatattttacgtggggcccaagacaattcttcttccaatgtgtctcaggggagccaaaagattggacacccctgccataaacatgaaaagacaatggccgggcacggtggctcacgcctgtaatcccagcactttgggaggctgaggggggcgggatcacctgaggtcaggagtttgagacaagcgtgaccaatgtggtgaaaccctgtctctactaaaaatacaaaaattagccgggcatgctcgtgcacacctatagtcccaactactcagcagggtgaggcaggagaacctcttgaacccgggaagcggaggttgcagtgagccgacattgcacccctgcactccagcctgggtgacagagtgagtctccactggaaaaaaaaaaaaaagaacagtgtgatacattgacctaaggtttaagaacatgcaaactgatactatatatcacttagggacaaaaacttacatggtaaaagtaaaaagaaatgtacgaaaataataaaaatcaaattcaagatggtggttatggtgacgggaaagaactgaggcggaaatataaggttgtc

SEQ ID NO: 17738 - DNA, 175189 bp, Homo sapiens
ataactgaccctatttaaagtcactgaaatatttgccttctctatttggacttgcctgatgctccaaattgaaatgaatacctgcacactcagaaagcatgttaggcacccccggctggaacattcctcacagctggtttcctggaagagctggttgagacttgaaagctctgcccccaaacacccctgaagctcttggagaccagcatgtagatcttatttatctttgtttttctcataaggcccagtactctaaagatatacaatctatgtggattgaattgaactgaacccaagatcaagcatatatgtaaaacactgtggggaggaggtataaagagaagtttgagtagagaatttgtagcaccatggttaaaacacgagctccgagcgggctgacctgtgtgagttccagccccaccacttactagaaatgtgtcttcgtgtctcccactaagccacatggagttaatacaagccatagaggatgcagggtacacctatgctaagccctcctttgctgagaactggacccacaagtgtagcctctagcagttgtgtttgtaccatgtaaccctgttgtgagcccgattctgtcactgttcggggcgccactatgtaacccgcaccgacctagggcgactgaacaaagggggcgaacacggaaataaaaggcaagagacaaaagagtatatttggaagaaggggtcagggggcaccttgcctctagtggacaagagctctgagctttacacagccctctgtatttattaggcaaaagaggtagtgagaactggggtggaagaaggggtcagctgcttggcccagagtaggcttgtaagactgcattcctcgaacaacaggctctagatgtcgcagtagatagccttggccccagggagtgattgcctccaggaaaccttctgtctgcaagagcagtcgtgagcttgttcacatcttgcattcatgataaacagtttgctgtttgatcatatagactccagtggaatgctgagttggtcacgcgtccctcaggccttcagcttcctacataaccccacccacctggccagacccaattgggccaggggtggaccactgaccccagctgggccaatcagctcctctctcctggaacttgggtttggattgagcatccttagcgggtctggtctcacggctgagctggggaaggaagtggcctcgggatgtgtgggaaagtgagtgattgttacgtgcagttcagttgctggcgaggtattgaatttcctgccctttggttctacctatgagacattctttttttttaccaatagattcccctttgccaacattaagtaggtatctacaacacgtgaccaaacaaacactctcttatctagaccccgccctcccaggattcatgtcaggattgaggcagtgactgagcagtgcccagccacaggcagccctcaggaagcatcagccctcattcccatgactcctgttagtaatggtttcacctcctcctctgatctacaatggtgatgtaatgaagcaatactctctgtccacagggaacggacagtggtgtctgggagttcaggcaggtgcctgctaacagatcccaccaatccaagctgaggtgggcccctggccaccagcctcactctggctgttttctacccgagtctcgtggagttcctgttgtctgaatagctgagtgttgtctgcaaacgcaagaagaggatgtggcgcttttgcaaggggcccccatctaaaatagtctctgtgagcaggctcagagccacctaactatttcttccatcttccaccatggagtctggagagctgctagggtagagtggtcacctggctcaccccatccttccctggaatgttgggagaaggcctgacagcacccacccgagtgttgactgagccccttccctctgctggagttggtgctgccgcagtacaagagcccggcatgaccccttgtcttaatagggctttattttctgttatcttacaatttattttgttttcagacacaggtctcactctattgcccaggctggagtgcagtagctattcataggtgtgatcatagcaccctacaggcttgaactcctaggctcaagtgattctcttgcttcagcttcctgagatgctaggctgttccacagcctctgctcccaagttttctcacaattggcacaattcctaggctggccaagtcacatattctaccccattcctgcagtcattggcctggggatagacgtgtgactcaaactgagctaattagactctgccatggggctctctttgaaacaatgaggaaagagatcctctttgtccattggggttgttaagcaggcaggtgacaggcccaggactgctggtgcccagcttcaccctttgctaccttgtagagaaagatgacctgagaagggaaccaacatagaggaccaatggccttgttccagagcctgggttagctgcatttggacctaattgtatacctggtttactaattatgatcttcaaaaaatgcccttcttgctgtaagcaatagcagagctaggtttctgagagtgaaatcaagtttcctaatcagtacaggaggatggccctgttggggcgtgtcagggaagcattctccatagaagtgacagtgaaactaagaagcaaaagatgactgggaccagccaagtggagaggaggggagggaacattctagacagcaggagcagctcatgagaaggttccaagtcagccagaactgggctttgggaatccgtttgcttcattaccttgtgtgtgttctactatagttataaacatctttgatgaatagcctttattaagtaagttctgtgaccctgatttaccataatgtccatttgcaaagtactttgttgtttgcaaatcttttgtcattggatatgtcataatttattaaatatatttgtgttctcacaaacccctgactgcacctagtatccatgcagtctagttttctacttttcaaccaggattttggatttaaaatatcggctcttctcagctcagaagcctagaagggttgggggcagcattgagtgtgttttggggttgggcctgggaccaggggccagttttgcctggtaaggcatctgccaagagggctgaacagggccaccctggatcagagcatccattcatcaggtggaagagggaaatgaatttgtcaatctttggatttgcctttgacctctagagggctgcaactgatgaaatgatgatgggaaatttggctgccatctatgaccagctcctttttttttttttaaagagggagtctcgctctgtcacccaggctggagtgcagtggcgcgatcttggctccctgcaacctctgcctcccaggttcaagtgattctcgtgcctcagcctcctgagtagctgggactaccagcgcgcaccaccacgcccggctattttttgtatttttagtagagatggggtttcaccatgttggccaggctggtctcgaactcctgaactcaggtgatctacccacctcggcctcccaaagtgctgggattacaggtgtgagccaccacacccggcctgactagctcttagttgtggaatcggtgaccctttagactgtccagggagatgggaataagaatctctcacaacattagcagtttttcctcctccctgcacctcccccaaatcctgtccccatcactaggttatttaatttacttattttgggggaaacaggagggaaaactagcccaggtggtgcgtgctacttctttgtattccatcttagactaacaacaggaagcaggcagcagaattgccccacattggaacatcacttgcgttactaatttgttgttatttactacttgtattataggatttaactttgacttcccagctaagttgtgaactctttggagggaagcaccaattgtgcccacttttgtagggcccacagaacccgaaataatgcttagacttagcagatcctttgattcttaaatgactttttttttccttttttttttttttttttttagccagggtcttcctctgtcactcaggctggagtgcagtggtgcaatcatgactccctgaaacctctgcctccagggctcaagtgattctccctcatcagcctctcaagtaactgggactacaggcaggtgccgccgtgcctggctaatttttgtatttttagtagagacggagtttcacacattgcccaggctggtctcgaacccctgggctcaagtcatccacccacctcagcctcccaaagtgctgtgattgcagccgtgagccactgtgcccaaccacgacttttttttttttttgagacggagtctcgctctggagccaccaggctggagtacagtggcatgatctcggttcactgcaacctccatgtcctgggttcaagagattctcctgcctcagcctcccaagtagctgggactacaggcgtgtgccaccatgcccacctaatttttgtatttttagtagagatggggtttcaccatgttggccaggatggtctcaatctcttgacctcgtgatccacctgcctcggcctcccaaagtgctgggattacaggcgtgagccaccgtgcccagccacgacttttaatgaactcatttccacactagaaaagttccacagctgagccccagggtgcccttctggatgtcaaataagcagggcaggcagggtgtgctgtgtccctgagggagttgggcccaggccagcatggaggctctaggcctcaggggacatttaggcctgagtagggccaaccccagcccgggacaggtggctctcgctggcagggtgactgagtcccacatgcagggctggggtggagaatgaatcctccgccttggcatagaccttgggccagcagagggctttcatgccagagtggactcattccccggctggagcctctgggctggcaggaggtgctatgaggccactcccaggccctggtgtggggtctccaattaagaagggggtgcgggcagggtgcagtggttcacacctgtaatcccagcactttgggaggccaaggtgggtggatcatgaggtcagaagatcgagaccagcctggccaacatggcgaaaccccgtttctactaaaaatacaaaaattagctgggcatggtggcatgtgcctgtaatcccagctactcaggaggctgaggcaggagaattgcttgaacccggcaggcagaggttgcagtgagtcgagatcgcgccactgctctccagcctggcgacaaagtgagactcggtctcaaaaacaaaaaacaaaacaaaaaagggggtgctgcatctctggtttgggggaggtcaggacaggctcccagccagcagagcttgttgagtcctggtgagagtgagttctaggccctggtgtggagcctctggcccacaggggatgctgggtgcgggatgatgctagggtggggtgggcgtcagttccacgtcctggggtggaaaatctgacccaggagggttctctgtgtctctggtgagggggcaggccaggctcttgggcaaccgaggaccctgggttggagctgtcagtcccaggtctggagctggtgactctggtcccacagcagaggaatgcggagtcccaggcggggtcggccccacaccccaggccccaggccccggcgtggggactccggctcggcagggggcgctgcgtctcgcgcgtcgcgcgggaggctcgggcggctccgggcccacagggggcgctgtggcggcgcggcgggcgcccggcaggtggcgctgtggccgtggccgcggccgaggcccggcgggcgggcgggcggcgtcgctgcgctgcggccggctcgcgggccgggggagcggcggcgggcgcgcgggaggcggagcggcggcggcgggcgcggcgggagcggctgggcccgggcgggctggagcgcggtcgccgagcgcagggccgcggccgcgcggagcccgccatgccggcgcgggtctgaggcgtggcgagccagggccgaggcgagcggcgggcgcgccgcccctgtcgccccgcggcggcccggcccgggcccgatgagcggcggcctcggcctccggcgcagcccggaaatgtccggcaagatcgagaaagcaggtgaggcgcgggcgtggggcggctccctccggccgggcccggccctggggctccgccgctccccgggccgagcgcgggtcgcccgggatgtgcggccctccgtgcgccggggcggggtgaagccaccgaggcctcgccggggcgcctggcagcttctcctccaggcccattgcctgccgggcgcggggggaagcggccgctgcgggggcgccaggggccgggccgggcggggcccctgcaacccggggccgggcgcgctagccgctccgcggtccccgggaacttccgaaaatggctcgagccccaagcaggggaagaacagcccgggccgcgtgctgctgcggctgcagcgatcggtgcccggcctgggctcggcgctaggagggtgaacccagctgagctgtaaaatgtgtcatttctaacgagcttcgagtttaacgagaagcgtccacttcggttgcttcaaaggaagcaggctggatgagtgggggtattttgaggaggtagtcaagtttcccctccccaccccgatcaagctcagctctgcaaggagggcaggtgggggaccggtgggttggagtagatggtaaatcttgatgcagacctcgtctctttgtgtgttcctagaaatctgggggagttaccttccgagtccctgggtttgcctgtcctggaaatagagtctccaaagattcaatgactgtcgagcctgtggggccccaggctttattagcctgcagcaccttgcagggcaaatgcgaattcttgggtctaaggtgaagtgggcgggtgctcctgggctcctgtactgggagcatgccctgtggtcataacccmggtagcaggttagcttggcggctgaatgagggaaagcagatttttagggagctgcaaaggaggtctgtggctttgattgtggaagttgcttatgtttcctgggttgaatctgggatacttctgtggggtgcacccctgcagcggacccacaaggcaatatgacttttgcaggctgtggttgaagcacagaaggacatttttgtaggctttattgagggtttactatatatctaactcttagcacctaaaatgcattgcttcttaaatttttgaagctagtctgtgggaaagaatatggtcccagttttacaggctcagagaggttcagtgagttccggctgtccagccagcaagagggcggcaggcccctagtatattcattcctggccctctgaccagaagccagggtgcttttctcaggggcagggcgcttgggttcaggtgccatttcttgagtatttttctcactgaatttgagcccccacagccttgccgagtgaccatgagtcgccatcctgtacacctgctgctccagaaataacttgggttcatctgtgcagcatttctcaggaacttcttgtatagtgtcttgtcagaacggtactgttgggaaacttggataatttattttaaaaagaacattcactgagttcttttataagaactttataatatataagattatattatatctttttatatctaatataagattatattatgttttatatctttataatataagaatattctatgttcattgtcaaaacttggaaatcacagaaaagtaaaatgaaccggattggaaatcatctgtcagccaggtacagtggctcacgcctgtaatccctgcattttggaaggccaaggcaggaggatcacttgagcccaggagtttgaaacaagcctgggcaaaatggcgagacctcattgctactttaaaaaaaattttttttttttttttgagacrgagtcttgctctgttgcccaggctggagtgcagtggtgcgatctcggctcactgcaagctccgcctcctgggttcacgccattctcctgcctcagcctcccgagtagctgggactgcaggcgcctgccaccacgcctggcaaatttttttgtatttttagtagagacagggtttcaccgtgttagccaatatggtctcgatctcctgacctcgtgatccgcccacctcggcctcccaaagtgttgggattacatgcgtgagccaccgcgctgggcctctttttttaaaaaaaggaaaaagttgcctgtcatcccatgagctgcccaaaccgctgggaatgaaatgactcttcatttgagttctctgctatttgggagaaakacctgaggccagttcatttcagcatagtttgtccttgggccttttctgggcaccgccttctgctagggggttgtagatgaaagtgcctgctcccagagaagcttgtctaacctagcacagtttctaagctacccaggctgccagaccgagcgaccgtgctgccatggacacaggtgagagaggggtgtcatgagtgcgggaatgaggaagacactggaggggacagtgtttgtgctaggctctgaagagagggctgagatatatacctggtggagacagggagaaagaggagagaggggaaggggctgaccaggagctgcggaaagtgtgggaggaagatgcattttgtgagaagcagaaaaagtaagagttctgagattggcaagaccagggtcaggacctcgcctgcagattggggattgcagatgtggagctggctggaagtccagcctccttgcagaaggtcttttgctgcagttcataggaatcatagtgaaagattacaactgccaaggaagactggggcgcgcctggagtgaggatgacctttcctggtggtctctgctggctattctcagtgaacttccctttgcatttagacgacattttgttagatttctgttggagtttttttaatggacttcccactattcagtctccagaggagtatttgattcagaggagaggcccttaggtgaagtggtggcagagcctgacaccaggcaaacaattgttgtgattggagttttgctgttttgttatctcaaagcaacagaaacgttgcttaaatatgttcataatctcctctccckgaaagtagaagaaccagcgtttttagttctcagtgcttaaggcatccagggttttttgggtaaacaggaaaccccttcacatcccgcatagtgtgcagctctggcctgttcctcatcccgcccccttgcattgcctgatacctccttggtgtgcaggactctccttaacccctgggggagatcttttgagtcattgctgttctttgggacattttctttctcatgcagcagtgcctggctggggcagggccttgaggggttcatccatacctatgtatatcctcagagaatacacaaggtcataggcctcacatttgkgggtcccaagtgccatggggaatcaagacagtctgggccagagggtggcacagggacaacttgctgggctggtgggggcctgtcaagtgaggcctggtggagaaaggttgaatttggagggccaggaacaagctgggatgcaggggaggctttctaaactctacagtgcttctagagatgacgaggaggtagggagtagaagagagcyggacagattagggagctcccagggtgagcttgtgggcaggcctgcagaggagaagaggctcttccctaggagctcagagggayttgttctggaagactgatgggagatgtatgcagctgtttagaggctgctttggagaacaaatgaacatggttctggttgtgcaagcagttactgtggttctttttgctcatatatcttccaataaagacattgagcgaggagagttgataccgtcatgtttttggagcttaagcacagactggcagctgcgggctggattcagtccacagatatgttgggttggatccgcacgtgttcttgaggaaaaaaacaaaagaattgatggtcaatattgaaaaatcaggaagtcactcaaaaatctcaaaagcctggttcctgatttccttgaaaaatgagaatctctggtaactctgagcgcttgttcctgcctacaaggcagctatgggcaggagtcaggtggcggacactcccacagagcccctcaccactcccacagccagccacacctccgacggcccacttggacttttgacatttgcgtttgcatcccctcctcggagaaatgattcatgtttgtttgtttttgtctggactttgaaacctttgccccatcccttcattgactcattactccatccctcattcatcagggattgagcaccggctccatcaggctccgtacaaggctctggggactcagtggtgaactcagcagatgtcgtgctgcctgccctgaatacaggcatcctctgtgtgtcacagggtgagcaggaaggtggcaagagatcagacttgcagtggggagggatggtcaggaaactcctgtgctcctgtgacaaaatgggacttaaggtgagaggcggaggatgggtccacttagctgggcacaggcagtggggtaggggaccagtctcctggggtgggagcagaccaaggcctcctcagctgaagggaagaaggtccttggactgcatgtgtcagtttcagtcactcattcctttcttccytccttcagtggcttcactcatcgcctgcctcacggagcaacctcctgagggcctggagttgttcttgttcttgggacacagcaaagatcccggcctcctgggccataccttctaactgggctggccataagttaagcagttttgtatgtatgtttttaaagtccctttccttcctctctgtgctcccagcgaaccacaggctggctgggagtttcatcatttaccagaccctcctgccagcgctgtagctcctgtcaccttggagcagttcactgggcctgctaaagtggccacaggcttgcccagcacgctgcctgaagatggaataaataggtgtctcacgctcagtgtgctacrgtttcaaatgtgtgaagatgcttttattgtaaatcgaaaagaaatttataatgactgcatttcatggtcacatttttgtcatgatatattttctcagaacagatactaagagtacaggccctatgatgtagggctactcatttttgtggcctgagaaagaggtcctcttagattggcagtcattgtatttcgatcaattttaaactcgtcaaatttgtacttcctttttcctccatagttaggaatttttgtcgtcaaagtatactcagtcaagcaatgagacattttgatggcacctgctctgcctcctttcactcacccgttttaacacttactgagtgcctccttgttggcaaacaccaagtgatgcctcgtggcagggagccagcaggaacctgtccctggaggccacagtccaggggtagaatcagaacgatcttgaacatctctgcaatttcctgtggttttcagaatgcatttatagactacctcatttcatttcatcctcacaacagcccagggggtgagggcagggcggagtatccctcttttgcccctcagggcagctaaggcccagggaaatttggttgtttgcccaaggtcatgccctggagaagtggaatggggaaccggccccctttcttgcctttatagagcactggttagagcctccctggttgctggggacacagctttccatcttaattcttcaggcttctcaatctcttttctgatctttgaaaaaaaagatctaccaatgaaattaagggaggctcactacagtctttagactgcgtctgatactcgtaatactaatcacattaacagtgctgtagagagataagaaatagcactaatgccagctaagtgtgtttttagaaaaatcaaccacagcaaccccaaatgtttcctggtctccagagcagctgttggcagaggcggtttgaatgggattccttgtagccaagagaccttataggaggtctgtagagatgagtcatgtgtgagcttgcagaaaaatgtctcccaaagtagcccggattggagattgccttgagtgccaggctgggtcttacctcaggccagctgagcgtgttccccatggccaggataagatcacgctctggaaagaggagaggcctgacaacccaccgcctgccccaccccgcggccgcctcgccgccgggacaggtgttcctctgactcgtcacccgtcttgccccaaaggctgttttatgagtaaataaataaaacccaccgtttgtgaattattaagggatctgtcatccagcaggccagtcatcttagtttctggtcatctgtttgagaacatcttagttgtgtccttgggtgattcttaccctttcctggggcttattttccccatcagtgccaggaaggagtgggactcaaaaggagcgctcctctgtttgtgtttttaagctgtagccactgcccccgccaaccccgcaccacccccccccccgcccccgccccggcttttttaaattttaagttctggaatacatgtgctgaacgttcaggtttgttacataggtatacatgtgccgtggcggtttgctgcacctatcaacccgtcatctaggtttgaagccccgcatgcgtgactgcaggcccttttttatacataagaaggccattaggtaaccactaatggggaagcctctttgaatgcagtccttcctgcttagctgtggcggaggctcctccttggaccctccaccccaaacacaatgtgaaaacccacttcctcgatgctctcacagctgcctctaccaaaatcaacttcctctgggctctttgtgccttctcttcctctaacatatagtaaattccatggaaatgccccagatcaatgcttgagtagaatgatgtttcactcattcaaaatcaaagccccagtttcctttctgcaagttaaaaaatcaacaagtgaaatgttaaacagatgattagctccgtgagggagtgtgtctaccactgcggtgccattacggtgccttgaacgcaataggtgctcagtaaatacttactaaaagaatgagtgaatttagttaatattatcatagaatgaattttagtttctggttccaagtctcaaattatctttagacgtagcttattgtggtttcaaattgccaattaggatgtttcttggtacattagtaggaccaatatctgatcagtggtgtgcagttagttgggggttctgtgttttcctgtagtcctctgaacactaatgatgaggttaggatcaaattcccagaacaccattgggagaacgccaggacaccgtgaaggctgagccgccactcggttctgatgccgcatccattggtcagtgcacgttctttgagcttccacttgagtgcacgttctttgagcttccacttgagtgcatgttctttgagcttccacttgtagtgactgcctggttctttgggatgtgcaggagcaaagcgctcttaggcaatgctcgttctgccctgtgtttacaaaccaaggcctgtgccagctctactcagcctgacacccataatgagcaccatcccaggaatccctgtccctacttgttatttttttttttttcagttggcctttgaatgtgatttaggactggcttcctgcagcattactctcttttcccaggatgactgtgcagcgtgtgctgtctagggctggggtgcaggctgttggtgtgcctctggcacccccttccttctttgtcaagaggcatgggcagtattttcttgctacttccccctcctctgtgagctaaggtacagggggggaggttcatctgaatttattagaaatctgctgtctgctggtcacaattcctttctcccactttcttctcccaggctgtagtttgaaagacaggtgacaattctctgaacccaagtcccaccctgcagtctggactgctgcttcccggaacaccacgactcctgtaacagcttagacttctgtccccacagtcccttagcagcagctttctctttgcttttcactggcttgcccaaaccacacagtgactttactgcatattaagttttgtgatcaggcgattctgcagtgcttttaaagcgtagaaatggagcactgagcacaggatgctgtgtggtttgcccagggctgggttcagaggggcggatttcaggcatttgctctatagcttttaaaatttgtgccactgatgtggacctgacagatgcgattcccagccacacactgtattgttaaaaacggagcaggagtgtgacactgacagtaactgagagaaggaaggacatggaatgagaagagaggacagctgacatccagtggaatgtgaccgtgttaaatagccacttagctgaccccaaacgagcaaacaaacaaaacccctggttggaaacagtggttgtatttatttgctggttatcacatgcgcccatcctccttcaagtgatggttctgaataaatagatggatgattgttcatgagtcatggaattggctactctcaacccctcctttcaataataaatacaaataatagtagtagctgatgttcattaggcacttaccacgtgctgtaccaggctcgcttctgtatattttacacttgtggttgcatttaatccttacaataggagaaaggtactgttaactgttctcatcctacagaggaggagactaagacacagagcttttctttgagacctgaaagagttaacrtttgcacatagtcatatactgagttggggcaaagttaggactaaagcccatctgactattccccatgcatctatatttttattgattctgatattattctcttggctgtgtgacttgggtgaaaatgagccttcatgtttccagggacccctctgccacagaggcagctgctgcactaacaggacaccccatcatcctgaggrttccttcagaagacagctctcctcctgactgtcctgctggagctcacagggggctgcggaagccttgcttctggctgggtgaccgtgggcaaattgcttaatctcctgagcctcaggtgcctttgttgtaatttggtagggtggataaacccaccccggagccctttctaatgctggttcttcttcttttttttttttttttttgagatggagtctcactctgctgttgcccaggctggagtgcaatggggtgatctcggctcactgcaacctccccctcccaggttcaagcaattcttctgcctcagcctcccaagtagctgggatgacaggcgcccgccaccacgcccggctaatttttgtatttttagtagagatggggtttcaccatgttgaccaggctggtctctttggccaggctggtcttgaactcctgaccttgtgatccgccgcctcagcctcccaaagtgctgggattacaggtgtgagccacctcccagcctaagsctggttctttgggagtctagactgcagtatgtggggtggacttattgaggcttgttttgttgatgatttttaatggcagtaaatgttggatagcacttaactaatcatcaaaatagcttttgaaacatttttgtacacattagtttctttgttgttttgggctttgttaattwgtttcyttttttttttttttttttttttgagagggagtctcgctctgttgcccaggctggggtgcagtgatgcagtctcggctcactgcaagctccacctcccgggttcacgccattctcctgcctcagcctcctgagtagctgggactacaggtgcccaccacttcgcctggctaattttttgtatttttagtagaaacggggtttcaccatgttagccaggatggtctcgatctcctgacctcgtgatctgcccgcctcggcctcccaaagtgctgggattacaggcgtgagccactgcgcccagccaatttgtttcttatcataagtatggagttgcccaagatttttcccagatgaggatgatggcagctcacatttattatttcctgtgtgccgggaacgatgctaggagctttaccttcagacgtgtgtgtgtgatttaattaattctgttcttataaagagtcagcaatggcaggtattgtgcccatttgacagttgaggaaagggaggcagcaagagggaagtgactcgccaggggtgggttgtgtattgctgagaactggagtttcacttctctccccttcctggggtctagggctgacttgccggcaccaccactgccttgggttggaatgtactctggggttcccccggggctttccagcctctctgtaggactgttaaggtggcaccacatctgcctacagatttatgaagaagcccctggtttctccattattgaagtggcttaaaaagtacatttgctgaaaatattgcatgagaatctgctttggagaaacctttcacagatggcacaacggtaggaagtggcccttacgagttaaagtagttccacccacccacccacccaacactggctgtcactgagtgtcaagcagcctgccaggggaggagagggtactgagagggctgaggcgtcagtgcccttggggaactgacagtcagccaccacctgcgttgtgtacaggagacttttgatcttggctctcacaccctcatccgtgttagaggcagcatgagcctgagctgagagktgggagacctgcctcatggcccctgggcctgcactgatgcactggatcagtgcccctccccaaccctgtctttccatctgtgcagtgagccagtacagaacagtgtctgagagcatgtgcttcaggtcctctagctgtggctttagataccagccctcctgtgtcattgttgtgggatcttgggcatgtcactctgtcttgtctaactctcagtttttccttatctgtaaaatggggaaaatcctaacagtacctaccttatggtattgagggagaattaaacgagatgatgtacataagcatttaatcagagtctggacacataagaagtgctcgataaatcttagcttttgttcttacttcaggtcgccttctactctaaagtgaccatttctttaaaaatggtaatctggtaactaaaattcaaacctcagcactcacagagaaggggaggtccctgactattgaggtatttccttttaggctggtttgttctttctctttctctctctaagaaagctgaagtccagggagtaggtttttacaattaagtaataaacttttgaagtgatcactcgtaggaagagtagagggcaattcatttcagctacacatatcccagtgcatgcaggcagaccaggaggccctgattttaatttgagtctgtctggaaggaatgggcctgtgcttgcaggctgtggtatatgtcagagccacagcagggctgatacaccaacaggtatattttttgccctgtctcaagggacacctccccagtttctccttgcggggtgactttcggggattaattaaatcatcttcgttcagctctggaggtgaaatgatcacagagtgttgcatttgtgacagttaaaaaccacaagacattcaaggtcctcgtgtacaaagtaacttacaagttgcattgagcactgcaagaagggggatttcataccctttatttttctttcttgattaactttcacagtaaagataaattcagaaatgctgttttggtgttctgagtcttccttaacccctgctccactgggaatttcgggtatgtgaaagtaaatgtgtgtagtctccttgcaaatttgtcagtgcagctagcatgaagcacagtgctatttgcagagagaccaaagcccagtcaacccttttcactttctgtaatcatttggtcctggagctacagaacctctcaattagcataaccacactaatttgtgcttctgcctcagcttgtcaagagtgccttgcaaatattaattctctgagctcatcagaagaccaaaggcatagatcaaaagcatgcttttctgcatgatctgtccttgtttttttctgttcatgaggagctttctctattaattaccctaaatatgcaaggttgtagaatgaagcttttatatttgacaagtaagaattgggctagggacctggattacagggactcgggctagggactgcctgtgctgcaggggtgcggagttccctggcctcagcttggcrggagaaatgcacgtactgctgaggaaattctgtaggctaaagtcatggggagcgtgtgagtcatgatcaccagaaatgcctggacctgtggcatctttgggyratgaagagggaaccagcttagcactgccacagacacaccatgtcctctggggcaagccaggattccttcctgggcctctgaaccccactctataattggagggccttgaactggaacagaggttcctgagctttttaagatcataggtctcccaggagtctgatggaaactctgtggaccttgtccccagggagaaagattcattatgtgtggacatgtttctgccaagccgtaaattcccactactatatgataagtgagaattcgcaaatacccggggtcttggaaagatcaaatagaatttttgttgtctgaaacaatcaggacttagttcagtcaggtctgagccctagtaacagtaattatgcattcccagaatttggtaaggattttgtgaaatggggcttgtaagctgctgggtggaatacctgcatggataaaagggggaaccttccccttatgggtgaggtttaaaaaaaaattatgtatagtaaaattgatgttttggggatatacagttgtattttttgtttttcatttgtgatggggtcacactgtcacccaggctagagtgcagtggtaccatcgtggctcacagcagcctcgacctcctgagctcaaggagtctttcaatttcagcctcttgagtagctgggactacaggtgcgtaccaccacacccttttcatttaaaaaaattttttttgtagagacaggtttccctatgtttgccaggctagtggggtataaagttttgtgcgttttaacacgtgtagatttgcataaccactaccacattcagaatacaggccaattccatcaccctgagtgaaaaagccttcttgccgcccctttgcagtcatacccttctcccaccctggcagcatggatctgcttcctttctttttttttttcttgagacagagtctcgctctgtcccccaggctggagtgcagcagtgccgtctcagctcactgcaacctctgcctcctgggctcaggtgattctcctgcttcagcctcccaagtagctgggattataggcatccaccaccgcgtccggctaatttttgtatttttagtagagacgggtttcaccacattggccaggatggtctcgaatgcatggcctcaagtgatctgcccgcctcagcctcccaaagtggtgagattacaggtgtgagccactgtgcccggccagcattgatctgttttttatctatacctatagatttgcattttccagaataccgtgtaagtacaaccataaagtgtgtaatcggccttttactctgtactgactttgagactcgtcaagttgtcctttttatcactggttcattcctttttattgctgagtagtattctattgcattgacataataactgcttatctgcgtgagaatttgaccttggctgactatctgtctgtttgctagaaatagacaaagatggcacaggaccaacaaaaaacaacccaattttggccgggtgcagtggctcacacctgtaatcccagcactttgggaggctgaggcgggtgaatcacraggtcaggagattgagaccatcctggctaacatggtgaaaccccgtstctactaaaaaatacaaaaaattagctgggcatggtggcacgcgcctgtagtcccagctactcgggaggctgaggcaggagaatggcatgaacctgggaggtggagcttgcagtgagccgagatcacgccactgcactccagcctgggtgacagagcaagactccgtctcaaaaaaaaaaaaaaaacacaacccaatttttaaatgggcaaagggcttgaataggcatttctccaaaggagatatacaaatggctaataaacacatcaaaatgtgctcaacatcactgatcattagggaagtgcaaatcaaaactacaaacagagctgggtgcagtggtgcgtgcctgtagtcccagctactcagaaggctgaagtgggaggattgctttagcccgcaaggtcaagactgcagtgagctctgatagygctgctgcgctctggcctgggtgacagagtgagaccccgaaaaagaaaattagctgagcatggtggtgtgcgcctgtagtcccagctactyagggactaaggaggggactgaagcagggggattgcttgagcccaggagttctgggctgtagtgcaccatgcctacctggtgtctgtactaagttcagcatcaatatgttaacctctgggactaccacgttgcttaacaaggggtgaactggcacagagtagaagtggagcaggtcaaaactcctgtgctgatcagccctgggatcacacctgtgaacagccactgcactacagcctgggcaaaatagtgagacccccatctcattcattcatacatacatatatatacgtacatacatacatacctaagtacatacctacctaccacagggagataccagctcacacccatgaggatggctgttttcaaaaactcagaaaatagagcttgcagatagctgaacaggtagcacagctggggaggatgtggaggctccgtgccccttctcacaggccctgcccagtgcagctcttcatctgtgtcctttgtaatatcctttatgataaatgggtaagcacaaggcagatggaattaacagactgtggctgctgtttttaaacagggtttgccaatatctgtgtgtctcttgggaggatgaggccrtctttctgcaacaagggagaacagaatcacaagatctttagggggggaccttgacatttcctgtggcagatttcagtattgctggtcagaactcatttcatccatcagagttgctgtaggctttctttctaagttccttaatcatctttagccttccttggatttaccaggccgtggatgctgaaaataacaatcctggtgttttaggacaggagtggacttttttttttctgagccggaatctcgctcagtcgcccaggctggagtgcagtggcgtgatctcggctcactgcaagctccgcctcccgggttcacgccattcttctgcctcagcctcccgagtagctgggactacaggcgcccgccaccacgcccagctaattttttgtatttttggtagacacagggtttcaccgtgttagccaggatggtctcaatctcctggcctcgtgatccacctgcctcggcctcccaaagtgctgggattacaggcgtgagccaccgtgcccggccgagtggacttttttcccatgaaccctatgggcagtctgctacttcgtatgtgtatatggccttcctgaaagcatgtctgaaaattgaatatcaaacctgtatcttaacaatacactgtcagccrgacactcacacagtccgatgagttacctgagtgaggatgaagatctacagctttggcatggccactcacctctgtcttctctcggcagtagtattttatgaaacctgtgtttttcactggtatcaactattccattttctcattttcactactttttataaaatattaatggcaaaatataataaagcagtcaaactctttccacagcaacaatcactgccaccacaacaaaaacaccccacagaaaataagtgttgtggagaatgtgggggaatctgaacacttgtgcgctgttggcaggactgtaaaatggtgcagccactgtggaaaacagtatggcagctcgccaaaaaactaaaaatagaactaccacatgatccagcaaagtatatacctatgggtgtgtacgcaaaagaagggaaagcagggactcgaggagacctttgtgtaccatctctgtagcagcatcattcacaacagccaaaagatggaagtgacccaggtgtccactgatgggtgaatggataaagaaaacgtgggctgttcatacatggaatattattcagccttaaaaaggaaggacattctgacatgttccagtgtggatgaaccttgaggacattatgctaagtaaaataagctagtcacaaaaagacaagtaccatatgattccactagaccgtgaggtgcctaygctagacaaaattatagcaaccgaaaggcgctgaggtggctgccaggggctggaaggagggaggaatggggactatttcagttttgcaaggtagaaaagttatggagatggctgctggtgatgatggcacattatgaatgttacttattaccactgaagtggtaataagtggtaatcactttaaaatgattaagatggcaaatgttatgtgtactttaccacagttttttcaatgtttatataattacataatttaatcttaaatatctttttaaaatttttatttatttatttatttatttgagacggagtctcgctctgtcacccaggctgaagtgcaatggtgtgatctcggctcactgcagcctccgtctgctgggttcaagtgattctcctgcctcagcatcctgagtagctggggctacaggcatgtaccaccacacctggctaattgttatatttttagtagagacagggtttcactatgttggctaggctgstctcaaactcctgatgtcaagtgatctgccagcctcagcctcccaaagtgctgggattacaggcgtgagccaccatgcctgccccccgccccgttgtttttgtttgtttgtttgttttgttttttaaatagagatagggttttgctctgttatccaggctggagtgcagtggtgtgatcatggctcactgcagcctcaaactcctgggctcaaggaatcctcccgcctcagcctcccaaagtgttgggattacaggtgggagccaccatgcccagcccatgaagcttttaatccagggcagatcctgcacctctggatggggacccagtcatcttggacctgggcctttcagctgtactgggcccctgctgtcccctggcaagctcccattcccatcaggggccgatggaagtccctgggagcctaaatgtctagttgagctctagcccctggtggtgatatagcttggcgcgtagttagtgcttggctcatgtcggctgttagtaaagactctcaagctctgcattggcttccctccgagggctctgcctggatccatcagcagcacttactctctctgagttgacaacacagatggcacttactccagagctgtttggcaggattccaggctatcgccacgttcttgagaaggtatcactggcttgggggaggggaaaagagaggacgatctaggcaaaagcaagatcaaggccctctcyaagaattttccagcctggcaggccctgttaggtggcatggtaccgctgtgtgagtgggagcgccacctggagatggccacgatagggtctctgttcccacgagtatcattaacacgtctctctatgaatctgggtgataaccaattaccttggggtttttttttgacactaagacaccaacacatataagacatgtaaggcgttatcgatttaatgtttctcaggaaacaaaggagaaaatacattagcaggtggattataaaacgcaccttgatttcaaaagtgaagctgtgaaaaactacagtatccaagggagattgatttttgggacccccagtggataccaaaatccacagatgctcaagtccctgatgcaaaatggcatagtacttgcagataacctatgcatcctcccatatgctttaaattatctctagattacttacaatacctaatacagtggaaatgctatataaataggtgctataccatcttacttagggaatattgacaagaaaaaagtctacgtgtttcagttacagacacaaccatccattttttttttttgcctgaggttggttgaatccacagatgcagaacccatggctacagagggccaaatgtctgtgacttagaatcagggagatacagtataagccactgacccrtcttcgagctgaattcttcggcgactattccatacagttggtggcaatagatgcctggaacactggtaaagaagtcaggtctcctgccctcatggagcttgctgtgactgggtccaagtacacccctccaaacgagacttcgccttagactgaagggttggactctggatttttgcttgtcaatgcacctctcttctagcctcttagttagatatccggacaccagaggaaaattaccctgaggatcaccgtgctgacagagcgcgtgacagatggagggatgagcacacttcccggcttctgcctgctgtcctggcrtcattattaacagagtcctccctacccccttcgaaatgtcctgatttggatgagaaaacactgagggagtaatcattaacatctatcgcgttccacaaattcgcactggagagggtctgggtttgcagtgagagaactgcttcaggtccacagcctgttctaatgcaggtcaagtccatggagtctgcgggagggtcggtgggattgtctggggctccgttctcccatgggcatctgctacttggcatgttccagtcactcctagaagcatcaaaatctgggatggtttggttcaagaaacataaacatgtacatrtaacaaccagatcacattatcttaaggtaaaaatcacatcaaatctcaaattgttattctttggaatggatamaarggatattagtatttttgtcaatttaagttttatagagaaagttggaaaaataattatatagggacacttgtcttggttaacttggacagagatttttttttctgttgctgtggaaaagatacaggcataggatttttctaagaagtttcattttttatgcaagtgatatactgtgggaggaggttaaaggaaacagccagaaagacaggtaagaagcttgatgtttgtgacaaattgataacttgcagcctgtgatgttggcaggtgttgctgacagggtcatctggggccaggtggtcgctgtcctgaggacctgccgggtacccagaatgctgcctgcctgttcggtggctctcaaacgtcagcacctggaggtttctgggctctggcgcctggtttctgattcagtaggtctgtggttgggctgagaatgagcatctctagcgagttccctgggtgacactgctggtagaggtggggggtatctttggaaccaccactcaaagtctggagaggaattggaagggtcatagggacttacctgtaagataaaaggttgcccttataataataatgatgatgatgatgacgtaacaaagaatttctgtgcagtaatgccaggagctgtgctatgtgtatttaatcctctcaaaagcactggaaggaggtgacagtggcctcattttacagatgagaaaactgaggcccaaggctgggcacggtggctcacgcctgtaatcccagcactttgggaggccaaggtgggcggatcacctgaggtcaggagtttgagaccagcctggccaacatgatgaaaccctgtctctactaaaaatacaaaaattagctgggtgtggtggcccatgcctgtagtcccagctaatcgggaggctcaggcaggagaatcgcttgaacccagaagggggaggttgcagtgagctgagatcgtgccactgtacttcagcctgggtgacagagtgagactcttgtctcaaaaaaaaaaaaaaaagaaagaaagaaaagaagaaaatatagctgtgtgggcaatagtcagatgaactattcccctaactttgccccaattcggtgtatgactatgtacaaatcttaactctttcagatctcaaagaaaagctctgtgtcttagtttcctcctctgtagaatgagaacagtaacagtatccttctcttatcgtgaggatctaatgcaaccacgagagtaaaatacacagaaaggagcctggtactgcatgggctaagtgcctaatgaacatcagcttactactatctctccgggtgacagagtgagactgtctcaaaaaaaaaaaaaaaaaaaaaaaaagccctgaagggtttatgtgacttgtccagctgggttgaagagctaggttgaagccgctgcccagtattgaaacaaacccttataaaatagagaagtagcttaataatagccccaaaaagacatcacagactgaagacttttctagtagtataagtacacgtgaacaagaaaatggtgacacttctgcttccagttcatgcttcttgtcagcagtattgcgagggaaaaacaacagtgatctaatgagccctgacaagagatggccagaagctgagcagttgggaagaaaactctttggtgaatctcactctgaatgtatattgtgccttgggatattagctgattaatttggatgacatattagtcatgataagcaagacatttacaaactaagcatccagaacgtgaaaactaaaattttgccaagcaccgtggcatgtgcctgtagttccagctactctggtggctgaggtgggaggatcacttgaacccaggagttcaagtccagcctaggcaacatggtgagaccctgtctcacacacacacacaaaaagccacaacctctaaaatttaaattatatctgaagtcacgcagtactcccatgagtaattttacagcatcaagtgtacgtgctctgtaaagggtttcatctcagccttctgttttgggctcttctgtctcctgaattgccatttgggaacaggcagcctagtcccgtggcactaagccagctagctaaacactggtccttctcaaatgcatgtttccagcccctctttaggacattatgcacctgaaccagaactcttggttctccccttcactctctgcctggtaactcaccttgggttcccctatcacagtaaataatgccatttttgatccgattgttcaggcttagaaatcttggtttggatgagaaaacaatgagggtgtccttgcctcctctctcccagcgcacatccagtccctcggtaaacccctgcgatttactccaataaatcctgactggtccttcttagtacctcctctgctgaccccttactccaggccaccgccgtttctccctggactgccccatgccttcctaaccggcttcttggtttcttctcccaactcacagccattcattctgcatttcacagccagagtgtgaactggatcacatggatcctctttatgattgcctggggcttccccacacatgtgaagcgatccgaggtcctcgacgtggcctgtgtgcgccctggactctggcccttaactcactccctgacacccctctccccgtcactgtgtcccagccacactggcttttgtgctcttcttccaggtgttcctttccctcagagccttggcacttgccgttctcttactggaacattcattccccagatattgtagggcacctgctgagaagccatggacaagagccacggtttaaaggctgctggtgccaccgtttgctgatcatgtgatcttgggaaaagttgctcacccatctccttttaaaaatcagtttctcattgataagatggatcctgcggtagggttttggtgagttcatgctggggagtactcgattggaagaactgggcaaacatgagttcctcttcctgtgtcctttgctccctatccctagctgcctcacatctttgttcagatgccacccagagaggtcagccctaaccactgggcccagaataacagatagggtgcgcatcactttctgtccctcatcccccgctctttttccccctttaaatgtagccttttttttttttttttgagacagtctcactctgttgcacaggctggagtgcagtggtgcagtcttggctcactgcaacctcttgggttcaagcgattctcctgcctcagcctccccggtagctgggattacaggcatgcaccaccatgcctcgctaatatcttgtgtttttaatagagacagggaccatgttgccaagactgatcttgaactcctgagctcaggcaatctgcctgccttggcctcccagagtgctaggattacaggtgtgagccaccgcgcctggcctatttgcttcttttttatgatattttccctcattgggaggtaagctccctgtcggctgctatttcaccagagcccagaatggtgcctggcacatagctgacgctcactaatttttgttcagtggatagtgagtacccattgtgtatggactccacacctcttaagggagacaggtgcatttttacaagcttgaggagcacagccagagtgcaggctgtgaccgtgttcatcctcatgcagctcagtgcagagggccatcagcagtgagtggctctgtcaagtttatctggaggcggggagttgtaaagggcagaggcatcacagcctggaggctgaggtcagcgggctggccaggagaggggctggagtcttccccagtgcgggcattaccccttccaatactgccatggtccaagtgaagcagaggctgtgggacccgaggctgtgggaccctcaacactgatctttgagagtccactggatgttggctgtgaggtttcctttgactcgctggagaggagggacaggagctacagtgcaggcaggcaggtgcacggctatgcacagtgtccagtcgccgtgtgaggaagtgggagatgaaggtgggaaaggtaatttggggccagactccaaaaggccttgaatgccaatccacgtacttaggacttctacctttagtattacaggaagcatcgaggggtttttattattttatttttttgagacagggtctgcctctgtcacccgggctggagtgcaatggcgcgatcttggctcactgcaacctctgcctcgcaggctcaagccattctctcacctcagccccccgagtagctgtgactacagacacacataacacaatgcttagctaattatgtttttcctttttttgtagagacagggttttgccatgttgcccaggcaggtctcaaacgcctgggctcaagtaatcaacctacctctgcctcccaaagtgctgggattacaggcatgagccatagtgcctggccacatcaggggtttaagaagcattctccttacatatttagactttccaccaagtcttccaaatttctccctttcccatactgagggctacgtttagttcctggccaagtcctgactttgtaaagaacaacaagtaaacagcttcttcagaaggctggatgctgagccctgattgcccttcagtgaaccagcctcatccatgaagcttcttgaaaagccagaaactgtmtcattgggggggtccttgaaatctgaagcaagggacaggttctgagcccctgtgttttgcagattaggttgcacaagaaagatgggctggtgactttgcagttcatttccgtagattgtccttctaggcctgcctggatagaagcagcctcgtgtgggatccagcagcagtggccagtgggatgggagccagcatatgtagttgttgacacatcccctgcagacgtgggtcggcgggctagctgtgggagagcactgcaatgggagtcagtgacttggggcctctagcctcctgtgaaaggtcttttttctctggacctcagtttctccattttattgtaatgagttgggctagatcagtagttcttaacctcttttttttttttttttttttgagagggagtctcgctctgtcaccaggctggagtgcagtggtgcaatctccactcactgcaacctccacctcccgggttcaagtgattcttctgcctcagcctcccgagtagcttgggagtacaggtgctcaccaccatgctcaggtaatttttgtattttcagtagagatggggtttcaccatcttggccaggatggtctctatctcctgaccttgtgatctgcccaccttggcctcccaaagtgctgggatcctaagtacagacgtgagccaccgtgcccggccattcttaacctcttgaaactccttaagactttggtgaaagccatagacctctcttcccagaagaatgaacacgtggtttgccggcaccttargaacccccaaagcccatgagacaaagccctggatctataaggccctgtcccatctgacccccggccttcccctgggcacatacctccagctacacaggkctttcatacacactgcccctttgcctggtccagctctgctcatccttcaagtctcacccttccctgacttccagcttagattaggtcgccctgctagacatgcgtcccccaccctgaatttagcactgatcaccgggataactaagtgattcttcgtgcatgttatccgaccctccccaagctccgtgttggtatttgttgagtaaatctctgaggcccctccagctatgacattctgagactgatctataagtttgcagatgtgtcataagagagtccctgagcttgtatttcctatgacattcgacacgtggtggcctttgccttcgatgatttcctccaggcctggacaggaaagttacttcaaagcagtctcggccagactcggtggctcatgcctataattccagcactttgggaggctgaggctcgaggatcacctgaggccatgagtttgagaccagcctggcaaccaagcaagatgctatctctacaaaaaataattttactaattaaccaggcatsgtggcaagtgcgtatagtcccagctagtcaggaggctgagacaggaggattgcttgagcccagcagttggaggctgcagtgagctgtgattgcaccactgcactccaacctggacaacagagggagactgtctcaaaaaaaaaaaaaaaaaaaaggcagagtctagaggaccccagaagacagaagagtgcctcccagactttctgcctcagtgctttgctaggcctgacctccaggctggtcatcgcttttgtttatattctgggctgagctggaactcacacttggaacattcccacagtgcttggcgcttcctcgtattgttgtatttttctccaggagggaagtgaccaacatcagactttcctcccagcagacaaattccatacacaaagctttgtgtgagctaccgggtacccgcctgagagcccagcctctgtttctttggttctgggtgggtgagtgtgcacattacagggatccacgagcccttcccttctgagccatttctatctaaaaaaaaaaaaaaatctccttcaagaagtgagcaccgccttgcaggatcctgactcagagttcgtctggagccaacagcgtcttgcgtgtagggacaggcactccttaaaatgtttcctacttcagtggccacaatattacccctctggcttatgtcatgttccacaatcaaaatatcattcctcctggartccagctactcgggaggctgaggcaggaggatcacttgagcctaggagtttgaggccacctgggcaatatagggagaccctgtctcttaaaaaaaaaaattattcctgaggtacagatgtttgtaagataaattttattttaattatactaagagaatgattatttactagaatattgcagtggatcttactctgatatgggggagaaaatccctagtgagggtaaataatttttttcaatgtattgtatctaaagcttggagatttataggtaataataataaaaacagtgacagctattctcattgagtatctgctgtgtaccaacaaattttaaacatctttattttagtttagttttttagagatgggttctcgctctgtggcccagactggagtgcagtggtgtgatcacaaatcactgcagtcttgacctcctgggctcaaatgattctcctgcctcaacctcccacctcagcctcccaagtctgaattcttatttaacctttaaactacccatgaagtagacagcataatggtacacatgaatgtatgtgaaaatacaaggtgtggaaaggtttagtttctatcccaaagttgttcagctaggaagtgcccccatagattcaaaccaggccagctggccttcaaagccaattccttcacactgccctcctgcctcctctggtcatgaggaaatgggtagcagaggttttcctagccaaggataaagatttgggggctggatccagccctccaactaaatgcctagcgttgatccctgcccctctctgaggaatctgtgaaatggggaagggagtcgctggagcagatgatcttgtggatctccttgggttttacagagatttgaggcttggagtagtcatacctgaaggagtgaccttgataacacatggccaggtcgggtctgattgaaggcagttcgtacagccacagcgttctcggcgtatttgtgcaaggcttggaaactcatcacagtggctgtgcagtcagccttctgcttctggtaacagttcacttttgattcttcccatttgtgaagaatcagaaaaattttctgttgtctccctgaaatgtggactggagatgggtcgcttgcccatcttggattgcaagcatattggtctttggggatggctctatgtttttttgtttgtttgcttagtctgggacactgcagaggggatgactgtaaaagacgctttctgagctggggattagagaggaattcttaagattaggttattctgttgctctccccctccccctacccctgaacagttcacattggagttattttgggggagccatgattgagaagggttggaccacagggtcctcatttcaaagctgttctctcaaggaaaaatgtccagttcattctaaaggttcatcagtatattagttgtttggaacctaggatgcgttttttcatggaaacacagttacaaatgtgttggcccccagctgagaaacgagagagggcacacctgagcccaggttctgtaactgtgacccattgttgtctgtgtgcacaggcgccaggaggagctgccccagacacggctcctgacttcaggggcttcgcactcctgatagggaagaaattccagggccyrgagtggcctgagctaaggagtggggaagtggaggaaacagcgccccagccgcccataccctctgactcttgctaggagaggagaggttgtttatggattagaaactctggttaatgcattccagggggtggggacaatcagtgtgtgtatgttggggataattctcattggtttattctgtcacctatccactcatttattcaacagagagttattaagcacctactgtgtgccaggtattctgctgtgcaactgttagttttcactggacccctctcgcgtggtgggggttccctgtgctttattccagtttgtggctgcagtttaatctggggaggagcttgcgggctctgtgagggaaacagggagcctctgcacccatgctctttcctgccacctcattggagacggtgcgacagacacatgccatttgctttgccaagtttggactctcaggccgtgattttgcaaaaatgatctctgtattggtagatcaattatgaggccttaagatcttgtagagatttggattttggtttttgtctgttttgcataaattggaaagattatttccccttccttcagaaaggaagggcctggtttaacacagtggcccactgcgcccagaaacttaacagagcattaagtgcctcttaaacttggtctctctggttctgtgggtcttttttggaatgttgtcccaaatattactccggttctatacttgctyccattttgtaccatccaactctgtaaaataaatttactttggtgcttttgactaaattgaccgaagccagatatctgccacctaagctaatgtattttcygtctacaattataaaagtgatgaagggctgggcgtggtggctcacgcctgtaatcccagcactttgggaggccgaggcgggcggatcacttgaggtgaggagtttgagaccagcctggccaacgtggcagatcccccatctcgactaaaaatacacaaattagctgggtgtggtggcgcacacctgtaatccagctattcaggaggctgaggcaagagaatcacttgagcttaggaagcagaggttgcagtgagctgagattgcaccactgcactcctgcctgggtgacagagtgagactctgtctcaaaaaaaaaaaaaaggtgataataggcacagtgcagtggctcacacctgtaatcccaggactttgggaggctgaggcaggaggttcacttgagaccaggagtttgagaccagcctgagcaacatagggagaccctgtctctacaaaaaaatttaaaaattagccaggcgaggtggcatgcacctgtagtcctagcttctttggaggctgagggaggaggattgcttgggccagggaggttgaggttgcagtgagccatgattgcaccactgcacgccagcctgggtgacacagcaagaccctgactccaaaaaaaaaaaaaaagttaaatattcaccagggacctcctgagtgtcaggcagcatgctacgtacttcacaaatgttctcttttgtttgattcttattacagctgaggaggtgagactggaattatgcccagttaacagataaggaaactgaggctgctgtgctcaactggcaaagccaaggggaagagctagtatttgcacccaggctggagtgcagtggtgtgatctcggcttactgcagcctccacctcccaggttcaagtgattctcctgcctcagcctcccaagtagctgggattacagcttcgtcccaccacgcccggctaatttttgtattgttagtagcgacagggtttcaccatgttggccagtctggttttgaactcctggcctgaagtgatccacacacctcagcctcccagagtgctgggattacaggcgtgagccacctcgcccggctcagagcctgcattcttacccatattatgctgtggggattctttaggggcttttataacctcaaactctgggactgaaataaatgaaatcttttcatccacctcgacattgtcttcctttttaccaagaatatgtgattgatttcattcccttcttttcttctagaaaaccctttgttcagaatttaggtagcgtagcactttctccagcaaaattgttcccaaagtgcagtgggagtttggagcttggggttataaattcttagctgtatttgtccccaaggtgttttcttctttggagactgaggtgtagcagtgttttgatgttttgtttcgttttgtgtttcccttggaaacacagcattagtgaaatcagcttgttttctctgacagtacttgttacgtggtgcacactggtctgagcgtgggactctgaaatagaaggcgtggcataagggtctgtatgaaaatgtttctcctggcatgccccagaatggttcatttatgactttcagcattttgatcacctgattccccatttctcctgcggagaaaagtggtattaaaagtatttggacataaaattcatcttgcaagccgctgttgtgctgatgagtaataaagtgtcaaaaggatgctgaggaaagagcttcttaatatagaccatgcctgagaggcaccggtagggcgataacaagccctttcttctgatttcctccctggggccaaagggattttgaaaggcagaaggcaaagacttgagaatgagattcctcaggcttcccttgtgaggctgcctgggttctgccgctgggtggtttgggatgtccaagagatatcccctttcagccagtgactcggtcctcagttgctgctccggaaagacgctggggctgggaagggccctgtgtcctctggctttaaaatgggcaatgctattgaaaaacagaagcccttgaaacgaagtcatctgtacccctggaaacaaggtaagaaagccctgggcttcctttccaggaagaagcaaggaggcagttttctctgagagactggcccagcagcagagctgaagtgcctggggaatcaccttccagagcagaaagcacaggtagtccaacatgatttcaagaaaattcacaattctcctgaggaataagatgattcctctctcaatatgatggcttggtttggctgagagtttagttcagctcgagatgtttcatttggtgcagtatgtgtctgttgaaaatttttattttttttgaaatggagtctcgttctgtcgcccaggctggaatgcagtggcatgatctcagctcgctgcaacctccgcctcccaggttcaagcaattctctgcctcagcctcctgagttgctaggattacaggcacccgccaccacgcccagctgatttttgtatttttagtacagatggagtttcaccatcttggccaggctggtcttgaactcctgacctcatgacccacctgtctcagcttcccaaagtgctgggattataggtgtgagccaccgcgcctggctgaacatttttacttttttagaaatgttccaagtcagccaggcacaggggctcacgcctgtaatcccagcactttgggaggccaaggtaggcggatcacttgaggtcaagagttcgagtccagcctggccaacctggcgaaaccccgtctctactaataatacaaaaattagccaggcctggtggtgggcacctgtatttccagctacaggcataaggctgagacaggagaatcgcttaaacccagaatgtggaggttacagtagccgagattgcgccactgcactccagcctgggtgacagagtgaaactgtctcaaaaaaaaaagaaagaaagaaagaaaaagaaatatcccaggtcaaagctttgatatctaggagtttgaggcttttgtgatattttttgatttagataatgttattaacagcttttaaatatatagcacttccaaaagttccaaagtactttcaaggtactttctgtaaaatctttcatttatccatcctggacacccaggaagtgggacaacagcctctcttaacacctactctgtctctctagggcttggggtcatgtcagcttgaggaggaggaagttggcagggccacagagcagtgcagtggtacatttggagctcaaggacctttaatagtgtctcagtgcaggacagtctgttgacgcactcagcggccttttatcacagttattgacccaggagaccggccggctggcaggcatgccagagatgacataygcgagacttcaccaggtctttgcctcctcttgccagaagaagttgcggtagcatttgatcagtagcaagacagttttttcacaactgcatatatgggtgtgtttatgaaaagaaaacaaataactggaagaaaatgcatggaaatattaagagcagttgctgtttgtcaaatgatagatcattttctcttaaaaagaaagtaggtgggatgctaatttactgtcaggttccagcccttctgactttctgtgagtcattcttttgtctaacatgttactttggaaagggtactccttagcaatccttgattggatccaagtttgaacaaaacggctattaaagacattgggggacagttcgggaaatttgaatatgaactccatggtggattataatgaggaactgttgctcatgtgattatgtgtgaaacggtgctgagtcatgtaggagtgtgtgcttttttgaatagtcatgctgaagtatttaagggtgaagagttatgctatctataatttactctctaaaatcataatcactctgtgattttccctgtatacacgttaataaatttgtatgccttttctccaattaaaaacaatactgtaatcccagcactttggaaggccgaggcaggcagatcacatgaggccaggagttcaagaccagcctggccaacatgataaaaccccatctctactaaaaatacaaaaattagccaggcgtgctggtgcacatctgtaatcccagctactcgggaggctgaggcacaagaactgcttgagcccaggaggcggaggttgtagtgagctgaggtcatgccactgcactccagcctgggcaacagagagagcctctgtttcaaaaaagaaaaaatcaaaataaaaaaacaggttcagcaaaatatactgtataaataaatggggacctaagataagcaaaatgggataagtttaacaagtgttagagtccaggtcatcgatatatgaggtttgttatactttctttcatgtatttttacacattaaaataaagaaccagttctgactgtgtcatacatagtacagtgtcttcagaatgggccttagcagacaccggtatttactgaagcagaccaagatgcggtactcttctgaattcagcaccgtgtgggctggtgtctccagccagccaggagaaaatcagcattgatccaactacttaaaagcaccacttttagaatagaaatttaatatgtttacttacgtttggattgtctctggttctccttagaaaaccatgagttaaaatgtctgaagatkttcattggaagcagctgggtatacagacagacaggtttgatgttttattttgtggttttgtttagttgtgttcagtaatttaaatgagaagagtggtaggaccactgttggtagtagggatttcaagatccacagtgaattggagattaaagaagagaacagagcagttctggtttttaagccttcacaggccccactgaccaggagcacatctttggcgcatagggttttatttgtttgggctgatagacccggggactgcggtccaaagtccatctcagaaggaaaagccgtttttcatagcgcatggtgtcctgctgaagagccgaaataacagggatagggagtggtccttcacagtttatttgtctttttcttgaaaggttgcttacattttggaaatgggattatagaacagtgtttacaaactggaattaaagattcccaggcacactggatgcagtggctcacacctgtaatcccagcactttgggaggccgaggcaggcggatcacttgagttcaggagttcgaaaccaagaccaacctgggcagcatggcgaaaccccatctctaccaaaaatacaaaaaattaaccaggcatggtggcgcgcgcaagtagtcccagctactcaggaggctgaggtgggaggattgcttgaacctaggaggcggaggttgcagtgagtcaagattgcaccattgcactccagcctgggtgacagagcaaaacccctgtttcaaaaaaaaaaagaagaagaatgtcagggcaccaccatgaccctgatctgcagcccacattcaacgtggttgtgaaatcttggtgggtggatgatggccccaggttccagggcaaagtagsatggtctgtgtctagtttaggaacaagtgaatgggaatcctgggcatatcgttatgtggatttgctacagacagttgggacagaccaggcggcccctgatttctgcccggattcccctgtgttaggagctctggagaataagactttaaccagagccaaagatgatcatgattaggaagggcaggcccagagtgcattccaaaggcaaatttaaaggaaactgttatctgccatttagatcatttacgtgtgtttccatgtcctacacctggggagttgaaaagccgcagaggcagaacactagtgtgaaaaacatgagtcttacagcctccacctgctgtcaccctacagagcatttgatgcctgctagagaagcttctctagtgatttgagacagtgtgggacacatacccgatgaggggaccattatactgtctgacttatggttctggtttttattttttgatagctctcaggaccaaccccaaacaagaaaatgttttttacattaatggatgcttctcgtggtcgagaaatctgactcatttgtattaccgcagtgagttccagcaggccccaaacagaaaaaaataagatggggagtgggacgaagcagtggctcaagtgtgaccctgagagttccagccagagctgtggcccagcctgctctctgaccttgaacagatgcattttctaaggccaaatgccctcgctttcctcgtctacagtggcctgttccaaatgactgcatcttattgtgttatttaatttacatccatggttttttttttttaattgatctgtttaccacttgattgtaaaccacctgagggcgggcagtcgcagggttcattgttttgtccccagcacttgcacggtgcctggcacatgtgccctctgtgagtgctccctggctgcagtttccctgctggtataaagaagggtaggcttatgcagggcatggtggttcctggtgcacagtgcacagtggacgtgcaataaatagtagttaccagtgccagcaggtgtctttgggacttggaaggtggcaggtggttatttgggacctggaaatgttcattcttagcctttaactgcccaaagtagtaacactggagaatgaaaataggtacaccttcctctatcccacagcaattctgagtttacaaacagtaaatgtgttgatgattgttcagttgcaaatattacttcacaaaagcccctcctaaagaatcaacatttagttgttgattcatacagctggaggaaactttgaaatttagagctaaattgaacttctctgaaataggcttataatcctgccctcccagaggtaggcaggcaggcaggcaccctgcctgactggctcctttccttctttcctttcctttcattccttcctttcctctctttttttccctctctttcgaaatgatttgaagagttgcttacagtgttcattttggctctcgggagtacagcactgacagaagtttccttgggaattaaaaattgcagcagtaattgcaaattgaattgttatctccttcaaaaatcccagcagctccaggccataccagcctggtaaatggaaatgttaatgatttgcatgtttgtacacagtgtgggtgtgagcgaatgaaattaacacccttagtagaagagctgagtataaaaagcttcagcccacagaccttggcagattgtgggatttgctgtgctggaagcagattggcaggcccaggtggggctgggggtggcagggggtgagttaaggatttgcctcagttttgaatgccagtggttgctctgccataggggcaaatttagaaatgtttggattccagccagcaaaggtgtttagacttgcctctgcacactagatagcaaagtagcatctggggcagctggatgcccgtgtgccagctaattaatattgatccagaatgcacaagggctgggtgctgcaataaccaccggctcagtgccttctagctaataagtaagacaagacaaattacttcacatttccaggcctgtgtcttgatctctaaatgagattaataataatgcgtactttgaaggactaccgtgagcactaaatgagataattcacataaaggggttatagcccttagcatacagtgagcatttaatgaatattagtgattcttgttatgcattgcatagtaaagagaaccctggatttaccagatccatggacatggattatctgcctggcttcatcccaatcccaatggctgtgtgagtttgggtaattctccacctgtttctgtctctcagcttaaggtatcgcatgcctgatggtcttgaaggaccctttgcaggctgtgcatcaatgaccatcagcagtggtcactgcctttcatatgtgctagctcctggagcattcagtacctgcttagacagcatcggtttggctgagctgagggatcataggagtgctttttatggtgttgaatttctttgaaaatttctttagaactctggagcccaggtgccagggtggagtctttgttctcccactttctagttggctgtccttcagcaagttacttaatttctgggcctcaatttcctcatctgcaaatagggcccacttcataggatgttgtgaggatgaaggagtctgtccatgcaaagtgcttaggacagtgcctggcgtgcagtcagtatccagtcagtttattattgttattgcttttaggccacatacagagaagttacatttaattttggttgaaatgatgttacattattaaagaaaaacattggaacaaacggacaaaatgcaaacaagaaaatgcatgttgagtggctaagcctaaaagacataaatgaccgggcatgatggctcacacctataatccctgcactttggaaggctgaggtaggaggatcacttgagctcaggagttcaagaccagcctggaccacacagtgagaccctgtctacaaaaaattttaaaaaataaaattaactgggcgtggtggcacgcatgcagtggcatggtgatgactcactgcagcctctgcctcctgggctcaggtgatcctccccgcacttcagcctgggtgaactgagaccctgtcttaaaatgaatgaatgagtgaatgacctaaaacatagtgaggcggcaaaagtgttagtcagtgccattattctttttcagagcggctgcacgatgcatatttttcatagaattgtcatcgtatgcaaataattttgcttttttttcttttaattttatgcttctatgtggtcttaataactgctatgactatgacattccatcatgttactgttccataacttatgaaatcattcacctgctgttgaatatcgaaattatttccactttttacaggtcaggcagcagtaagtagcttcattaatatagttttgtgattctgttggatgatgtccttaggataagttcccagtgtaaagttcccaagccaggaacatagaaatagctttaaggatcttgccttgttgttttccaaaagtgatgcattttcatgagtgatgtataaatttaccagttactctcaagcacatcagcactgaatattattttgaaatcgttcctcttgtaaaacttaaactacacttacaaacaccattttgatgaattatctgatggcacgggactcagagaaagggtatgggaagttcaaaagccattatcggtgttaagaatccattttgttataaaatttaatttcccacagtcatttgctttgggcttgactcaatctcattcaagtgctgagtttcatagaaaggagacatgaggctttatttaagcgtacccaattaccatcacaactttttgtcttctgccttccagagagcaatgattattaaatacttgagtttcttcacatgaaagagacagagtgagcccagaagtgttgttaacattgttaatgtaatgcttactgttaggcagcgtgactaatgacccagcaatccctcttcgctgcttctgtagagagctaaccatttccctaactgcatatggatgacaagagcatcaattcaattgttaggaaaatagatacattaaacagtttgctgggagggtagtttgaatcaactagtgtagaacgtcagggcgttggagtgaatagaacggacaaggccattggttcatcagtgaggttagaggccatattgggatgtagtcataaactggttcagggtaggagagaaaggtaaacaaaagattatttaacatgactttggaatcacagacatcttgagctagaagagaagagtaaaaatctcaaattattccctaattttgccaatgaagaaattgaggcttctagaagtgaagtaacttgtctgaagccctgcagctagagtgtggctttgtgtctcctaagttaggatagcaatataacagtgatataataacgcatgtaataatataaaaccatacaacatactgtatatgttatgattttatatttacatgttacagaatattcaatacattgtatatgcaatccattatgtattgtatcatatataacatatgatgcaataatatatgtaacaatgatacaataataacatattgggatacagtattacaataatgccagtggcttcctatttgccaggcatggcactgaaaggtctgtgtatattaggagcttccatttgggagcagttgacatgtaactaaagtgtcctggaaatcggttttttcttaagtgaaagatcagatgttggaaagggaaaccctaagtgtgacagaatttttctcatgagaagtatgggtgtagttttgggtgtgggtaagaaaagggaaggaaacttcattctgtcatcagatacctccaaatttagaacaatatctatccgtagccattggttttcggatatgctttaccctgggaacgtgcgtaaaatacatttccgtgtttggctatttctttcccagctgcatagagggtgtcaccattattttagataatagccatggccagtgcccactttaatcacttttccaatcacttttcactgattgcttctaaggcacttgatttcagatgtcactttttgctgaaatacctggataactgtttcagggggccttgtggactaccgagaagtttgcctccaggggttggtaaacttctaaaagtgccaagtcatgaatattttatgctttgcaggcccaagaagcaaaagtaagactattatgtagatacccataaaacgatttaaagtgaaatcatttaaaaatatgaaaaccattcttcacttgcaggctacgaacaagcagcctcctgtttgactggggttgctcagcgagccttctggcttctccggcacacacacattcaggtctccatctatgcaaatggagacctccttcttcttctcaccactgtaataaggagaaaacagacagtggaaggtttgtagaacctcatgattgactatagaggctttcagcatttttcctttactattaaatgggacactgtactaaaaaaaattctattgtttctatatttgttcatttattgattggatgttcattcatccaacaaatgtttattgaacaggtcctgtgtctccactgttccaggcacgggggatacctaatgaggaaaataagacatctctgccctctggagtttttagtttacatatgaacaagtataatatgtaggcttttggatgacaggtatcatatagaggagccagggaaggggacaggatggacaggggaagagggttgttagttttacatgtgatggaaagggagagtgatcagaaataaggagcagaatcctgtgtgttgcagatgtctgggcaggcgygctccggaaaaggaagaggtggcgcagaggccctgacctgggaatgtgtgactagggcggaggctggagacccatggcagatgaagccaggccttgagatgactgtaaggacttggaagggagagccagtgggatttactgaggggttgagtatggggtgaaagagagaaagagtagtctaggacgaccccagtggttttctcctgagcatcggaaggttgactttcgaagcaggagagcttcagtggcacagattgtgggggatgattggggctgtgtgggtacagagtgagtttgaggtgcctgtcagagatctacaaggaggtgkccattaggccattaaaatctggagtataaaaatctggagttcagaaaagaagtgtaggcttttttgagagttgttgacataaagatggtgtttaaagctatgagactgggtgagataccagcaagtaagtcagagaagagcaggggccaaagcctgagccccagagcactccagcattaggaggtggaggagatgagggagcaccagcagaaacctcgaaagaccttccaggaaggtagggggaaagcaggagactggtgttcagaagccaactgcagaaagtgttcctgaggaggaggcagagagggggcttcggtgacacatgatgctgactgggtcaaatcccttgaggaccaagacttggccttggcattcagtaacatagtggtcactggagaccttgacaagaggtgtcagtggggccaggcgcagtgcctcatgcctgtaatcccagcactttgggaggccgaggcgggcggatcacctaaggtcgggagtttgagaccagcttgaccaacatggagaaaccctgtctttagtaaaaatacaaaattagccaggcatggtggcacatgcctgtaatccctgctattcaggaggctgaggcaggagaatcacttgaacctgggaagcagaggttgcagtgagccaagatcacgccattgcactccagcctgggcaacaagagcaaaactgcacctcagraaaaaaaaaaaaaaaaaagtgtcagtggagtgttgggtgtgaaagtgtcaaagaatgagcagaggagaattggccacagggagcatgggcgttcttggagttttgctgaaagcgggagtgaagacacaaggtggtagttgttaagggtattgcggtcaagggaaagttttttcataaagggtgaaataatggcaaggttgaatgctgatgggaatgacctggtagagatggaaacatcgctcaagaccaggagaattgccggacgagagagaagtcctgattatcagctgtggtgcattgagtatttacagtccttgctgacaaatcaccccgctatttagggagcttaaataacaactgggcacctagtttacacttctgcagctggcagttcaggctgggctgctgggctcctggtcttgcctagggttcctcaagtgtctacaatcagctgctgggagggcttatccctgggcctccagcaggctagcccagggtccctcccgtrgtggggttgctcacctggtcggggaaggggggcagccctgaggccccaggtcagaagccgcacagttacctctactttatttcattggctaaagcaggccacaggccagcccagattcaaggggaagggagagagagacctgccccctccttctacccgcccttctaacaggagagtgcaaagtcatcttgccaagctgtgggtatgaggagcagggaatcgtttggccattactgcaaacaatttgtcacagctgtctgtgagctaagcatgttgctttcaatcatcacaagagttctttggggtaggtagtatgattgtgattttacagatgagaaaaccaggtcactgagcatccagtaacttgctcaagatcatgcagctagtaagtggcagaattgggacctaaactggtctctgacgtcaaagcccctttcttccctattttcccttcctgcaagtgtctgtttacaagggcagactagagggcccctcctccctttgcttgttaggcatgggaataatatttttgtggatgatgattatctcataatcagggtggactgagggaggtgatcatcttgttgtggcttgcatgtttactgtgcggggattggacagctgtatttatgagaatccctttgaggtcacagtggtgtgttattgacacagattcatgtctctgctctcagctggtccctcagtgccctttgacagtctttgcccttgtccttggtcagctgactctcctgtccagatagtcacacatgttccccttcacgccccactttgttccaggcctctgacttcctctgtctgcctttatcctggcccctctctttctggccctgacacaggtacactcagcctctagtccaggttccctctgcccaggtcctcttccctccagaacttgtcatcatcaactgtcttttcaaccaactggacttcaagctttccaagagcagaatccaaaatgtgggaaaatttgaattagcatcagtgaactttgtctctgacactggctgtatagtcttgagcaagtcctgtaccctcaggtgcaagaatctgggaagagtggacactttgagccatctccaaggccattcagggagagtgagatctctttatgtccgcctaggaaacccgtggcctagagctcagttctgttctgttgcagtggctgcagtgtgtcctgggtgtatacctgacagccctgcattttgctgcaagagctgcagccttctctctgccctctcctaattcaagcgtcaaaaccttgttggccccagagctagagccgctgcaagccacttcgctcatttaggaaagcaggaggcaggtcctgtgctgagtctgcaatctcagcaaagacctcagtgaaaatgttttcaagctctctttggatagagggagcagagcagtgagtaattaggttcaatcacccatttcaagtctctgtgaccttgcttacatagggagcccggagctgggccctycttggagtccctgggttgggatcccagccagctgagtgtgaggaagggagggagcgagaagggatggaggagaagcctgggccagcagagggctgctgtctctgctgcgctttcagcaagctcatctcaggcatgacattcaggatgcagagttgctctttatttttttatgtagtttgctaagagaaaatagccccgctacttatgtatcagtgtaatccaggggaaattacttaatttccgtcagcctcaatttgctcatctgtaaaatgaaggcaactaattacacctgccttagcatatgaggcgtgaatacgagaatgcttgacaatacttggcatagagttagccctcgataaatttcagctgttaatgttattatagcaccttcacatgttgttgtgtttatattgtaaatcrttggttaaagatatttttattgtcatgatagctccatactttcaagatgcgtctttgtagtatttcgtatccatttagtcattcattcactgagtttgtatttatcagacacctacttatggacaaggaactgttgattattatctttctgttcaggttatgatgagctgttcatttcttagtgcttgccactataatattcagagctacagttcgctgagcacctgtttcaatagagttgctcacttgggagatagattctaaagtccgagcataaagagaacatggcacagaggaagaattagccttgaaagatcccttaaatcatctgtaaagtacagtgtacatcggaggtcatcagactttttctataaagaccatatagtaaatattttaagctttgcaggccacctgtggtctctgtcacatatgctgctttattttcctttttaaggaaagccctttaagatgtaaaaaccttttgttagctctgggcccttaaaaaataggtctttgtctacatgagcagactgtggtatgtcttctccaggatggtccggggatccccgcctcctggtattcacactcaggtgtcatcccctccctctctggatcagggctggtcctatgaccagtagaatacagcagaagtcatacaagatgttgtagcttccgccagcctgtctctcttggatcccctgctctggggggagaccagctgtcctgtggtgaggcgaggtcacaggtgagggtctgtggctctggccagcagcccacagggaagggaagcagctcttccagccccagtcaggcctcaggtgactgcagcttcatgagacatcttcctgagccagaactatccagcttgtgtcagccactctgcctttcaggtcattataaaatctgcagcagggaacggggtgcggtgaggagttctaaagaatgcctgcttgcctgcagagttacattgatttttttattaaatgtttgctggttacacttgtcaacaaatctgtttatggagaggatgagatgggaacatgtcattcatgggtgttcttattatcatgcatttcttggagtttccatcattccaaccagagagagaacatttaccattcagcagatggctgcatatggacagttaagtttcctgagggagtgatgcacctcttctgggtgagccagacattgaggtacaccactcagtcctggcagcagcccccactaaggttaggattggcagctaaacgtctagcttgatccaactcgctcctgatgcccctgcttccactgatacccagtgtggcctctgctgtaacacagcagtgcgcttgcaatctggggagagcttttgcttccacactgaatagcttcagatggctttgctctttttcggttgtgccaagaggcccttctacactaaatggctcatccatgggtagctaccattgacctctatcgtgtggcctgctttgggaagacaagccgggtcaattggttctgcctcaggaatttgaaaccggacacagggaagcattctaatcattggcggggatttgagctaaagaatctacagaattggaaccaggcagtccctgtgtgcttccgrattatgagagagtggtaactcagaagaagcacgttcatgcatttatctaatgaacattgattagacatgtgctgcatgccaggcattgttttagccacttgggttacagatatcctcatgaaacctatattgctagtaggtgaaaatacacaatagacagtcaacattatccgttagtgagttgcatgtaaagaaagtgcgtgaacaatgagaacacatggacacaggaaggggaacatcacacacgggggcctgttgtgggtggggggagggggaagggatagcattaggagatatacctaatgttaaatgacragttaatgggtgcagcacaccaacatggcacatgtatacaaatgtaactaacctgcacgttgtgcacatgtaccctaaaacttaaagtataaaaaaaaaaaaaaaagaaagtgtgaaggtgatgagtgctgtaggaaggaggataagggggcatcaggaattccagggatcatggggtcaggttgcagagctaaagagagtgtccggggtggcctcattgaaaggtgatatctgcgtccagtcttgagaaggtgaagcagttggccaagcagataaacctggggcacaggcatgccaggcagggggacctggtaggtattgaaggaacagcacgaatctagtgtgactgcagcagagtgagcgagagcgtgccagccttgggttcattgcaagattacatttctgtttcattttaacaaacctttgagcacctactctgtgtcaagtagtatttggcacaaagcttttcaaacctgggttccccatctgaaccatacaacacagaactctgtgactatttgttcagctcttcagctcttccaggagtgtgacacagctgatgctttctggatgcttgggagagaagttcattcagtacatctaatgcatgccctagggtattaggcctcattctctgctggaaccctgactgaaaaaggcagaattcctctgcccccagcccttgccctgtaattacagactagtaaatactatgaaagatcagagctaggatctgaagggtaagtcagagtaaagtaggtgaaatgtgaggtgggcccttggggagggagaggatactgtctaggtgagaaaacagtgggcagagacctgaggcagaggtgggagagggggtgagatggattttgtagggcctgtcacagccttgagtttaagaacacttaaactcagtctcaagctaaatagccattaagtgtttggagagagagagagagagagaaactgattgagaggatacgagatttgtgctttgaaaaattgatgagattgccctggctgcagtgggagaaagccttggaatggcaagaatggaattcttaagctgccttgtatttgcaggcagataagggtggtggcagtgggacagattccctggatataatggaaactccaagaggacttgggaatggatgggatctggggtttggaaaggtattgtcaaaagacaacattacaacaatgtaaagacctgaattggcttttacttgtgattccagaattgagaaacacttgaatagaattgagtgttctgatgggccaagcagaggaggttggttttatagaaagaaaaggactgaggaaagcagaaacagaaaataaaaagcagattggttgtttcagagttacttttcttataaaggttaaagcagaggggactttcttatcatgccagctacaactggcctgtttggggatttggctattctctctctctcctgatttctckgaaggtcagataaaaatcttattttggcttagtggtatggaacttgagcgtgagtgacaccattttggtttggtctattgggcatattgcaggagctcagttcaaaccaatgacctcctataaatttaatttaacaatttctccctttttgtcatgctctcacctaggagacagtgtgaccaaaacttagggcatcagcactactccgtcatcattattttggggtttaaatcttaacacgtcattcatgggtgtcctcattatcatgcatttcttggagtttccattattccagccagagagagaacatttaccattcagcagatggctgcatatgcacatttaagacttttttgagaggatacagtgcaccagggagactactgttgtggctaatgactatgaggatgataataccaagagtttggagtatgccccttagccagggtccccatgaaccaaaccaactgaaatcatttagatcaaataatgagccagatggggaatctacctgttttagccaagcagcctgtttgttcggtttatccatgtgcaacaagaagcattagcaactgtgcagattatttcctgttcggctagaaggtggcatttctgttacctaccatcccatgactaggtttggcatgacagatccgttttttcatcaagtctctgtagaagctactgattgtgcaattccggcaatgtagcattatcctgccaagtgaaaaaggtaggcataagcaaggaaaaatcaagaggagtcagagcctcattatgataaagaatcttgttctgatgtcttgggaaaagctgtccacagcatgaagttgtcagcttgtcctggtttgcagtttgactgcctgtgattataacgtccggtgtttgggtgaactctctgtggcccacatatcaggtatgagacctgtccctcataatatacatggagttgtcaagctccagcttgtagggcttctgggacagagcagttcttgtgtgtwtttggagagttgtagccagatgtttccaaataggaaagtagaagaattctggatccgttccagcctacaaatagtaaaaactcaaaaacaacgaacagggctacaatctaataacaggtgtactatagtttttcttctgaaacatagtttttctctctacagtcaccctcatttctactaaagataaagcgaggtgaatttttttgcaaaatgagcttagtctcgtcaaacttggcctgattatttacacaactgcagtaatgctagtgattgatcacaaagtttgctttgctggaactttggataagaaatctcagattggacttttaaaggactctcaaagctaggaagccaaactgatatttccaactatattctgttatgagagcagactcatattgaacttaatggaaataactatattagcacaaagataagaagagtcacaaataatttccgaattctggagatattaggtagggagaaaacataaatatttcgtttttgttcataagagtataactttaccaaattactgaaagctaatataaggaaaaaggtgttttttttaatctgagaaataaaacaccagcaatatgtcaaattaaaaaccataaaacccacaattgttatttatcattttattctgtctcatgtaattaatttttgttctgcttgatcttggtcagtagtttcacaagcccatcagtttctttattagagttctggaaatgtttagccagtccaatggtatgatcttaaagttattagagacctcttcttgtcaaagtcctttccatcctttccatgaatctccttgaaaacacaacattttaggattatagttgcttgcaaaaagcattgagaaaagcatcagaataaagcaaattaactgtggataacaggacttaaagcgaccatgattagagatctgatgagggttcattataataatgattcagttgacaaggaaatttggctgtttctgtggcatacaacaagttaacatgataaccaaaattatgactgacagcatatcagatgatcagataagcctaattggagtaatgtttctctttttcacggtgagagactcatcctttgatgttttctgggggcccaactgagaaacctcaaagtgaatttgaggtcagagagacttgatctaaaattgattttgagaagtttgtcaaaaatatcaacaggtttaaaacaattaaaatagtatcacatgtcattgtggaaataatagttgttcatttaaccagtgataagaaaaagacttcagaaggcaaatacagtaagttacatagttgtcagcaaaaatttagctcttttaatattgagaagactcacatttcttaagtaatcaaaggcctaataaaagaaaatgcaaagcgcaagaaattgtcttgataaaacacaaaatctttatttcctaggccaattatctagaaagaaagaaaaacctttcactatttctcattaagagtaaatcaatactccaagaaagcattgagacaagcatcagaacaaagcaattaactgtagataacaagacttaaaatgaccttgataacctcgtgttgagagaaccaaattctattttgcattagcatctttttattttatttatttatttttttgagacagggtctcactttgtcacctacactggagtgcagtggcacaatctcggctcactgtaccttccacctcccagggtcccacctctgccttctgagtagctgggacagcaggtgtatgccaccatgcctgactaattttgtatcctttttttggtagagatgaggttttgccatgttgcccaggctgttctccacatcctaggctatatgcgatctgccctccttggcctcccaaagtgctggggttacagacattagccaccatgcctgacccatcagtgtacttttgatattaatgctcaatttttagaaaaaaaaggtttagaaaaaaattggacattataaataatttccttttaattttagctcgatcaaacataaaattcctttcacaagattcatcttccacaaaccttttaccattttctgatcgattctgttttgtcctctaatgtttctctttctcgttttggaagaaccgtcactctactgtagaaagaaaaaattactttctttttcccttaacaaagtctcattctttataacttcctatttagaaagtatcttatttccctcacatacagagttatttccttctagttttaatggtcatccattaattagactttttaactcttggtaaccttaatttctagtgaaaactagggagtgagcaaatttaaactgttttatatcagcactttgtacatgagcaccatttcttaatttttaggaacatgtgccctaatacagtttttttcatgtttattaacagactcacaaggcccgcatgtatttaatttatgccatataaaaacaagatgccagaatacatatactttacatttatattcagatattaatgtttcagtattttaacttatttagaaacaactcagacatttcataactattacttaacataacttgactttaagatttcaagttactggccaagcgcggtggctcgcgcctgtaatcctagcactttgggaggccgaggcggtcggattgcctgagctcaggagttggagaccagcctggacaacacagtgaaaccccgtctctactaaaatacaaaaattagctgggcatggcagtgggcacctgtagtcccagctactcgggaggctgaggcaagagaagcgcttgaacccaggaggcagaggttgcagtgggccgaggtcacagcactgcacttcagcctgggcaacagagcaagactccgtctctggaaaaaaaaaaaaaattcaagttactgaaaaggatttttgaaactatgatttaatccgtctataaacctttatcccctttacattcacctaatttagtcatgcttaatatttatgcttgaaatgcttcttaaaactaatcagtgaaggagttcaggaaatgccattccagaatatgtcgcattagtatattgatcacttccagctgcatgtacttgaaatacaacaaatgcagggagaggcattctctgaactcgtacctgcccaaagacagattctcagaagaactcagctgtcatcagtccctcctctgccccatcatcttacattattttatttttgttgacaaacaagacaggtrtaaaaaaaatcacagaatcaaagaaacagaagttaaatatgattctttatatttcaaaccattaatctttccattttctgttccatcaccctaagcagttgttagccagacaaccctaaatctgtccttccaaaaagatgactcttggatgaaacgagtttaaaaattgacatctcaaaggcataaaattaaacaccattatttgtcaagacaaagaaaggggtgaagtgggaattccagttaagacacagtggtccaaggtgaagcttattgtttccttgttttttatttttattttgagacgaagtttcgttctatggcccaggctggagtgcagtggcacgatcttggctcactgcaacctccacctcccgggttcgagtgattctcctgcctcagccttccgagtagctgggattacaccacacccagctaattttttgtatttttggtagagacagaatttcgccatgttgcccaggctggtcacgaactcctggcctcccaaagtgttgggattacaggggtgagccaccacacccagccacaggcttgttatttagatttgagtcttgccttcttcattgtaatagtttctagtgattcagggtgcagagaggcagatcccttacaaaatggagatttcctttatagatgtaaatttcttacagagtttcaaagtagccagctgagtgccagaaatgtaggcccttgtacgttttatttagcagtataaagtgagtcaaggatgccaccaggttcctggcttatgttaatgggtagttaacatccactgagataagaaatacaggacacttgttgctgtttatttggtttaygtataaacagtgaattgtggttcttttattcaacaccagagtgtaaaccattgactggaggtgttcacagactcggaataattgacttcagttcttcctgaagttcttaacttgtgggatttgggggcttttaaagggagtgacttggagggacaattctccaccttgagagaggtctccctttcatctggcacggcatctccagcatatctcctctaagcacctctgcccaggcaggtaactgtgcacgaactaaccttggaaaggtcaagagacctggctgtggctcattttcctttcttttcttgggtacttgggctcctaatgaaaatgcttctcattcagaggttccgggaagcctccatccatgagcaactcacatgatttacagaagaattgctatgctgtgtatcttcacgtgggtaacacacttgttcctcacagcccatagggttttgtyattaaactattgagacccatgtgatggtggagtatcaagattgacaggttaatttcccatttatatagaacattatatgaaaattgatttttttaaggyatgggggtggaggatcctgggatgtgtggcgtggtgagmgagaagattaagcatttagtgttttcagctacatttaaacttgtcytccttggcaccaacctaggggctgctctgagttctaaaggaatcacaggaggctggttgtacaagtggctgcattgcctccatgcgtttcctttgcttcttcccattaaaagccaaggaccaccttactcttgaggcattttaaacaatgaaatctaaggaaaacatgctcagttgagaacagacttttggggaggagtgaatgggaattctatgcaaggccgggtgcgatggctcacgcctgtaatctcagtactgtgggaggctgaggcaggcggatcacttgaggccaggagtttgagaccagcctggccaagatggtgaaaccccgtctctactaaaaatacaaaaaaaaattatccaggggtggtggtgcacgcttgtagtcccagctacttgggaggctgaggcaggagatttgcttgaacctggaaagtggaggttacagtgagctgagatcgtgccgctgcattcaagcggggaggacagggcaagactctgtttttaaaaataaaacaaaagaacaaaaaaactgtatgcaagttatttgattggccactcagaaagattactgattgattatgaattgaatctgttgtccaggcttgcattctcaaattttccagtattgtcaagaagccagaggctggtgttgatttgatttaacataacatttgacttaacataacggatcctattggtaattttatttcattatcttcgcgtggttttgaacctcaacacctcagcagtcaacttattttagatcttccatttcatcagaacgctatcatagttcaactaaataattatagtatgacgatgtagttacatttaagtactgtgaatgtaaaacatttggggctgagaaaaacatacactgaaacccggtttcttacttcatcagcagatgttaatgaggactgtctaagtctctggcactgtgctgggcactgagcaatatagaggctttgcctgccttttccaggaggcatcctctcactgccaggtggaaaacaaaggcagtggatgtaacctacaacacagagaggtgaatgctatgcagagagctctggcctcattaccccgtctaggaggtcaaggaagtctgtgggagaaaaaaattattcaaacagagagggaacccagcatcttgtggacagcctggatggtgactttgtgttgatttcaggccaattgggcagctccttgtgtggctgcccagttgtgtagtggagctgcattccatacaggtggggggttgggtctgaaaagtccacacagcaccaattacccatagtcaaaatcacacagagaatccttgtcggagacccacagagccagttgtcttcagcattggaacagaatgctgtttcttaaaagcagggatggcaaatgggccaaatccagttggcggtctgtttttataaataaagttttgttggaacacagccatacccatttagttacatattgttggtgctgctttcttaccaaagtggcagagttgaatatttgcaacagattgtatggcccacgaagtccattgtttcgtatgttgcccttcaaggaaagtttgctgccctctgctttggagcaaatgaaggaattcgttttatattcaggtactacgttgtaaaaagaaaattgttacctttaaacaccagaatcgtatcagtgaggtgagatattcacaccccagaacgcatgaaggaactgaagaagcagtcacctcgcctctccatctgaccctcacctggcatcatatgctctgactaaattggagagtgatttgcctaaaatgtgtctccttcctccttgccctgccctgcctctctgtttgtccaaatgcacgtagctgaattcgcctgagttttctccatactccactatatgcccctctrccaagaccagctaggtcggggagaccctaacccagcggcgctagaggaattaaagacacacacacagaaatatagaggtgtgaagtgggaaatcaggggtctcacagccttcagagctgagagccctgaacagagatttacccacgtgtttattaacagcaagccagtcattagcattgtttccgtagatattaaattaactaaaagtatcccttatgggaaacgaagggatgggccaaattaaaggaataggttgggctagttaactgcagcaggagcatgtccttatggcacagatcgctcatgttattgtttgtggcttaagaatgcctttaagctgttttccgccctgggtgggccccgtgttccttgccctcattcccgtgaacccacaaccttccagcgtgggcattatggccatcatgaaaatgtcccagtgctgcagagattgtttatggccagttttggggccagtttatggccagattttggggggcctgctcccaacatgtccgccttctttgatttgcaaatccataaaagcaagggcagctttgtcgcggtgagctacttctcgcaggagtcaggatccacatctgcagactgtacaaagacaacacagattaaaagcacaatcatcattgaaatcacagagcttccaagtgtttttatccattttaaygggttactagataaatatgtccagtaagtataattgttctctgtgtcagcccttgttgaaggaatactcacggcagtggtgataacctctatcatagctaccattaaattacttgttgtgactggttgtcccgctttcctcaggttttcttccaccatctgtgacagcttcttgatctgtccccaggtgggtggctgtgttcgacgggtgttgctcatgacagttggggtcctcctcagcatcagtctcgacatggctgcaactgaggggtcctygggatcctcccggaatctcttcctcggcatctggctcatgataaggtttcaggtgtcttgatggtatccaaatcggctgttgattttgggctggagaaatacaagcataacctctactccaagttattattttacctatttcccaactttttgttaycggatctctccactaaatcagttgttctgcttctgtctttgcagctgttctgtagatgctgttcagctgctgataacatctggcctttgggcaggctcaaaaaatttaaagttaataatgctagattcagttgtatctgcggtgttccataatctctatttccccctttctgcttttgcaactgctgttttagggaaagattcattctttccactatggcttgtccttgagaattgtatgggatactagtaatatctttaatattccacatagagaaaaatgtagctagagcttggctaggatagcctggggcattattgttttaatagaagctggaatgcccatcaccgcaaaacactgcaaaaggtgaygtttaacacaggcagaagactctcctgattggcatgtagcccagacaaagtgagaaaaggtgtccacacatacatgtacataagctagtctcccaaacaagggaacatgtgtgacatccatttgccaaagacagttaggttccagtcctcgagggttaactcctcctgtaaaagatgaagaatgtaccatttggcaagttgggcatcactggacaatagctttagcttctttccaggtaatgctgtatctgcgtttgagaccagaggcactaacatgggttaaattgtgaaagtgtctagcattagatatttcattagcaactaggcgatcggccatttgattcccttcagtcaaaggtcctggaagaagtgtacgagccctaatgtgagtgatgtaaaaagggtgccttctacttctaactgctgtttgcagttgggtagataaagtcatcagttgttcatctgtatgaaatcataactgagcattttcaattaactgtgtggaatgaaccatgtatgaagaatcagaaaccacattaataggcatatcaaaagcagtcaatacctcaattacagctacaagctccgctttttgagctgaaatatagggcatctggaaatctttactttttgatccagaataaagctttaccattactagtcccatctgtaaaacaatgaaaacgcttagcaggctgcaggttgtttactgcaggaattgtaaatgcaaaccgttcacagtcttgctcagccaaagggatagtgaagaaacagtcttttaaatctatggctattaaaggccaattttttggaattataacaggagaaggcaatcctggctgtaatgctcccataggttgtataactgaattgatggctcttaagtcagttaacattctccatttacctgatttcttcttaattacgagaactagagaattccaaggggaaaatgttggaggaagtatgtgcccattttctagttgttcagtaactaatttctctaaagcctccagtttctctttacttagcggccattgttctatccaaattggcttatctgtgaaccattttaaagatataggttccggaggcttaacaatggccaccatcaaaaattatttcctaatctttggcggaactttgtttttccacttgaagcagttctttcaaaccttgcaaatttttttctagtcccataccagggacatgccccaattcatgcattgtatgttgactttgaggactatataattgttctggaattagaacttgtgctccccattgttgtaataaatctctcccccataaatttataggtacagaagttataattggttgaatagccccaggtcgtccatcgggcccttcacaatgcaaaatataactactttgatatatttcagcggctttaccaactccaaatatgttacattgagcgggttgaattggcctcacggacggccagtgctgtagagaaatgattgaaatgtccactcctgtatctaccaaacctttaaatttgtttccctgaatagttatttcacaggtaggatgtttatcagtaatttgacttacccaataagctgctttgccttgtttatttgtgcttccaaatcctccttttcatttaatttcacttttccccattcccccatacggcacaatcaggagctgtgctatgcactctcctggctctgctgtccagggaacagaagtagttacaacaatttgaatttccgcattgtaatctgaatcaatgactcctgtatgtattcgcaccccttttaaacttaaaactagaccttcctagaagtaatcatattgtccccactggcaagggtccacagactcctgttggaaccttttgcggaggttccccaggcagaaggctcacagcttttgtgcagcataaatctactgacagacattgtacggaggtgatggaatggcctgagctggaaatgccccggtttagaacggggcccgggacgggcccctcatggcgtttcccgaaatcgggttcccttctatatcaaacttagagtgacactgattagcccaatgttttccttttttacattttggacatatttcaggctcagcagttttcttttttcccctatctggcagcctgactcgcttattttttctacattcttttttagtatggccatgcttcccacagttaaaacaagctgcaggaaatggagtatttcctttatccactctcagtcttgccattgcctgtgctagcagagtagctttatgcagattacttccgataccattacaggccttgataatcaactaaatgcgctttccctctgataggtcgcagagcagcctggcagtcgggattagcattgtcgaaagctaataactgcaacactatatcctgagcagccgaatctgcagtcatctttttaagagactcccgtaaccgagctataaaatcaacgtatggttctttggatccctgtttttgtagcactaaaggaagggtattgttctccacttgaagtgattttttccccagctctaatgcacactcctctaagctgttctatggcatcatccggcatgatgagttgtgcatctaaagcagcccagccgccgacccccaaaagctggtgcgcagttatattaattcgaggttgggcctgggcattgcgagcagcctgaatggaagcttcatctgcccaccaagttttaaattgtaagaactgagcaggagttagacaagctcgagtaagagcatcccagtcagtaggaatcatccgactggaaacagcaacattctttaacagtcccattacaaaaggagaacctggtccatactgatttatagcttgtttaaattctttgagtaatttaaaatgaaaaggctcaaatgtagctataatatttccctgttgatctgggggtgtattctaacagggaactgccaagcctctaaatcactccctcgtctagcttgctgaattcctgcctgaatagaattaagagtggtcgctcgaggtgctgcttgaacagtcactggggcaactaattttcgcccagtgtcctccggaaaagaaagatctggaggatcattttcttcaaaataataatgagggggtgcagaggggtagggatgaacctctccctcctttgctgctttagctttagctggtaaataaacatgctctgtaacctcttttgttacctagctatactctccttcctcctcatcatcggtgtgaaaaagttccaaggtgggacgaaccacacccccacacttgtcctattgttaccctgatgcttctgagctccccttcttactcaccagggggattgctttgagagtactcgggtgtcctccagctagttccgcattctccagccatcactctggcgacccctccacctggattcgagcccccacgatggacgctacttgccgagaccagctcggtccgcgagaccctaacccagaggcgctagaggaattaaagacacacacacagaaatatagaggtgtgaagtgggaaatcaggggtctcacagtcttcagagctgagagccctgaacagagatttacccacgtgtttattaacagcaagccagtcattagcattgtttctatagatactaaattagctaaaggtatcccttatgggaaacaaagggatgggccaaattaaaggaataggttgggctagttaactgcagcaggagcatgtccttaaggcacagatctctcatgctattgttcgtggcttaagaatgcctttagtggttttctgccctgggtgggccaggtgttccttgccctcattcccgtaaacccacaaccttccagcrtgggcattatggccatcatgaacatgtcacagtgctgcagagattccgtttatggccagttttggggccaatttatggccagattttggggggcctgctcccaacactcctctcctccttcaattgcagtggacaggctgatgaaaaaagagcagagccaggcttaataatgtggatgaggcacttctgccaatggaaagctaaaatgatgtcgtgattcagtagaaaaaagtggtaagacaatgagttgtcattgtgacacacagttaagcatattgaaccccaatataactaactctctacactggattcacattggaactgactgtgcagtctcaagaagacattgtccttattgtccatcagtgtgcactgttaatcaaaatttggggatgggagttttagttgcgtttagttataaatgtgctttgattttatagttgtaaaggagctagatgygtatggcagacagactttaaggtgacccctaggattcttgcctcctggagttgacgcctttgtctcattgtctcacctggagttggatgtggcctgtgactcgcttcccacttctaactcctcttgccagctgactccctctggggccattcttcctggctagctttgaggaagaggcccctgtggcagggagctgaaggtggcctcctgcctatatccarcaagaagctggggaccttaktcctacagctccaaggaaatcagttcttttgcccacaccccgagtgggcaacttgaatgaagacccttccctggcggagtccccgctgcgtagtaccctcattgcagcctttcagggacccagctaaactgtgcgtggacccggacccctgacccacagaagctggtagaggataaatgtgtgttggaagccactaagtttgtgtacttcattatgcggcaatacgaaacatttcaggacttacacaagttgttactggtacttatttaatgttataaaaatctgagccaagtcagatcactttaggatgggaacatctgaatcacagccttggtgagcttctaatccaccgttccctttttcttcccatcaggcaaaggcaaaagtggctcctgaggtcctttttgtagcactgacaggtttccttggtcatagtggaagagaggggcatcccacatcatttggcccagtgttcttttatggaaggacacatggaggacaggggctggccccttaggcttgtcttccctgaggtcagctgcagcttccaaggaggtagcatcttgagacatttataatctatcctttgtacagctgcttgtggccccccccttgtcacataatgagttcgcagttgggatttcctcgtgtgagtttccagcaccctagggccatatttgtcctaggattctcctcatcatttccccccacccccagtcactgctgcctcttagcctttgcttctccgggctgaggaattcctgcatttttaatctgtcctgctcctgctggcctgttttgtctagctactgcccttcaaaaccatatccagtttcactcataaaaagcagggggaaatggtcaaaccaaaccctccagcctcccctgtgtagtcctggctcttgtttgattgttggttctctgaagaaaggtgctctgaggaggaagagggctgcctgtgcccccggcaccccccatcatggaggctggcctcctggtgtgttgtttgattgggtgtccttttgcacccctgaggtcctgctagtacctgcagtgctgacagtccctgtgggcacgggtgtgtgtcaggccttagtcatcagcacttaaccgctctgagctgcaaacattgggcctcagagctcagtgttgatgtgatcaccgtctcacttctgccaaaaatagatggggaggaacatatttctgttaagctcttgagggttacagctggattaagttagagctcctgaaaacagcacactggcttatactagtggtttagattctctaagaaatgtgtattgatataaagttatcagactattgattttttgtagagtgaaaatattaaattgttatttgaagaacatcatagatcttgtaaaagcaaagttgaagaccagattcaaagttactttacattcttcttgaaattccttctagaatgttgtgctaggaaaagtccctcttctgttgagtttatttactttcttttaatggacaaaacctatcttatttacctttttacctttgccactaggaaacttagaaccaaacgaatacaactcagttgcagtaaatcttgagttctaagcttctgactctgtttgcttttaaagtgtctcatttgytgtgtgcttagtgttttctaaataaatacctaccattaggggaggaattgctttgtaactttgcacattagctccgtggtttgcgttgacctcgattctaagcagaaacagctgtgagtatgttctattaattattaggtgagttgttttaactagtgcagacaagagcttgttgacctgtgctctgggtgagaactctgatttctgcttctactcaaaagggtcaaatcccatgatgtagttttgacttaggagaatttagttctggcctggagtgaatctttgtgggattgatgcagaccaagactcgtgttaaggccgagctctgcagcagctggccgcttgtttgtcttctgagcctgtttcatttgccttccctggtctgcttgagcagaggagagaggaagaaaagctgttggcagatgtttttagtaagacccttaagcgtaagggaggaagctaattttagtcctgtttttaatattatggtagtttggttgcgtctttcctcttagggtagagcattttagcttttgtttttgcttttgcatttcctgtgtatatatcctgaagcaaaatggactgctaaaaatgtcacttggtgtttgttattttgtgcctagaataacattcaagacccgtgagcactgtgagtcactaaaatagttttaggagaaaggaatgttgtctgtgttactcttttctatatttccttctagaaattttccagttgattcctgtgcttatgttaattggacatccataatctctttcttttatcatcagcaatacagtaacattgtatttgttagcacattgcatctctacttgcatgcagagctctttaattttaaaagtacagtaagttttggaagaagatcatggctaaagaggcaagttgctggaaaatacagttgtgctgcttactcagtgaacaaccagccaacaagctgcgtgcacgtttattgtgatgagaacttaaacacaaagcagacgtgtaagttcccctggtgtccccagttcctagcacatagtagaaactttgtaaatatttgtttggggtaaatgaagtcagtagcactacagataggaggccgtaaggaaggatggtttctaaaacaataaaaagggacatcagctaggccagtggtcttccaacttactgtgtatcagaatcacctggagagcttgttaaaacagattgctgggcctacccccagagtgtctgcttctgtaggtgtggcatgggcccaagaatttgcatttctaagaagtctcttggtgaagctgccgtcgttgttggttcaggaccacactttgagaaccgctgactaggctaatgcctgtggatgagaaaagaggcttagagaaattatgttttgcctaattgacaaaaccaattagtggctgaaacaacacagaaggccaggtttgtcctctcacttcctaacttgaggacagagaaatatattctgatgtccctaactggcagtctgctatggtagtgaccacatgcccatttctttcttgggatttcgtcccagcctgacaaccttggaacagaacaagaggacaggaggtgtcgttccaggtatgtrttagctgcaccagccactctttgtggcatctgctacccatcaaaggacgtggttgggctgggagccaagttaagttttctcattgtttggcagttgtgtccccagattttcttgcccatcttggagatcttagcacagccggggtgcttggggctcagctgccttgaaggggactcagtcccccacacaggtgattcccatgtcccatggtgggcactgagattggggtgaggggagcacacttgagggacccttcacttcctcacagcccttgcccctttcctcagggtgcrctgggaagaacccccagcggctgcccatgcccacctcagaagctgttcagtttgggcagaaggaggttattgtggccaccttctgtccacggttttcttttacatcctttccattgcactgttggtgcccacctccccattctaaaagacatggccactggctccacttaaggaaggcactttattgtcatgattaagactgtgaggccagcctataatcccagcactttgagaggccaaggtggaaggatcacttgagcccaggagttcaaggctgtagtgagctacgaccatgccactacactccagcctgggccacagggcgagattaaaaaaaaaaaaaagactgagtttttgtcaaactgagcagttcgagttcaggctgtttcccaatcatgctgtgactttgcacctagttcttttctctgagctttagtttcttcatctgcaaaatggcaattaatgtctgcctgtcagggctggygtatagtaagtgctcagtaaattacaggctatcttttgaggagcaagaagtagactagctcctgactaacccttgccttaaattcctcttctctaccttcattccctgggggctttcctggtacaggggcaggataatggtgtgtgcttactttggattttgccttgtggcaatttgctgtaagacatggttggggaattcatttttatctagacatcaggaccaccagtacattggtaattcgtctcttagtggaaggtggcttgtgggtgtttggcttctcagcctgttggggaccatttttagatttstgaattaatcctttctcatggccggtgaagaaaaaaacacatggtgaaccctgtggacggcacgtcccggcacccgcaggaagctgccgggctccctgctcccgcagagccctcctccacagcctcgcccagcccctggctcttgccctccctgagtcaggtcacctgttcagctgaccctgctgggctggggccttccagatgtgctcatccctctgctgggagcattttcccctcggtccgtgcctcatccccacgagaaatacagcgcaaatccagccaagtgcagcaaatctagccaagtgcagcaaatctcaccagcttctttttaagccagtttcctcttggtggcaagcacagttgctaccaccccccaccaccctctgtggaaagggctatgacgctcgccttctctctgctccctccctcccagctgctcctccagaaccccccagtgtccctgcacatcccaggagtctgcttctggggaaccggaccaaggtttaagcattcaccttggggaggccacccccacccstctctccagacttggttaggggtctttggcctcacttgtgtagcacttgtcccctgacctcggtagcgatgcttcaggtctgccctccccgcgcctccacagggtttcttgttctctgaggagtaggggacaggacagaggcttttcctcagcaggcagccagctcagattggactttccttctagggatccctcttcaggttgggttggtgggaaggccgtctgaactggagcaggtgggctgtgtcagggaggcggtcaccggactggactctagccagcrgttcccacctccacgcgcccaccgcccaagcagccagagctccagccctagccgcccaaaacaatgcagggcaacggttttctcctgagccaagtgtggagacctagatttccttgcacctgagggagagggaccacagtggtggcttctcacgccttggggaaccggaccagggcctgttcataacacagagatctgagctccttctcaagtcaggctgactgctttgggtaagagggcagaattttaaagcaaaaccgtgctctgcagggcgcctatttcagcattttcagactggtcttaacgtagttggttcattgccctcagaaatgaatgttgaaagcggtaagccccatttgaagcacccccgattttaacaagcttcaggacacatagttctgtgctaatatttttgttttgatgaaaaatttaaaaacactgctctcaacccccaccacaaagaacacgaaaatattattataaagaaactagatatatcccaatccctgctctgcagtggtggttcaatttgtaaagcaaaagttagaaccaaaaatgctttcaaaggtggcttcgaacaatgttcataactctctgctcgcatcattctgctttttacagagtttagagacccatttatagattcagtccacggattgtcatgcatttgcaaaaacgtctactagctctccgagttccatatttttattatcaagggacccttagatctgaggacatggggactggcagacaccagctgcagaacggaaccgtcttttaggaaacagaggccacgatgagtacatgatgggccccatctacctagtggaaaatgaagcggcatgtttttcttcacggtcactggtggctcttggcaatttctgactcagcaccattggactttctcctggcccctcctttcctctctgttgggtggggcggccgggggggtgcttttgtagccctccacagatggagttgataggaatgtcctgctttctaaccatctgcagaggacctgtgctttgggtcacagggtcctcagcaaattcctttcccttccagttgatttacagttggttccaattggtttacctgtttagaaaattctaagtccatcttaaatgtaaaaggtggttatcatcttagaatgtgctcaaagaactttaaagataactgctttccactgaggacacagttcatctacaggacagggtcagcagtggagttgggaccccaacctctagcttttgggcctgctcctagcaggccaggtggcatggtggcttttcatccagccctgatttgggacacactgatgtttcagcccctccctcttaggaattctgatttgaaaatcactgtatctactctgtattcctatgagagagactaaaagattttgttcagatttgctttcttctgattgcaaataggaacatgtatggtttttttgggtgcactttttcagaccagacgccaggtcattctgacccaccccactcctctcctgagaatcactgacttagtgcagttatttgagggcaaaaagcactttttttcccagcacaaagtaggtgctaaacaaagtctacagccaaatataaacaagcaagccctgaagcagaaggaagagcagggctcagtggtggctttggccccctggttcttatgtctgtcactccacacacgcagtagggcttcaggagatactggctgactggtgctctgagccttttaccagaagagcctgattcagctaaatttccttggtaggggtgactgcttagttggaatttggtggctggaactggtggtcaccccctcttaccctacacgggccttttccaggttcagcatttacagatttgtttcccaaccaggaggggcttatcctaaggaatgttctgatctgagatgagattagaacttcccctgctgtcraagtcaaagggtcccatctgcctgtcacttcccatgtgccctgggctgtgctgggctagtcatcagcccctccccgtctttggcccaagatgtggaaaatcttaatagctcaaccggttccctcagacctttgtcttctgaaacagtgcttctcacactccagcactgcaggsccacctgttgaagcccagtgtcctgggtcccttccccagagaccccagttcatcagattcttaggtttgcaccagggctaaagagctggcatccagaccccctcccatgtgacactgatgccgtcatctgatgcccagtcccttttcagctgaacgaaggatgaagacacaatgttgtcctaaaattgattcmgtgaaatagcaagtagtgaaaaagtaaaatagaatttaaatctttagatttttgacatattttgtgtacttggttgtaatataaaatacgtttcttaccggggtcaaaaagcttattagcctctgccttagctacttctccctctctgaaatgcccacctgtgcctttgcacctgtgcttggtccttagttccaggctcaggaggggaagctaaccagtgtcttggcaacttttggctatgggctaggtttgcggtcttcaccaccatacatgacccctaacctacagcagcacctattggcccagtgagggggtttctccactccacactccagggagaagggtcttcacatgtttcaagttggttgtgattaagtttcgtgaaacgatattagccttaatacatgcatggcctctgagattttctgtttcatgttttcatctatgacattgattttgggaagtgctaaatgggttggttgtgcatcgtaaacatcaacattgggagtaatccacaaatccacccctcaagtggccagraccagttcccacaactctccagggcacctgttctcccccagctcaactgccctgcactttccacagccagatcctgcaccgtctgccagtctcggttccagggcctccattcatgaacttttcctgcatctctcacaaagtgacccccacatgtcctcagcatttgactcacctcacagtgtgccatagccctgggttggaggcttgactttcttgtcagcttatagaccacctgagtgcagagcctgcattccagtgcccccagaacctctgtggcagcaaaggccccacgttgttgggctggttggaggcgctcagccacattgcaaccccagttttgtgggcgggcccagaactgggacttggtttttaactttgtttcaaggggaaggtgtgttctgattccaacaactgacttggaaaagaccgatctctgctttgcctctccaccgtgtggcccgtgcctcctccctggcgggctgagatgtaggccttcagacagacggcaggaggctgcctcctgtggaggatttgggcctttaaaatagaacttcaattccaggagacttagaggatacagctgctgagggagagcaatgaaaaatgagattccctcttgaaaaacgatcactatttcctgctctgaggattctagagtaaagcaactgagtttttgaagttgggttgcccctggtttttcctaggggcattccccggacagtgtggggtttagagagtgttaaatgagagaggtaatttggagggagttagaggaatgctatttggctgagttcaagatccagggaagggggatggctgtcttttcaaaacacttggttgaggagcctctttaatcagtatggcgagttttgtaactgatcacagactgctaaggcataaaggcagtgagaaagggaggactttctgacttaggaagatccccttctccgctttcttgccaaatgttggcaattccaggcatcactgaaatatatgttcttccccaacccattatttttggggttgtttaaaaatagtgtcttggttgcacccataatcccacctcccaagtcgagagagccagtgtataactttggcctcttccttgaggccgggagactgtcccgaggttttgcgctgagagtatttttagcccaggtgctagcacagccgggaggtctttgatgtgcgtctgctatgaaccagccatcttggtcctgggcttttccagaagggtgtaattcacttttacaagcagtcctggcctggaagtcttttcttctcctcttacagtgacttactcccctggtgatcaaggttgtgaacacacttaataaacagcttatttgctagtctttggcttcaaaagggggaagaggagcctacaccaagattgtggcatctgcgtcagaagcgagggtggggacaggatggtggtgatcctagccaagcccagtgtcccacgctgagtgggtgctgacttaagtggaacactgacccagaggaaataagaaaagtcctctagggccaagagcagacgtgagccctccttcctctgaacttgaattctgctttgtttgaaccatccttagggtacttactcctctctctactaaattaggagaccgtgtggctggtgtgtgaagcagaactgattcaaatccagggtctgtcacttactcctcggcctcactctccctgtctgtggcatgaagacagtggtacctgtrttggagggtcacttcgaggcttcagtgagatgaggcctgttgagtgcctgcggtggtgctgggtgctcactgcacaagaagtggtcctagtcattgctgtgtagccattgtcatcgctgccagctccacgtgggcagggccttgtgttactcagcacctgatacaactccctgtacatagtgggggccaatacatttgactggaaatgaagtggattgaattttaggctctaacccaatgaaattctgtctgtgcttaaaccaggaggacttctgattttcccagaacctcaagggccctcaggagcctcccgtgggggttaggccagtaactctgaagtaagagtcagctggtatcagtagcaccagggtgggctcttctatcccagccctctgcatgcttgggtgtcatgtcagaacatgaggaggagaaagggctgagggaggcgagttgacgctttctcctccagttcrgaggaaggagcctgaactgccctcgttcaggggcaggggggcctgggtggtaaactgggcctcctcctgaccccagcaccttgcaagtgctttgcgtgtaaatgtttatggagtgaaggggtggatgagtgaggatgccacgcagtgtctgacctgcactgtgcagtgcagcctgcttccctaaggtgacagggagggacttttgaggtgactcctgtcccttcactgtcttctttctctgcccatgagctccttctgcagtgtcccaagctgctagggattgtggctgccagctccttcccctgttgtctgggagataaatacatgaatgtatgcttactgacgaatgaaaatgctgtttttcctctggaggcccagagggtggcctgtcaaactgtgagttctcagagtctctgagcagggctagcgcagcagaggtgggggccgtctgctgccrcctcctgcctgcaggcccatggggctccatcaccacgacccagccccagctagacaggccttcctgcccccagactggctgctttgctggtggcactgcactggagagcaggaggctgcggccccggcagagcactgttggagtgctgagatggcatgctgcctccacctgcccctcctaggctggcagccatcctaacaggcaggttcctctgagccacggaggctgccccaaacaactccacctaaaagacaaaggccgggggagggctctgcctccagatgatgagatrtaccctggcctctgctctgtggtttactcagaataaactgttattttaccatcactctttttttcattttgcctctgaaaataaagctgagaaatgactaattcacatctcaggaagcctatgaagtctgtggttttcatctctagatcaatgcctaacagtaatggaaaagaaacgcttccctgggagtaggccaccgtggggacaggccgccttgagtggttcaggacaccggctagggctgcagtcaccttgtctgtgaaaatgggaggggaggggaggtttaaacttaaccctgtgaccttggccaaggtccatgactaccgtgtgactcggtctcgtcatctgtttagtggtaataagaatacctcccctctgatgttagcatgaggaccaggcatatgccaagagctccccacatattagaagccccactcctggcttctaaggggatttcttaaattgtaagytttttaaaaatctaaattttaatatctaatttaaaaatttctgagaggaagtttaaaaacagccgctgctgatttaaccacttgattgggctccgggagggaagccgctctgagtctcagaggcgtcccttccatcccctcaagcagcatctgtggtttataagaggagcgagtctgggaattctcttcacgtctctggcaggtaagggaggggctccctggacatcatctccatgctttgttcacgcggaaaagtttacctgacgagggctgtgggttctgtttaaatcctaggagatgcttaagttattagaatttttctctatttttaaagccagttgtgttaagaaatarcagctgtccactgaagatggtggcatttatcccaaaaaggagtatatttttgaacggtctggtggccacagatgacatttatgaatgttaactaagtgccaggactgggcttagtgactcactgtatgtgcagtactgtatgacatcctcccaacggcccagtgaggtaaagatcactactcccattttacagcagagaaaagcaagccccagggaggccagctgactcagcatcacacaagatgacggcctttcccttccatctgagacgtgggtgggacgggaatacgtggataggctgccctaggccacgtgtagagatgagtgccacttctgtttgccccatgtcatagccataggacatggtggcagttcccctttgaatgactgtggtccctaccttcaragaaaatcagtctggaatgttgggaagctgtgatggtagagatttcttctcttgaaacaatagaagactgcctctttttccatgcattccatcaccagaccttgcacagtgacatttcttgaggccatcacccagccacctctgtccctgtaccaggtactgtggaggaggaaatgggcagtacctccgtgtaggaagagggtgtgggagggctccatagtctgggactccagtgctgccctgagccctgcctaaggcgagcaggaagccgcctgtgactcggtctcctcatctgttgagtggtaataagaatgccttggctgggcgcagtggctcacacctgtaatcccagcactttggggaggccgaggcaggcagatcactggaggtcaggagtttgataccagcctgaccaacatggtgaaaccccatctctactaaaaatacaaaacttagccaggcgtggtggcaggcacctgtaatcccagctactagggaggmcaaggcaggagaatcacttgaacccgtgagatggagatggcagtgagccgagttcgtgccactgcactccgcctgggtgacagagtgagactctgtctccaaaaaaaagaatgctttgaaggcgagcaggaagtgccaccttcaagacctcagcactccaccctgaagcaggcagatccaaccaggccaaggctctttgcttcatgtcccagccgtcccatcacaggaggtgagggcccaggctgtgcgtctagtccagcagcactggaaatgtggccagtgccatctgagatgtgctgaagtataaaatccacagcagattaatatgaaagaaaaagaaggtaaatagctcattaatcgtttttatattacatgttgtaataatactttagataaattgggtcaattaaaaaatatttttaagactgggcacagggactcttgcctgtaatctcagcacttagggaggctgaggtgggcagataacttgaggtcaggagttcgagaccagcctggccaacatggtgaaaccgtctctactaaaaattcaaaaattagccaggcgtggtagcaggcacctgtagtccccgctactcaggaggctaaggcagaagaatcacttgaacccaagaagtggaggttgcagtgagctgagatcttgccactgcactccagtctgggggacagagtaagtgagactctgtctcaaaaaaaaaaaaattttgttttaattacatatgtggttcacactatgtttctattggatagtactggtccagagagtccgttagaacctagaggaggagggtgaacagtataatctttcttgtctattccctggaggtagcttgaacaacagatgttctagtaacccaggctgaagcgtcccaccaaagaaagttcctgaatgagttgtctctgactcgtgtgctagaactacttagagaattatattaaaaatccatataaaccatcttatctacatctctgatattaccatctggtgtagactgaatgtcatagctgttggttgttacagggttaattcattgattcttttatctgcgtgtttgctaacaagcacttatttattttatgatgtgtcagttattgggctaagtgccagattccaaaatgaatgagatttgattctctcattggggtctcaaaggactagtaagtagaacccttctctgtcccctgaattctgaaagttggaaaagaagacagtaaggtagatagatggggacccaaatatcaccttgatttctaaagccttgcttgaaggatgcagcttgttctaagagcccagtgagcttcccagtattgagtcccaggattagaccaacattacccaaccactcatagtggctttgcacttgtcaggcctccccatctgggggacatcggagaacaggcttaccatggagggcttactctcagaggtggggagggggttggttggggcggcacatggttgggtgcaaatcacacagggcctctctgagggagaatagatgccatcagaggttttcaaacagaagggtgacatagcgagacttagctcttataaggactactctgattgcagagttgagaatggggagggcaaggagcaggggacagttagaaagccatcgcggtcgtccatttgaggaataaagatggcactgggcaggctgaccgtggtgcaggtggtgagaagtggtggattctgaatgtaccattaaggtagaactcacaggatttgccgaaggattgccagatggactcaagcaaaagagaagaatcaaggattttaacctgagctgctggaagggtgaaatgtcctgtttaccaagatgtggtcaaagcaggtttgggaggaagcttcagagatacagttttagacttgtgtttgagccacctgtcaaatgtccaagggaatcaccaagagcttgtgttgtgtaatgagaccacccaacaatgaagtcatctggccctcttctctatctacacatgtccctgagggcctccactggtcttctagcttcctatactgtgtatatgccgacagctctcgaatatatacccctagccttcacctagctccttcacttctcttgaactgccaaattcaggctcctgtggatgtctaatacagtatttgtaagaagaggaaataaggatggatatactacttatttctgtgtaaatgagggataaaacagaagttatgtagttttttaacttttgaactgtataaatattttacaaattcagaaaaaatcctgaaattgaatatcaataaaaacaaacctaactgtatattaaatgataatataacccacacagaaaaaagaattagaatatctttttgaacacagtacttgctatatgcccatcacaggatatattctaaggactaaaagaattgctaagaaatcttgaacttttacctttagtagttgttaatgatattcrtgtagcaattctgaagaaattttgtgtttattgtaggataaggcaaatgaatagattgatgatgttagaaaccagggttctcactgwtwggaagggagctgcaaatatggaatcaaggaaggaggaagaacctggtggtgttggcttgcagtaagaaataacagtattaacttatgatttaaaaatatatagatatatacacactcatatttaattatatatatttacattaaatacatgtacatatttctctcctagctgtgtccactgaaaggacatagaacagtgacatcccagtggcaatgagcacatctaatgccccgatcttggtttctaaataccactccccaccaaaaggagctagggtacattaaagaaatggcagattccaagctgatttcctggagaaatggggtagggaaggtacggggtgattctggagcttcttttgcatcaaaaaccaaagaagtattcaaagattgatggagactcctcagtaacactggagatgggctaaaaaggttccctctggccaagtttggaagtttgaacatgaaagggcatgattataatggattataacacactgaataataaatgaacacccaggtccatagtgataccaaaaaaagtaaagggtgggggcctattacttataaaggaatgccagccaataaatatcgaggaataattaataatcaccaatgtgtaaccaccagtaaaataaagattcacataaggatcatcagtggatgccaaactattcagtgaaaatttgttagggaacaagatgcttaaaatctcaaattgcagtacagattacttattagttacaaaggagaaactatatcattgcagtggagaaatttggcagataccaccttaaccaagtgatcgaacttagcattatcaataactgattaataatacagtagaaagcacataccacccaggaactgtgtttaccaagcatgtattacccgaatctcatgacagggaacaggcagatccaacttacgggggacctcctccaagacaactggcaggcacttttcaaaatatgtcaaygtccaaaagccagtcccgtccctcctgcctccagactagataagggaaattggagagacatgacaaccagatgcaatgtatgctccttaattggatcttggatttaaaaaaaaaaaaaaaaagctatagagaatctgataagagaaatttgcttatggagcaaatattatgtcagtgttaaatatcttgggtatgataatgttattatgttatttatgcaggagaatgtccttgttcctaggagagagacagctggtagtatttagagatgtgttataacgtgtgcaactttcagttgctttgatgaaaaataaatttgcatgtgtgtttctgtgatagagaaagaaaagggatggaaagcgagcatggcaaaatgttaacggttgacgaatctaggtgaagggtatgtggacgttcgcttcatagtattctttcagcacatcaatagatttgatttttttttttccaaaatataactttggaaagcgggcatggcagaatgttaacggttgacgaatctaggtgacgggtatgtggacgttcgcttcataatattttttcagcacatcagtagatwtgattttttttttccagaatacaacgttggaaccaggcgtggaggctcacacctgtgatctcagcactttgggagactgaggcaagaggatcacttgagcccaggagctcgagaccagcctaggcaacatagtgagaccctatctctacaaaacgaacaaaacttagccagggctgggcatggtggctagcactttgggaggccgagacaggcagatcacttgaggtcaggagtttgagaccaggttcgccgaaatggtgaaaccctgtctctactaaaaatacaaaaaaaaattagccaggcatggtgattcatgcttgtaatcccagctactcaggaggctgaggcaggagaatcacttgaaccaggaaggcagtgagccgagatcgtgccactgcactccagcyttggtgacagagtgagactccatctcaaaaaaaaaaaaaacaaaataaaacaaaaaattagccaggcatagtggcgcatgcctgtagtcccagctcctcaggaggatcatgtgagccccagaggtcatagctacagtgaactgggatcacaccactatactccagcctgggcaacagagcaagaccctgtctcaaaaaataaaatgttgggggaaaatgaaggataagaggaaaggaactgtagacaacatataggcaagtctttcaagtggttttgctatttagagaaacaaacgtgggagtagctggaggagaaggtgggcttaaggactcgggtctttaagatgggggagatctaccatgtgtatgtgcagacgtgaagtgacacacagcagaaggaaacctggtggtggggagaggagagaatggctggtgcagtgtgtgagcaggccgggtgggtggggccccaccgctgatgtaaggcacagatgagatgcctaaaaagtcattgaatgagttttggttttaattcttaggcgagcctcatgagacagatactattattaaaagtatattgattcaatcttggttaaacataaaaaattataagattcaattgtatttatattaagttcctagaatttttcatacagtaagggagaagagattggaaaatgcttatttactggtgatttaagatcctaagaatgtatacatttatgtaggtgttatcttttattatttttaaaaagatgagacaaaagtttcctgagatattcacaggctcttcctgagatagtcaattcagagttcttagggaagatactcattctggaatattcatgggtaaatacatttgtttgttttagggaatggaatttccttaagttgtaaatgaactttgcagttgttaatctgacccatataaaaatcatgtgggctctttttccgaagaatcttagacctttgtatctgggttatttcacctttttgttggaatatactatacatcaggaagtatatacacataccttatgtagatagcttgcaggattttcgcaagttgaacacactggtacaaccaacccccagatcaagaaacaggccataaccgtcacctcagaagcccactgcttcatgtcacctgccagttaaccaccccccactccccgagcataaccactatcttgaatccccaaataatagattaaatttgtctgtttttgcatttatataaatggaatcgtataaaatgtactcttttgaatctggcttctctctacactcgtgagaaccatgcatgtcatgggtgtcgattgcatgatattccactgtgcgacggtgccacggttcacccgtcctgctgtcgacaggcattcgccgagcactgctgtgatattctggtacatgtctgatggtgacctcacacaggcgttctttggagtggagttattgggctggagaggaaggatgtgttcagccatagtgggtggctgtcagtcagcagggtagagagtcccccttctcttcatccacaacaccgatagtgttccctgttttttctttttatctattcaggcatgtttgtggtggtagctcagtggttttaatgtactgcttcctgatgacaaattgagcaccttgttatatgtttattggccatttgaatgttgccttttgtgattctgaatctctttgtaatgcttaccagttatgcaagtaaaatgaaaagggtggttctgtcagatcttaacccaaatccaaggtgaagcctggtttcctgcataggcgagaaggccccagggcccagaatccctcctcaccccttctgcctccatccagggccccactctggggcaggcagtgctggctgcattcagctcagtggggggcagtttgactatgtcgcatccagcttcccatgccgtccatccctaggagtctgtctcaccatacaagggcgcagacaggccagcttgagggtgttcatcaacgcagcattgtttgaagagcagaagttagaatctattcattcgggggcctgactgcataaatacactgtggttgccgtccagcagagcatcatgcagccattaactgcactcacatgggaaaatgcccacaatggcttgttgtttaaaaaaaaaaaaaagtgaaaaaatrtttctgctgtgtgtggaattatgagaaatgtttaccgtctacgttatatatttttacagtgcttggatttttataatgagattgtttgaaaattttttaaaagataggcttaatattcccattagcagtgtcatagttatccagtagacttcctgaacaattgggtagtaggaatggattttcataacaaaagagtctttggaattgcaaaacttcaaatattgttttccctctgttttaacaggaatagttgtatattaagtaagacagaggatctttccatgttaaagttgttagaaaaatataactccaggccgggtgcagtgcctcatgcctgtaatcccagcactttgcgaggccgaggcgggcggatcacggagtcaggagatcgagaccatcctggctaacacggtgaaaccccgtctctactgaaaatacaaaaaattagccgggcgtggtggcgggcgcctgtagttccagctactcaggaggctgaggcaggagaatggcgtgaacccaggaggtggagcttgcagtgagccgagatcacgccactgcactccagcctgggcgacagagcgagactccatatcaaaaaaaaagaaaaatataactccaggttgcttttggctcgactagactggggttatttttagcttttgcctttttaagtgttggcagagacctgacgaggttatcacatgacaataatagctgccatgtattaagtatttgctatatatcaggtccttggctacatgctttacacacgggtcacatttaatctccacaattacctgaggaggagctaggtctgtggctatggctttcctctaggtgaggaaccggaggctcgggtaaaaagtttgcccaggttagtggccgagctgaagttaaaacaaagacacacaggcctggcgtgatggctcacacctgtagtcccagcactttgggaggctgagatgggaggatcccttgagcccaggagttcgagaccaacctaggcaacatggcgaaaccctgtctctaccaaaaatacaaaaattagccagtctcgtaacctggtctcaagataaaataaataaatagatttaaaaaaaaagccacagacttcagctctgctgcctcctgtgcccatagccctctgtctccatctttaccttgcrgtccacaaaatcctagacaagtgaaaagacttttaaaaaattggaaatcctcatctttaaaaaagcttttcctaatgtcctcaatcacgcctccactccatttgtcctttttatgcatttggaaaatggggaatgtttattaagtaagtgatctctaaatccttcccagtgctcgacttctgagcccagtagaagacagggaatgaggaattagccacagcgtttctcaagattggctgcctcaaagttgtccaccttgcccttgactttgtgatcccgtgtggttgatgtttagagactccccaccatccctggtgagagattaagttgagacagaaaccactgctaagttgggaacccagctgctgctacaaatgacacagaaagaaggccagttgatagccacatttgtcagcaacaggcagagaccattgttaagcctggccgaggggcaagttaaaaatttaagaatgaaatattggcatctggcagaccacttgaagaaattgggttggctttgatgtctttttgctctgcttggttttctgttgagacatgattctgtgagcaggctacatcctctcctccggcccatcctctttctctctcggtagagaaggacattcatccgacagccagatctgtagcctgcgatggttgcccaagaaagtggctgctgttggtaacatcacagtcaatttatacagaaattgtttgtaagctcatataagccacccttcctctggaaggaatgactagcagattagtcactgggagtctctgaccttggggtaaatgtaacatggagcaagagtctgmggctttctgttctcaagttcaggtgaacttgaagttgctctcacagattagatagatcacaataaaatacaccagcatatggcatttccaggtgaaggaggacttttgtgtcctttcttagacatggccatgtgggaaagtttgcatgtctggcaaccccaggtgccgggaggaatatggagcaactaggactctcccaaccttgctagtgggactgtaaagtggcatagccacttgggagaattgttttgcaatatctgtaagaatcaatgtggcatataccctacaatccagccgttctgctcttagaggactgttggcatgtgttccaggagacatgtatgagcagcattgtttattaaagcaaaaatgctggaagcgacccagtgtccactgacaggagagcagataaataaagctgggattatggaatctacggaatttctcagcattgaaaacgaaatcactgatacaccccagcatgcctgagtgtcaggcctgctattgagtaaaaaacaagagcgtgagaatctttacaatatgccatcacttaggtaacgttcacaaacttataagttaaactgtatatgtcgatataaactatcctgaaaagtaagggatgataagtctgaaagtcagagtcgggctgcctgtagggaagagatgtggctgyagaggagcacatggcagcaccagtggaatccatccgcttctcgagctgcaccatccagtgtgccagtcaccagccccaggggctgtttacacagttaactcacagttcagtgcctcagccacagcagccacaatcaggcctcagtagccactagtgcctgtcgtgttagacagttcaggtaccggccgcctccatcgctgcagaaggttctgtttgctaggccagatggtgggtgcctggatttgattcattctctataacttgtacatatatatatttgtatgaaatctttaaattttttgttttaacttcaattctagaaaattactaaagagacgcatatacaaattctacagtgtaacttcctaagtgtgaaaagcaggggaatagcaagagagcagttggtggcactgcctgcgacgcagcagtcatgtgggaacactcccttcacgtcgccctccatcccagatgattgacgtgcatgagaaaggggcagggagagtgcatctgtctgtctgtctgtctgtctgcctgcctgtctggagccgttggcgagattgccctaacagcagtgttcatgtgagggcacctgtcgtttcctccccaccctgctatcgcaaagcattatagtacctcctcagcactcaaaggcatagtgtgaatgaccttgagaatcacctgaagcctgtgctgctaacccaaggtttcaagaaggatgtgacaaacatactgtcctagttagtgctrtcctcgatttccagcgttgagaaggttggttgtcatttgaaagaatctcttctctctgcctgatttatggcttcttgtgcyagagctggctgtgctgaggtggataccctgaggagggagatttattggtaggcattgcactgtctttaggtgctgacatgttttcccagccttgcccaaggcagacaagaattgtgagtgcaataataaacctcttgagttccatcaacagctcataggcagaagtgcccttagttggtccctgcccttgcatgaacctgagagggttttttggtgatcgacctctacacctcacttgtctaccccagttccgccgtggtcatgacggcgcagttgtgaatcttgccagctcctcagccccatgcctgcctgaacagcaactcagggcagtagacagtggagaaagcggaagttggctcacccagcctgaagatctttgagcaccagagaacccacgcatcctgcccagacttccccatttgtgtctgctttccctgcttcagtcctactcaacaggatacaagtcacatggattaggaaactgctctgacagcccatctgacttgggaacctgcctggtgagggaagaggctgtgtcttttagggacactgtggggctgccatcagaagacatggagtagggacagcaataggatccgtatgcagggaggcaggttaaaccaaagagggaaatagactaataggctaaaagccagattgagacttctggttcagtgccaaaggaagagaagagtgggcatttataaggtctcatttacttagaatagtgagttaaatgttcagtgttgcagaataactggatgaagatctggaagcagctgggaaataagaattcggtatcgatcgaccttgctatgcatccaagctccttgtgttgagcgggtgccgtgtgccaggcattttgtgaaataccttattgtattatccacagtaaatatctcatttaatctacatcacatcagccatctcaagaaatataatgttatctcactcattttccagacaaaataagggaaagatttagagagatgatatctaagtatttgaatgcaaacattctgactccagtgcacaccccccttttagaaaattttttggccgggcgcggtggctcacacctgtaatctcagcactttgggaggccaaggcaggtggatcacgaggtcaggagatcgagaccatcctggctaacacggtgacaccccgtctctactaaaaatacaaaaaaattagccaggcgtggtggcagtcgcccaggctggagtgcagtggygcaatcttgcactgcatgctctgcctcctggattcacgccattctcctgcctcagcctcccgagtagctgggactataggcatgtaccaccaggcctggctaacagtgcacaccctcttaagcatcacatgaaggattagactgttcacatccatgttgaagtataaagaaggaagtataaactgtaaatgggatccaccctgcttgggtgaagagagagaagaggcaggacagaggggagcgggagaagtcacaccatcccagttcatttgaatgcgagggatgactgctgacatatgagggctggtgttgagagcctcctgaccctgttgagctgttccaggtgagctagccaggtgcagcagcttcctgttgacttgtgtccccatctggggactaagaagggctttctgcagctctggccatcacacagctgtgaagctgtttggtttgaccacatgtgaatgcgggtcaggccctggcttttctctttggtccagagcgcagtgggtgcctaggtaatttgcaaagggcaggtagtttatctgatcctgcctggccacctggaaggtctttagcaagggaactgaactttggccttgttaagtcacgtgcagcaatagtagacagagtgagagccatgtagtgcaaggtgccgtgctatttatttggagggttgttttgtttggttttctggtttgttttgttgtactaaattgctggaaaaacttgacagagggagtgctttttatttttaaaactacaggtatttatttttccattgcgtaggacagtgttttgttgcttaattttcagccaatttcaagtatttctgctgttactaaaagmagcagtcttcttcctgggatatttttgttgttggttggtttcttcatttgttgaatatatgtttactgattatcttctatgggccaactgccatgtcagcactgggaaaacaggcatgaacaagacaggtacagtcctcagggaacttgtcccccaagcctttatttttttgagacagggtctcgctctgttgcccaggctggagcgcagtgctcactgtagcctctaactcctgggctcaagcagtcctcccacctcagcctcctgagtagctgggactacaggtctgyaccaccatgcccagctaatattttgtaggtagagacaaagtctcactctgttgcctaggctccaactcctgggctcaagtgatcctcccgccccagcctcccaaagtgctggaattacaggcatgaaccactgcgcccagccatacttgcattcttgtgaggagacaggtttaaataaatcgattaataagatgttttcagacactggaactggttgtaataatgctgagatgaaggaagactgccagtgggcttttttaaaaaaatagctttattgatatataattcacatatcatacaattcattcaaaaagggtacagttcttttttttttctagtaattcactgggctatacaaccatcaccatattctaattttagaatacttttgtacaccaggagaaaaaactccatactgattatagcagcccctctccatctctgccccgtccagtcttaggcaaccaccaatctactttctgtctctatggatttgcctattctggacatttcaaatgaatggaatcatacaatatatggtcttctgtggctggctgctttagcttaaataatgttttcaaggttcaactgtgttgtagctgatccgtacttaatttatttttattgccaaataatattccattgtatggatataatacattttatttagtcattcacaaacatggacatttgagtttttcccacctttggctattatgaataatgttgctgtgaactttcctttgacttacctgtacaagtctcatggatttaggctttcatttctcttgcaaatctgcccaggagtggaatttctgggtcacatgtcaactctgtgatcttgtgagaaactgcccgacattttccaaagcagagaaaccatgttacattcctaccagcaatgtgtagggcgttcagtttctccagtcctcaccaacacttggtactgccttttttattagacctagtgtgcgtgaagcgttacatttccttaatggctaattatgttgaccgtctttccatgtgcttattgccaatttgtgtatcttctttggagaatgtctgctcagactctttgcccattttacattgggttacatgccttttattctagagctgtaagaattttgtaatgttttctgtatacaagtcccttatcaggtatagctgaccctccatatccgtgggttctgcagcctctgctgattcagtcatggtcagaaatatacagggaaaaacaataaaaataacagtgtaataatgcagattttaaaataaagtataactatttacataacatttacattgtatttggtatcgtaagtaacctatagatgatttgaagcatgtggaggatgtgtgtcatacacaaatattccactgttttatataagggacttgagcatcgtggattttgatccccgcagaggatcctggaaccaagcccctgaggatgctaagggatggctgcatatgatttttaaatagagtcatgctctgcataacgacatttcagttagtgacagaccacattataacatatgtagggcagaccacattataatcttatggtcccataagataatcataaagctraaaaattcctgtcgcctcgcctgatgtagccatcattacatccagcgcaatgcattactcacctgtttgtggtgatgctggtgtaaatatatagcacatatggttatgtacagtacgtagtacttgataataaatgactatgttactggtttatggatttactctactttttatcattatttgagagtatgcttctgcttactaaaaacaaaaaagttaactgtaaaacagcctcaggcagatccttcaggaggtgttataaaagaaggcattgttatcataggagatgacagcttcttgcattttattactctgaagaccttccagtgggacaagatggggaggtggaagatggtgatactgatgatcctgcccccgtagacctaggctgattaatgtgtgtctgtctttgtctttaatgaaaagttttaaaagtgaaaaaaaaataataattttttaaatagaaaaaagcttaaagaataaggatataaagaaagaaaatatttttgcccacctgggcaacatagtgagacctcatcgctacaaaaagtttaaaactgagccagacattgtagcacttgcctatagtcctagccactcgagaggctgaggcaggaagatgtctgagcccaggaattccaggctgtggtgagctgtgatcacaccactgcactctagtcttagcaaaagagtgagaccctgtctcaaaaaaacaaaagaataaaaatgttttttttaaattaaaagtttataaagtaaaaaagttacagtaagctaaggttaacttactgaagaaagaatattttaaaaataaatttagtgaaggttaaatgtgccatggttataaagtttaccctggtgtacaggagtgtcctagaccttcacatttactccctgatttactcagagcaacttctaggcctgcagcctccattcgtgatagtgcctttcacaggtggaatttttaatcttttataccatttaccgtacttttctacatttagatatggttggatacacaaataccattgtattacagttgcctgcagtactcagtacagtaccgtactgtacaggtgtgtagcctcagagcaatgagctattccatatagcctaggtgtgtagtaggctatcccatctaggttcatttgagtatactctatgacatttgcacaacgaagttgcctaatgatgcattactcagaacttattcctgtccttgagcaacacatgactgtattttctttcatcctgtgggtttgttcactttcttagtagtagtatttgtagtgcaaaagttgttagttttgatgaagtccaattttctatttttttattttgttacttgtgcttttggttttgtatctaagaaaacatggtcaaattcaaggtcacaaaaactgtttttttctgagaggtttacagttgtaactcttacatttaggtctgatccagttcaatgtcagataggagtggtgagaacagatgtcctagtcttaattcctgatctttggggcaagtctttcagtctttcaccagggcccagaggattttgaacaccttacttctgattcagtcaccgctgccaactccagagccttgcacatgtcacttgttgcagtttcttaaagaatgaagaggttgatgcgaaagggccttcctttccagttctcacatcctacacatctgtgatttgactgggtgttctttcttctcagccagttcccttggatgttagttagatcatcacacaaactctgtaaggacacttgggaatatttgcaagttctttttccatatttatttggactgcctttgatttccacaattccttgatgaaaattgcaaaaattgaagcatgtaagcagaaatgttttgtaatggatccatacgtcctttcccttgaaactctcaacagccaagaaaaaagatgggtttggggacattgctcatttccacaaaaggtcaatgaaccatcgcttcttcccactcccatctaacagtcagtaccctctttgttttcagactctcagcgttctcatctctcttccttcaccatgaagctgatggacaaattccactcacccaaaatcaagagaacgccatcaaagaagggaaaaccagctgaggtgtccgtaaagattccagagaagcctgtgaacaaagtaagctgactctggatgtttctcctggcctcacctgcttccagcaatatgagtttgtgcgatttgtatgttccctccctggggattgagctttcagtgcatcatacctacttcgtagcattccatgggcgggacctttggtgtccttgtaaaataagaaccattaggatggtgagtgtttgccacgttagccaagctcagttggctaagacagttctccttttccagctgtgtcatcctctgggcatttaaaacagctcagcacatcatgtccacaccccaggctgctgcctccctgccctgcagttccctacgttgccttggcgcacactcaaacacagggaactctgtgatgtccagaacatccatcatttggctttagggcctgtgctctgaaacatgcaaaccccttgagacacagccaaagatgtcctcaagagttagtggcctcagcagggccagtcaagccagatatgttgaaacagctattgactttcatcaacccctcccttcggcctcaaacagccatttcaaactctgtaggaatccaggyttcctctcttccaggaggcaacagacagatttctaccagagggctaccctctccccttggatctggagcagcaggcagtagaatttatgtccaccagtgctgtggcttccaggtctcaaaggcagaaggtcagtgtaacattaagaacaattgggtttgccttgccttctactgcagaatcctggtccatggttttggggatggaaaaaactctattgcactattattatgttcaactgggtggtgaccgtgggctgaattgttcaggaaagagtccaggggaccttggataaaagtgagagtttatgcaaggtcccatgatctttggagagagctttgtggcaaaagcttagggattctttctggggttggtttgggtgtgctgcttgggtccaacgggttccaggggatgtgggcgagtctcatctctcaagaccagctgttccttgaattgctaagatgatctgaatagtttagaagggaaaaggcttctgaagcctccgagtgctttcttacccatctcacaaggctggtggagtgcagtgagaccgccgcataaccaagtgctctcagagccccagacacctgtgtccctaacatttatggagccttttcttggtccagtgctgagtgctttacatgtgtcctcttacttgtcttcatagcaaccctgatgtgtgaaaagttattttgccaaaaaggaaactggatctatagaaatattaagcatttagccaaagtcgcacagcaaaaaggtggcaaagtcaagatttgaatgcaggctgtctgacgtcagagtctgaattgtcgagatgctacgtttcctctttatgaaagacagaatttttaatatctcgtgaatttaaatattaatcctgactcattacataaaaataaaactaggctgggcacagtggttcacgcctataatcccagcactttgggaggctgaggcaggcggatcacctgaggtcacgagttcaagaccagcctggccaacatgacaaaactccgtctctactaaaaatacaaaaaaaaaaaaaaaaaaaaaaaaatttagccaggcatagtggcaggcgcctgtaatcccagctgcttgggaggctgaggcaggagaatcacttgaacccgggcggcagaggttgcagtgagccgagatcacaccactgcactccagcctaggtaacagagtgagactctgtctccaaaaaataaataaataaaactaaacttagcaatgtaaaataaaataaaccttgtagacagatattcttaatcctttagtgattatccaaagtataatttctatgtagcagaactactgtcacagccatccatttaatgccgctggtaaacactagcctgttatttaaatacataattcttgaattttgcagttcatctatttttgggttttatgttgaccagcagaatatcttaaaattttagttaaaagtggaggaaaataaaggttttaaatctaaaagtcttttgttgraaagtggtttttcctgccccctcttttaacgaaaggtgactgacaagcaagagggaaacagtcagtgtttgccagattgatctaaattccagattgaagaagagtaatacagtagatttggtctgtgccacagttattttttattgcaatctgtttagtaacctcttgtagccgaatgtagtattaactacaagtagagtgtaattgtcatccaacactagtccaggcagtcagagtaaaatgattcacttactaacaacgttatcctgctagtgaattctgatatgaaactgttcggccactcaattcctgggatttcccccctttttgttgtttttgttgtttttttgtttgtttgtttgttttgagataagagtctcactctgtcgcccaggctggagtgcagtggagcaatctcagctcactgcaatctccgcctcccaggctcaagcaattctcccgcctcagccacccgagtagctgggactacaggcgtcctctaccacgcctggctaatttttgtattttttagtagagatggggttttgccatgttggccaggctggtctcaaactcctgacctcaagtgatctgcccgcctcatcctctcaaagtgctgggattacaggcatgagccaccgcacccagcygggattttcccctttattcatttttccaagagaggtcacagagaaaaattcagtgctaaagtaccgctcatttagtggggtgcctgtaaaccccaggggccatttggcaatgtctggagacatttttggttgttgccataggaaggcaaagcagatgttattggcttctagtgggtaggggttgggaagctgctaaacatcctacaatacacaggacagccccccacacaacaaagaattctctgccccaaaatgtcagtagtgccaaggctgagaaacctgttctgtagcagggagctgtaggtgtgatcttcacccaagaaggaatgttacccctttttcatcattgctcattagraagggttggatgwctgtgttctgtcccaagccacctgcgtgggacaagtaaatgcgaacctcttgcttcgtggaggcccatggacagaaccagaagcattgagaaacttcccagagtacgtggacttagaggattatgtccaagaaaccttgcagtgggtctgtcatctgctgccctcgttgattattcattagctctcttaccacttagggagtgattacgtacattcttattttacttcaggtcatatgcatggctttccctgctcagatacgagggaaatggaagtgcagggagatgaaagtacagattcagattcgctgccacttcccgagggctccttctcgccccagccctgtcctgggtggtttcagacatgctgtcttatttactcctcaccataattgtgtggggaagcttttattattcccactgtgcagacagtgttggccctggtgcacattttcttgatcaaaatctgtttttctcactatattctgttgtcttcccagactgattccacattagcagtctcttgcatcttcttagtgaatttaaaaattcaaagtacattgtgatgaacttctaaacttttttgcaaccttttaacaagtctagcagtgagctgcagagtgttgaagttgtagaggaaatttagccatataytgggtgtccaaaggtataattacaatgagcagtgagcagggggtcctgggaggtgttaatgccccatctctgagggcatttggacagagattggatccgagtgctcttgggtggattcctgaaagcctttccccttcagctcttccagggagatgctgctgccggacagcctggtggcaggtggtgatttggtgctctcattgtaaccaatgtctgtgttcgacatgtcttcttgctaggcctcactgttctggactaataggaataatgttgcattgccattttttttttaatcctgcaattctagttttttattatactgattgtgacttgccctccccctcactccctggctttacccacattttcagggtacactgtcctatagtgtggaaatgaggcttatgttgctgtggagaggggaggcacccaggctgcagatgggacaaggagtgacagagcaagtcgggtgtcccggctgcggcacggctgtggggagagaactgtctggagaggagggccagttttcctcaccctcttccccgccatctcctgtggcagcacatggctgtggagccacagcctgggcgtcagaaatgaatatggcccacggggcaggaaaggcgatggggrttttatgtccatctctgycatcggggtcttagtttactcgtttgttaaatgagatctttttgaccaggggatctcaagtaaactttttaacttcagcacatttctgatctggtctttattctcctctctatctctccaggctctgaactcagacagaccaagttcaaattccatatctgtcactacagctgtgtggccttaggcaagttgcttaacctcccccacgtcccactaagcctcagtttccccacctgtgaaataatagtatccacttcacagggtggttgtaacctttaaacaaaatagcctatataaaatccatagcacagtgggtgcctccatgtccccgatgagtggyagctacgatctggcctctttcttccctttcagatgttcccatcctaggccctctttctctgctttattactggcaggtatatggtctctggtgttggtatagtgcctgttaaatgttgtgaaccacttcatatgctttctcattcagtcccccacagtcacctctttagttacacggggcagatgttattctccccattttgtgggtgacaagcccaaagcccagcagttggctttgtctctaagccatccccagacacggacagcctcatttagtttccaggcttatgtggaccaatgatggcaatccatcccccacagcaggaggggtgcgcaggtgaacgcacctgccctcgggttatgcagcgaggcagcttcagcaaagccaaggcatggagtccccagtccgagccagtgctggatgtggctgtgtggctgtgaactctcactgctggctgcattcacaaggatccccagcttgacagctgaaaggctggagaatgcacaacacccagaggccattaattctgggagtagaatctgagttcacggaggcagcctggctgtgctacattgttggctcctttaggaggagcccaggacagcctgactcttaaacagctgatttgatctctctgcaatgacagaaaaactctctgctctgaagtgccttgccactttcgagtgcctcccatcttcagattagccactttctccctgtgtgacctgatgacacattttcttaaaatgtttcctgttcctcagcaagtttcatcattgctggtctctaacactttctgatgtgctaaggtggcagtgttactgtcatagtcctcttcttgcctggttgaccatggctttaggcacatctgaggtctgtcggcactgcgactccttcacactcaggttcctccctgccccgggcagatgacatgaagcagagagctcttgtccacgaggtggaaaagtaagcgcccagcctcttggaaacagaccgtaaacaaatctgtcaggtagtgaaaagagaaaaataaagccagggtgcaggacccagggatggggatgaggaagggcacttcccccaccatgggagaattgtgtcttctagtctgcaggacaccttgtgggaaagactcaatgaaagaaatgactgggtcttttgtgcattgtctgactaaagtagccatttatatatttttcttttgacattcccatgaaataaaagcctctactattgaacatttttatatttaaaatgatattctgcacctttttttaaactttatttttttaattgagacggtgtgtcactatgttgcccaggctggtcctgactcctgggctgaagtgatctgcccaccttggcctcccaaagtgctgggattataggtgtgagccacttcacctggccaatcggcactattttagaagaaaagagctagtattcagaatcataagcactttttattaatttctaccatttgtttgtctgtatattgtttaaatcacctttttctagaaattatcttcttgccctcagtttttatttatatcctctagacctctgagatcctgcaggtggctgtttgcctcatacacacccctcttaatttgcactagacatgtaatcgactacttgagtacactgtccattttgggatttatccattctgtagactactctttttttttttttttttaaaggacagcctcccaaaccagaacaggttcagagactccacttctgtagattactcttagcctccttttcctgccagccagctgagacctggatcattgacatcagggcaagtagaggggaagttggagagaagaacaaaaggggtgtgtagacccaccaactggatccaaggcctcccacggtcagggagaaaagcttggggttgtggcttaaacactggaaagcgcagggctctgtattttccctttctctcaggtgggcttctctcaggagcagagggaccatgaatgctgctagcgcccactgcatgagtcgtgattgaatcttgagaatcacggtcatctgctctggcttctctgccttttctccccagatttcctgccccttctagccctgggagcttccaggcccttgaggaatagcatatcatttccttgagtgggggcttcagtggggtgaacaatctgggaacctagtgaggagtcctgagggaatgggtttcagcccctcatgccctggaccagtcttacacagtctttcagatctttgaaacaaaagcctggagcttcttgatgtgatttacaggatacagatgtaccatgggccttgactggtgcttctccaagtcatcagcaaattagtcctcactctagttaacagggttagtggtggtctgtcagtgtggctgatgaggacagacaggaggataagtggttttcaagacctcagggtctggaaagggaattcagaaatttctgaatgagctatcttggtccaagcccccttcttccttcagctctaccctctgtctcctgattacaatccttagaaaaatgatctggcttggtttctgtagcaagagcctttccattcctatcgatctcaagctggtttaaagaaaatgttcctttattttttcaaaatagctccctttaatctctctcctcctccttatgcctaacgtctcctttcagaacctgagctggctggaggagaaagagaaggaagttgtcagtgccctgcgctactttaagaccattgtggacaaaatggcaattgataagaaggtactggagatgcttccagggtcagccagcaaggtgctggaggccatcttacccctggtgcagaacgatcctcgaattcagcacaggtgagtggctctgaagtctttggctgtgtcagaacaatggaagccttagaagcatcttggtttggtggcactggaaactcaaggttcctaggaacagtcaggaaaaggactccatcacccctcatccttcccctgaccactccccccacaactatcccgtgatgccatctcagagttgaggtcactattactcctgaagcccgggacacatctctgccatccctagggatgtggccacagtgtaagtttgtggtcattgcagaacttaactgcgtcaagccaggacgcctcccggacatggagcctggattcactgcgggtgggaggagcctgttttgaatgaaactttttgagtttcattatctgtcaggtggaagctactgtttccactcatcgccagaggcccagactgaagagcaccagcagggcctccatctgcatgagtctcttcacagacttcactgccaggggctggattgcaggctcacaagctaagagttttttagtaccttagaccttgggggttacacagcagcctggaggctgcacagggaggcgaagaagcacaagctgggagagagagaagggaccctatggaccagcgccgcttttggggttattgggtccagggcgggccttatccaaacaggcctcctgcagggagctttaattggtgggtttaaagcaagcaggcacgtgttcaggaggcgcagcctttgactaagaggtggttgctttaagttctcaggcaaatggtctgtttaaaggatcagtaggtaagccaggagctagcctgctggcgggcaaagatgcctgtaagtttctgtctctggccaccagctagagccagtcgggtagggtgtagtattaggaaccttgtcaagggttcgtgagccctgcttctggtatgagaaagctaaacatattttaaaacagatgccgaggcaacataaaattacaagcactcgctgcaggggacatggagccggcctttgccccaagaagcttttgttgggtaatacttttattgctggagtacattttcctcttaaaggttagctagcagcttgtcctgtatttattgttaaatgtaaaaagaaaagcactaccaaatgtaatctgaaatgaaagcctagcaggagctttttcttaagaggctggcacatgttttgtttttcttccatggtacctgttcaggataaatgcttctctgtcgcaattccgcaagatgacttagtgttcatttagccccatgaggctaagcttttatgaactgctttcagaacttggcaatgaagttcatagttttcttcttctgggggataaagcaaatagtgtctttatttacaagaaactctctgccctggggcttcctccctggagtttcagctgacgcgtggagactgtggtcttttggccagaagctcgctggcgctggttggtgacgggaaggaggcagggcatgcttgtcttcactgtctttcccagagtcagtccagctccggctcttagaagtgttcggtgctgggctcctaggagcgcatgtgctgacgtcatgccacagcgagatgtatggattccctcttagaacatgtttttgtggacctagtctcatgtggtagtctctgccttggaatagttaaagcctagttgaaacaaatcagctccctctgttctacgataaagcacttattttacggtacagggaggaagctgtgttggagtttgaagaagggagagttacaggggtgttggagttgatctgatgaagcctcttgactgagtagttcctggagcccgacctgagggaaagcagcagttggattggcagtgggggcaggagaacaagagcaaaggaactgaggccactgggcctggtgtatcccggggaggggagggcggcgactcgggcagtcatgggcagagggtatatgtcctagagcatggacgagaggggaacagtgggaagaggcgactgatcaccctgcaccctcaggcgctaagcctctttgggagagtccaggatagcgtcccckggaccctcacacccagagtgtattgctgctagragtgttgcttcccagagccaggctctgcttggaggtcacttgcaaaccctgggtaagaactgatgaagtcacatggtaatggctgggggtattttttgtctattgaggggtggctcttaattgacattgaatgtctataaccatttcctagaggagaaaatgggaagtgcctgggtgtggctgtaaggacccatgaaatatggtttgttttctggtagtcctttgactaatcccattgaaggggttttccttctgaaattcttccaggctagtggaggtggttttcttggtctcccacagtgattggaaatacctcctcagatgctccttttagatgctttgcattatctctttcctccctaagtgcagtttgcgagctggaaggtcctttctcgtttcttccgtggggcagggagtggggggtccttgsaaacaggccctttgccgccctcacctcggttcctgagacagtgataggctggcctccaacaagcagctggctcttagcatgagctttgaatggaggattcccgagtgaggcacgcagaggcccatgtgagagcgagagtcacactcgtcacatgcggagggctttgctccattgtggaactgagccagcagctgggcctcagatggcattttttatagtcctcaactttccttcctttcttatgtcttagccccttgacacaggaatattctgcttccaagctaatgacgggaaggctggacataattccagcaccttccgggaaacgttagcatccaatgcagrtagaaaggaagtagtgaataaaagtgtttcccctctttcacctcactgttaccagcagtgtgacagtgagatgctttctccggtggaatcctcctacagcacatcaggggaaggcagcaggcttctttcaagatgcctcacctggccttgccaggaagcagagcgaggtccagcccagccgttagaagcacattcccctgcaggatcagawcagctctggtccaaccccmggagagactgcagggtctttgttttcccctctccgtcctctttcctaagagagtagttccaacaacaaatacttttcatccatataatcttctaaaatacccaatcctggctttctcagggctcctttaggaattttgtttgtttgtttctaatggacttgaaaagtttgctttcattcctgccgacccttttctcctgttggaacatgcagagtggaacgcctggctaaatggaaactttagatccttgcaaaaattgtttcctccttgactgattctgaagagcttctcattaaagcactatttggttcacatttttgttctaaatagctttgtttttagaacctgttttaatcatatcttacaatattatatattttcctcaaagttatatctttggctcctaaatctgcatcattttggggtgtttttttgttttttgtgtgtttttttggagtagaggaggttgcagcacataaattttctatattgttgctcttcctctgtgataattgtttgaaatggaaaaataatcctttccacaattcctagggaaaattatctttagttatttaaaaatacgtgaaagatgtaaaaattctccattcggctgctactctacaatcattgaggcactcagggcttctgtttgtgggcgctggcatcacagtgtagctggtagcgtggtctctctctcacacacacacacacacacacacacacamtcacctgcgttcccatcctcacatccccaccaccatcacaggccccgtcacccctgatttgctattctcaaaatagtcttcattcgtgcgctcctgacgtctgtctcatcgttatagtgcagaagatgatgaagctggccccgtgacggaggaattctaataaactgcagacctgttttgagctcatgactgttaaaattccgcaaacctgtcggctccttgtggcacatctaaaatagatttgattctaattgctaacaatcagtatacactgcttggacctggtctagtgattagcagctagaaggaggggaagatggggcactccttgagagatgtgatcagaatcttgtagaaggatgtgaagtttgaaaaagcatcttaactatcgtggtggaatttttgtaatgttacatttgggaaatgaaaaaaattttgaaacacagattagaatataaagctccacaaaatctttgttggatgtatggaaaaagtctcatgggagaagtttgcttattaaaaggcagtatggattttgcacaaagaaagttggagaaacacacccttgtcaccgagaagctggctctgtgctaagtgatggtcatgctttagattttctttttttccattcttctcttccctgtagctcagccctctcttcctgctatagccgagtgtaccaaagcctcgccaacctcattcgctggtctgaccaagtgatgctggaaggcgtgaactcagaagacaaggagatggtgacgactgtgaagggggtcatcaaggctgtgctggatggagtgaaggtaccggtgcaggttccagacagtcccagtcagggacttagagcagcctgcctgctggtgcttgtcacataagagcttgctcctgaccttcaaacattagaatgtctttctgcgtctctggtgttggtgcgctctatcccataactacttacttctctcaggactggtgcgaatggctcttagggaaaagctgtctagagcagtcagcccttactgagcactgcattaaatcttagtgagtcttcgtagcatcgtgctggctgagcatgcttgccagctagacaaaatgcaatggagatcgttttcacaatgactttaagcaaagctcccagcatgtcatatcagcactaccttttcatgttctgggagcttctaggattcttggtagaaaagcaggagtgagatgagtaagaaatggaactttctgtatttacttgatatccatgatgtggtctgtgtatttgctatccagagaagtcagaaacagcataagaaattgtgaatcctagttaagatgggaagcaaaggccatagaaggtctggaattggggtcagggggacaaatcctaatagagaaaataagtcctagcggatgggaagcaagacagaatgttggacatgaaccaggtaagggcctttgggtcagggccagggctgcaggcagcaggacagtggaaaccccgctgttgtgtgaggccatataatgtagtagaaaggggccagccttagcacctggctagatttgaatcccaagttcaccacttcgtagtctatgaacttgaacagtttactcaactgctctgcaccttaagtaactcttttatgaaataggtataataatagcatcgtgcatctcagggttatagggaagattacactagtcaatacacataatgcttctagaacagcacctggcacatacggagcagtcaggccttagctgctatttattattaattatgtggtgctagatgcatgctttgtaaacagatctcttggcttgaaaaacctgtgtccctctcctttctggacccctcaatccaaaattatagctgaggtgtttaccccaggtcaaaaaaaattccttcccactcaacgaggctaacaaattcctgaaaactgcctccttggcttaacattccccagcagctctggagagtagaataaggacccccaaaggacttaaattatagagagaggctgagaaagcattgctcagcattgcaaattgctccagaatgaaatatgtgtttgccaggacatctgggtggccctccaaccccagcagcatttaaggggaggctgacgtgtctgctggggccatagagttcatgtaaaaggggcttgcctagatgacatcaatattttcctctgaattctcccatgttctccttttttttttttttctctgagacggaatgtcactctgtcacccaggctggagtgcagtggtgcgatctcggctcaccgcaacctctgcctcctgggttcaagtgattttcctgcctcagcctcccgagatgctgggattacaggtgtgagccaccacacccagctaattttatatttttagtagagatggggtttcaccatgttggccaggctggtctcgaactcctgacctcaggtgatctgcccgcctcgacctcccaaaatgttgggattacaggtgtgagccactgcgcccagcctccccatgttcccttcattccaaaaagttactagtatctgcttagggcagcgagactcaaggatgtagcccagggtggctgttgtgatcagagctgatggccctttccaggatttggaggacaggcacgtacattatcatatctggtcctcacagtagcacactgggttcagcagagcagagtggaacgtggcctggggctttatcagcagccctgagtcactctggcccacccacccctgctgttcctgtctaggcttctgaaaatgctattattgaaaattgttattcttcaggtaacattgttaaggtttccttctatcgaattgattctgatgagatgttcacaagttagagcagccaaaacagaggagaatgagtttccactcataaagctctgtggcagtcccaagtacatttcctctatggagtcattacagcaccacttcattagtagaaaggcatgtctgaaagaaaaatttccttgatttttcaaagtgactggggaaaaaaaaargagagagaaacctataggttatgaacttgtcaatgtcagagcaaataacttttccacaattgctttaaaaatattttagccagaacaaagattctctaggtgagaagctttacaaattcagttttgtttcatttattcaagaagcatttagtgagaaccttctatatgccaggcaatgagagataataggaaatatgagcaaagctggcacagaccctgccctatggcacttacagtctaaggggggcaggaccgtaaacacaaaggcacacccatgtggtatagcgctgccaaggaagatggcacagggtgtgatgaaagggtatgatgaccttcctttctcagggtggtcagagacgcttccccaaggaagagacaggccagcatctggaggatggacaggagctgcctgtggctgggagcttttcgtgctggagtcattacagacagtgagagtgatcgagacactgtgacgctggcatttgttgttattgtctaatagtaataacagctaacatttatggggtgctttttgtacactgtcctcacttaatactcatgacaaccctccataataggcataaatggctgccccttgcccctttcacaggtgtggagactcaggctcaggtggagcagtagtcagtggcaaggctgtgattcccacccccaacctgctgccccctccccggctcctgtgcaccatgacaccctgagctgctgcctcccatgggaggacaggattctctgcactcccacctccaagctagctggcttccagcctctctcaccgtccctttcaggcctgggacaccttaaaagcccatgccctggtggcgtgagagagcctcccccagctgggagggactggagctgtgcagaagggaaatgcactcatgaggatgttgtcagcccacttggaggaggggcgttggacgttcttacactgactcaccgttgtttacgtaacccattcagttgttcaagggagtctttcctctttttttttttttcaaatgattgaacatgggttgtaaaacaggattactttggttttgtccctgaatgcrtggtagcatttatcatttaaacctccacataaatgccacttgttcaagctgtataaccttgggcaagttacttccctgagtttcaagtaggttttaaaatatttaccctgaagatttgaggaaattcagtaagataaagtatataaagtacctggtaagaactaggtgaccaggaggcagtggggaaacagtgttacctggagaagtgttcatttctaacggctcacagtgaccatttttgacagtgattatggctcttttccaggtagtcttatcatctcaggtaaaagatagacccctgtcccctcatctggctctggggctgcttttccaccgggagcctgtagctcagagctgattatgactcttgaaggaaggaaatctgaggaatttaaagaccctcaatgtttttctctgagaaccacacccagcctagcacctggatgctggggggccgagccactcgaggccaaagagatatcccagcatgaccttttgaaatcggtaccccacctcttcccaacttcaccaggtaatttactgtgttacttgagcaccagagctgtattttgacttgtcaactgttayttaagcccttccttctctgtgatcattttcttttttttttttttttttttttttttgagacggagtctcactcttgttgcccaggctggagtgcaatggcatgatctgggctcactgcaacctccgcctcctgggttcaagtgattctcctgcctcagcctcccaagtagctgggattacaggcacgtacaaccatgcccagctaatttttgtatctttagtagagacaaggtttcaccatgttggccaggctggtcttgaactcctgacctccagtgatccgcccacctaggcctcccaaagtgctgggatgacaggcgtgaaccaccgcgcccgacctatgatcattttcagtatgaataaaatgaacatggaaataaagtattacatatttggagagctacttttccaaataccgtttttgacttttgaaaactgattttcagtgaccagtcggcagtttccagtcactgctgtagacatagactctagagtagtctcttcttctttttgttctgagacagtctcactctatcgcccaggctggagtgcaacaayggcacaatcttgctcactgcaacctccgccttctggattcaagcaatcctccagcctcagcctccggagtagctgggaccacaggtgcatgccaccacgtccaactaatttttgtagaggcagatttttaccatgttgcccaggctggttttgaactcctgggctcaagtgattcacttgcctcggcctcacaaagtgctaggattacaggcatgagcaaccacgtctggcctttttcagtcttttctaactcgtgcctcaggacaattaaaaagtctgacatccctctcaaaaaattctaccttcagtaggaggtgttgggctcatgccaaattataaatggtcaactttcaatgagattagggtgttagcacagtagccagatatgtgcacattttaaggtttctcctctgtgatagttaaggcaagtcaagactaaagaccttctgtctaggcagggagataggtggtaaatttaaaaagcagcccgccccttttatagtcttttcaagcctaggccacgcgagctagtgtagggagcgtcattgggatcatgacgtcatctttgaatttgggcacatgtctgcacatgtgtgcctgtcattccaggattgttttgccattgttcattagttgagttcacagctgcctctccagaaagatgacgatctaattataattgctcatgaatcaatgaagaaccaggaatgttttccyktatcaacagatgcaaacaacacagacttctctctgttccttttgccctgcttgtaaagaagagtgaatctgaaagtggggcatccagggcactgtgttctggcgctctttaactccctctaaggccgtgatgctcctctttggggcctggcgttgtgcttttaggaagagctgcttctcccaccgtcctccctcctccaggcggtagggtgcaagggagctgcctcttttctaactgctctcttcactgattgtgtagtctctcctcctccatcttgtcctgtttgtaatcaccagctagatggctgtcccttaaatattaacttctaaattgtgctaacatgcaagtattaaggttctcctttcttgctagtacttggctcttagagattttgcttctccacatttcttcaagaatagacatctgaatggggtaacaactgtcacagagtagggtaacactgaacctgcatctgtggatatgcctggctgagcgtggtggctcacacctgtaatcccagcactttgggaggccaaagtaggaggatcacttgagcccaagagtttgatatatgcatttaattttggrgggcggggttgcttgtttaattattatttcagaagtaatatatgttcatttcagaaaatttagaaaatagaaaaagaacaagataaaagggtgtttcatagccatattttttgtattacatatattcttgatttggctttgtttacaaaacgtgcaatataaaccagcatatcacctagaactgtttttccactcagtgtattacagcatctttccacgatacagtgcatattcttgttgtgactttgtctttaataacaacgtaatggtcagcccattgtctggttctatcatgacttatgtaattgatacatattatcaaatatttaattgtgggatgttgaactattcaaaattaccacattaatgatacgtaatcttatgtatattctgtgataaccatcttttgtggtttaatttttgcacacattcatgacatttttcttggacaggattctttttttaagagacagagtcttggccgggcgcggtggctcacgcctgtaatcccagcactttgggaggccgaggcgggcggatcacgaggtcaggagatcgagaccacggtgaaaccctgtctctactaaaaatacaaaaaaaaaaaaaaaaattagccgggtgcagtggcaggtgcctgtagtcccagctactcgggaggctgaggcagaagaatggcatgaacccaggaggcggagcttgcagtgagctgagatcgcaccactgcactccagcctgggcgacagagcgagactctgtctcaaaaaaaaaaaaagagagagtctcaatctctcacctctctcacctgggctggagtgtgattacagttcagtgctcctcgaacccctgggctcaagccgtccttctgcctcagccttccagagtgctaggattataggcatgagccactgcacctggtgcaaaattctcataatgcaaatatttaaggcttttgatatatactgataagtcatccctctggagaggctgtctgaagtggtgctcccacctaccatgtctggaagtttctattttattaccatccaaggtggtgaatgtcttatgattattgaccattggtatctgtaaatttcttgtttgatatttttttcggcgtgttcaccttctagtttttttgttttcgaaagaacccttgcgctggaaaggatggtaactgactctttgccttatttgcagcatacgctgccttttttgtgtgtggtgcttttttgagtctggagaggcttggcagccgctggttcagggtctctggttactgtgttgcccactggcatccgctgccacctcctctgtaacttggaaacagctttctgctgaaagcctggaagcccctcatcacacacatgcaggccctggccaggccagatgtccagcaacaggaaggtggagggagaagctgtggtgcatccacgagtgggaacactgctggcagcgagcagcaggcgcctcgcccacacgaagcacagctgttgacgctgagctcgggggacggagcaggcaaagatgtgcggacaggaaatggattggcagctgccaggggctgggggtcgaggggaatgcggagcttccttatggrgtgatgagaagtcctaaaattgattgtgttgatggtcacacaactctgtgaacagactaaaaaccactgaatcgtacactttaaatgggtgaatttaatggcatatgagttatatatccataaagctgtttttaaaaagaaggttgacacaaaagtgtatgtatgatatggttccatttatatcaagttctaggacaggcaaaagtaatctatgataatagaagttaaacagttggggcggggcagattggctggagacggtgatagaaatgttctttgtgtttttagtggcgcttacttgggtatatgcagttgtcaaaactcatcaaactgggaaaaaatgcattctaatttaaaaaaaaaaacacatgggcacttatgtcttcccttttttttcttttgctacgatttgaaaaaggctatttttcttttctgtttttctcagttaatggttctaaagtgatttctttgctgggttatctccccttaactccctctccattgacaaggatcccagccagccctcaccccacccccaccagctagcagctccaccacacctgtggccagctcgccttgggaaaccacccatgccatcatcgtgcatatgatctaatggctttagagaactaggaacagagttattccccaacaaactgactgggaacctgttctgatgagtattttaatttgtgtgataaacaatcattttgagaggctggggtttgccatttccccttccaagaggaagtgcctttacgcatttgaaacttgacatgccatgaaggtatttttggagggcaggggacatttgggaagtcatgcagattacctaaggcaagtgatacttgcgtttatggtgcgtggggaatctgtaggcacagaaatgagactcagcagcagaggacagacagcacctgcctgccttctggtggaaactcagtggtgacgggagctttgctcattgcctttttcttgtgggggtaggagctggtcaggctcaccatcgagaagcagggacgtccgtctccgacgagccccgtgaagcccagttcccctgccagcaagcctgatgggtaggtgctgactaaccctcgtgtcgcgggtgtcacgctcagtggcaaagtctgcacttgacaaggatagggcccggtggggtgggcagcatgagggtgggctgctggaggcccatattcctttttcagtggttagcagtgtgtgtatatttcacacaggcttgaagtattgccctgtctcaagtttacccttcagcatgactgtttccaaggatcttctgtgagcgcgtccagtgacacataccagtgcttttcctgggcagcttcgtttcataatgacaaagaacttttaaaggcttgggtttgggtgctttgacttgagagcactcttgtttgatcaagagtaaactgaggatgacatggatggttgtaaaggtttatattcatctctactccaagctcctggtraaaatataaaacataaatttggagcttttttttttgtttttgagacagagtctctgtkgctcaggctggagtgcagtggtgcgatctgggctcattgcagcctcctcctctcagattagagcaattctcttgcctcagcctttcaagtagttgggactacaggtgcacgccaccatgcccagctaatttttgtatttttagtagagacagggtttcaccatcttggccaagctggtctcaaactcctaacctcaagtgatctgcccgccttgacctcccaaagtgctgggattataggtgtgagccactgcgcccggcctggagcattttagagaacccttagatcattttcagatgaggaaattgaggtgcaaagttgggggcacagccaagctccagtagctcattagcaaccaaaccagaaccccagggttctatatccagggagcctgctcttcagccccacctcacccactgtgttcttcctggtcacgtcctcaccctctcagggcctgtgtgtgctctgtcccgcctttgaccttctgtaaccccaagttcttcccaattctccagcccagcagagctccccctgacagaccgcgaggtagagatcctaaacaagacgactgggatgtcacagtcaactgagctcctcccagatgccacggatgaagaggtcgcgccccccaagcctcctctgcctggcattcgggtggttgataataggtaattaccttcctatttgtccagtgcctcccatggcagaatgagmaagaaagggaggaagacagggctcrggccctttcccctcagcgctgagggcttggccccccttgggaggctgactctggagctgtccccaccccgccggccctcgctggccaccctgagctctcctgaaggcctccttgtgccctcagcccagggagacatggtatgatttattatgaaagaaaaagaaagggttgttcttttttgttcatttggtatttacaggttttattttggcggaggggagtaggcaggagttgaagtgtgaacattgggtgtggagagtctagtaatgaaagaaccccacatcctgtaccccaatatcacgctgaagagctttggtgagtgtggtttggtctgcctggacgtttcggtctgtttcagtcctccaccagcattgccacccaagaaaagacagtcggcgccgtcccctacccgagtggctgtggtggcccccatgagccgagccaccagtggctccagtttgcctgttggaatcaataggcaggtaatgcagcccctgttccctgcatgggaaggcagggagggggtggggggctcagggatgtggctcctgaagctgaaagaaacccatggtcttcaggcgctggtgtttgtcacatcgaggagtgcgagaccttgtacccatccctctctctccaggacacggtccaagttcccatatggggataagggtcagggcagggagggcasagccaaagggcgtctcctggggataggtgagtccagccccagggccctccctggccacaccccccacaaactccagatggctgcttctcagctgtatgtgtccttcgactactgacgtcagaggtggtttctgagttcgcctggcagtatttccttctctaagtaaatgcaccggttgcctcacccctggtctgtgccaccgtttctcagaagtgatttggctttgtttttctttttccacttgaggattttgatgttgactgttacgcacagaggcgactgtcaggaggcagccactcatatggtggagagtcgccccgcctctccccctgcagcagcataggcaarctcagcaagtcagacgagcagctgtcctctctggacagggacagtgggcagtgctcccggaacacaagctgtgaaacactaggtgagccgccaccatcctcctgttccatcgtgtctcggtggcttctctggggccattacagtcctgggtgggagtcccaggtcatgcaatcattgactacgtggctttggctgacttgtttaaaatctgagcctcagcttcctcatctgcaaaatatggataacagtatctgcctcccaaggaagttgagcatgtaaatgaaatcacaatgtaaaaccacagcctagatattcaagcggtgactgttagttcatctgtcagtgagtaatttgactctctttaccaaaattaagagccatttgtgttgagagctttaaacaaaggggtgggggtcctgacaacacttgacagaggctgaaggggagggagccgcgcgagccggccttctcgttagtcagtgctgaatgtgtactgtgcgggcccctccgagtctgctgggcagggggcttagagagcaggaagctgttcgtatcctgtgaactagatattttcacttctgagaatgtatcctaggagcataatcagtgattaatagcaagattttcattggtaggaaatcagatgaattatggtacattcatttgctggaataatctgtagctattaaaaatcactcatattgataactagaaaaagtacaggaccatttacatagtattctcaattgtttctttttttttttttttttttttttttttgagacagagcctcactctgtcacccaggctggagtgtagtgacacgatctgggctcactgcaacctccgcctcccgggttcaagtgattctcctgcctcagcctcccaagcagctgggattacaggtgtgtgccaccacgcccggctaatttttttgtctttttartagagacgggatttcaccatgttgaccaggctggtcttgaactcctgacctcaggtgatctgcccacctcagcctcccaaagtgggccagcgtgcccagccaatttttgtatttttagtagagayggggttttgccacattggccaggctggtattgaactcctggcctcaactgatcggcccgcctcggcctcacagagtgctgggattacaggcgtgagccaccgcgtggccctcagttaggctttttcaaaaaggaattgtataggcaaaaaagtcatttaaggaaatacttcaaaatgtaaatagaaagtacagttagattatggtactgtgggtgatttttattttcttgatgtaatttgccacrgtttcygtaatggttgtgtattttttttttaaataagaaatgtaaaaaataaaagtatagcaaacagccatattcccatctggtttgcttttataatcagggagaagaatgaagaatataacatgtgaatataaaataagccctggagacaggtctttgtcacacacccatgagcgagccggcgagaggcgggcggggggagctggctgctcctgcagggcctgtggctaacgggtctctttttcccctgttgtaactgcagaccactatgatcccgactatgaattcctccagcaagacctctctaacgcagaccagatacctcagcagacggcctggaaccttagcccgttgccagagtctttgggggagtctgggtctccatttcttggccctcctttccagctgcctcttggcggccatccccagccagacggacctctggccccagggcagcaracagatacgccacctgctctccccgagaagaagcgcaggagcgcagcctcccagacggcggacggctctggctgcagggtgtcctacgagcggcatccctcgcagtatgacaacatctctggggaggacctgcagagcacagccccgatcccatccgtcccctacgcgccctttgctgctattctgccctttcmgcatggaggttcctcagcccctgtcgaatttgtgggtgattttactgctcctgagtcaaccggtgacccagaaaaaccacctcctctaccagagaagaaaaacaaacacagtaagcctttgttgcactgttgtcaggaagtgcattttataacctgaaatggcagtatgttttatttcagcattagaccagaatcaaatcagtggcctcattatttcataaaagataggccagccaggtatgtggacacttctgggagccaggttttgtcattacacgtgatcatttttaaagcytcatcagctgacctctcctttacagtttctatacaatctcaggtccggtctccatgtagcctgagggattctcctctttagatggcagcagttgaccttctggcctgatcacagtgacagaggggaacgagtgtcctggcacgcaggacagcattgcagcaacatctgtgtagagcgaggtggatacgtgaatttcagcagaacttgcctagtttccacagagtgattgtctaaggatccctgtctagagcacactgtctctgttcatgctcccagaatgacttggaagctggggttgcccagcaggagtaattcagcacacttcttggaccagacattttaatatatgatgttattggagcccagggttggagctgaagttttgaatattttccaacggtaaatctgtcataaaagtaataaggagagttctcctggaaattcggttttctcctagctcccctaactgctccacacttctgggacttgcctggccccctctgtccccgccctctccctgcttcactagcatagttctgcttcgattttcttggcagcacagctgtcaccgtttcaatgtgtgtggtcacattagccacacagccccaggcttccctggcctcagttgacacatccagcagagaacttctatgacctagaaatggaatctctactccaaattcccaaatgagagcttctgagcccascttagagctgggccccattctcaaagaagggaagacctggcttggttcagtccagcaaggrtcgccctgagggctggctgcgtggtccacagaaggcrgcggctgcgatgatgtcatgtatccccagctcctcagtgggtgttgcccagcttgtgtgatggcctcagcagtgkggtcccccagctagagggagagctggctctgtgggactaatgatgtcatccccatctgtcgtgtatatttgctcatcagaaaccagggctcccgcagaggggtgtgcaatggcactgccagaagcatttccttctcttcccctccctctgcatggacaagtgtttaaagagctgttggcctcccyctccacccctgttatcttgggctgcgtgccattcaggttcaccccctttccttccctaggggaggggtcctctgagctcagacactgggcaggatggcatccttgcaagctgcagcagatgccagagagccttacccttccagctcctagaacaagtgtgggyggcggtcctcatgcagggtctatagaggggagaaggaaagggaggggtagccattgtttcctttcaaacagtctcaagtggctgaaaatccctattaatttaggccaccattttgaggctttaaccaattcatcactgtctccagcactggagcctgcaaacctctaaaaaactcctgagctacagccatggtgtgccctgagctaaagcttcacatgccctatggaaggtagtcctgacagccacctgcaaggcaggctctattacctccaatttcataggtagagaaactggagctcagaagaactgagtattgcccaagatcaacaagcaagtggggcacagatctgggactgagagcctggcctgagttgtacaagcctgttacacttcctcccaagccgaggaggaagagattcagccctccttccttgagatcccatccagtttacagtattgacccctgtgcaggggttggtcttctccgtaccctgtgaaagagccccaaacttaggcaccctgagcctcatccttgtccccagtctgctgttcactccccgaggggaccctcaggtgaccttgtggaaaatgcctcaaaattgctttgagggaaagaaggaaagaatcatcaccctggccgcgtggctaacgctggcctgagttcatgcacgctcagtcccaatgtcacgacgtgtcctcatcatttgggatgcactgacatcgtgagggtccccagcccctcttgcccggagcagccccatgagtcccttgtgccagacgagccttgtgatcactgtccggcacctgaaatccccacagtcccaggccctgagcactggcggctgaaccttcccagcaatgctggctgtgttaggagcaaggcctctaaaatcagcctctgggctgcttttgaaatggactgggtcctcctcatttctagaaggctgggagcatcactgctgttctgtgcttggctagcaggtgtctacaaggacttcaacatcaagagttcagaaagacctcctgaagagatcacagttttacagaaaagtcaggcagagatggttgtgtttaatctttttcttttttccatagctcactgcaaccttgaactcctgggttcaagggatccccccacctcagcctcttgaatagctgggaccataggcacataccaccattgctaatttttttcttttcttttttctttttagagacgggggtctcactatgttgcccaggctggtgttgaactagcctcaagtgaccctcctccctcagcctcccaaagcactgggattgtaggcatgakccagtgcgcccggtcatatttagtctttttagggagcagtttgtgggtgcttgggatcaccttcctaggcttgcctcttcgtctggagcctggtgacattggttgtgcagcattaaagaggaagtgtggggctgggcttggtggctcacacctgtaatcccagcactttgggaggacgagccaggtggattacctgagttcaggagttcaagaccagccagaccaacatggcaaaaccccatctctactaaaaatacaaaaattagctggacacggtggtgcatgcctataatcccagctactcagtagactgaggcaggaggatcgcttgaacccatgaggtggaggttgcagtgagccgagattgcaccactacactccagcctgggcaacaagagcgaaactctgtctcaaaaaaaaaaaaaggaagtgtgagacaagctcaaggggctgtgagctgccctttcagtagcagcagctgacctcagaggggaaccatttcttcctgtgcatcttttacaaccaagttctgctcggtgcttgttggagctagtaagaaattcttacatattcttttaaataaagaaggtgactttgaacactttccttcagtgacactcctggagagagagcatttcctctatacctggacccccagtgtggctcagggaagaaataaactccctacctctgtgactgtcttcctcagctcagtgtctggccttccttgatttgttgactagttggggtttgcagagaagcctctggctttgtgcttatttgaagatacaaaatttagcactgcagagccaccactttttcttggcatctgaatctcagctccacctggcagctgctcgtggcacttgcgacatgcctcgaggggaaagtgcctgctcaggaggtagctgagacttgccatccctgcacccgccakgtgccctcgcttgagtccccagttcacattagggttccccattggtgttgcgyrtctgccggtctggacgtgtctcctccgttagcgcatcagacagagtgtgatttcattgcccgaaaagtcctccgtgctccgtctgttcgtccctctctgaggtgctttcagtggaaagccccctagctgctgtgggaagaatbsggggaggggttccctgatgtggcctcccccrgcctcgctgcagctttctcccttgtttcacagtgctggcctacatgcagttgctggaggactactcggagccgcagccctctatgttctaccagacrccacagaacgagcacatctaccagcagaagaacaagctcctcatggaggtatacggcttcagcgactccttcagtggggtggactccgtgcaggagctggccccgccgcccgccctaccccccaagcagcggcagctggtgagtgacaccttcccttgtgactagaacttccgatcctagcaggtctctaggaaccagaatgaccctccttgggggcagggttaaccctcctccctgctgtggcagggccctggttttgggcgtggaaggcaccatctcccacacagatgcttttacttcctccttagatgctcaccagcagcccagcgcccactccaccwcctccccaccctggggtgcagggacctttcttttccacagcagccccgcgcagcagggacaggcttgtactcagggtgtttgctctctctgctgacagtctcttgtatttttttctttcttctttggcttcaacatagacctcccagaaaggagggactcaatcaaagcacaggacatggtctgtgcacagccatctgtggacttgattggcataatgggcctaactgtgtagagtgacttacaacccagccttggccggggagggcccaaggaaaacaagtgccattgaagtggaggatggctttaaacagagccactctgyttcagacatggcaccttcctcttctagaaaacactcgtgtgctaaggactcctgtgcatgtaaggaagcacgggccagcacagaaggcaagctgttccaccgtgggcaccccatgaggctctggaactgcccaggcactgggagggtgagcagatcgggggtacctgtggcatccctccaaactttctccctttgctgccagttaatgaacatggagggccctagtcaggtttgaagatctgagcctcttgtccagccatgctccccaggaagaggaagctccccagcagggagctccaggcttgttcagagctgcctgggctgctgctctcgtgtgctggccagtctggtggcttctaccaggaggcgactggtgtgcactgggccatcttttatccattgcgagaggacatgaggggccatctgattcttctgggaggcagctgcagactggaggacaaatgtccctggattactccgtataatcaatcacctggggctcagcccagtcccaggagttcctgagccttcctatactcagtgggctgtggctaaccaagcaagctgttttgtttccactcaaaaaccacactcagccacttcagaggtggccatgtccagtagaggaaaggccaagcttggagttgggagtcctgaattccagtcctgccacttgttagccgtgtcacacgtgccattttcagagtctcagatcctcacctgccctgcccgtcccacagacacaattgagaatgtgaatctcaattgctctgaagatgtttcaaaaagggtcccaccatggaaacataaatgcctcatttagagaccccttgcctaaaatgtttggttagaactgttgccgagagccaggagtggtggtggcacatgcctatattcccagctacttgggaggctgaggtggaggatcacttgatcccaggagttcaagaccagcctggacaacatagtgagaccctgtctaaaaaaaaaaaaagccattgctgagccagatttattgaaaatattttcggcccatttgccatccttgggcatcttctccatactgtggagtccacaggcttctgaatatttggggagacacccctagggagcacgtggaatcagaacctgttctaccacgcctgcagggcagtggcgagctcagcccccggaggcctgttaggaacatctgtgttgaacacctccccaggtaagcaccagggctctcatctggctctacatggtccctgccacagctcctggcatccccattataagtaaattgaggcagacagagccagcgaaccttaatccaagcccacagctagaaacagaagacctgggagccacacccaatcctaatgacagcccaggcataccacctgacaggtcctgccagctgctggtcacaccctctctcaaatgcagatgcaggaagcgttatccacacttcacagacaaaaatggtgctcattacacacacctgttggcccatgtacagtgtggtaagcaatatttcaagtgcttcacacgtatcatcccatttcatcctcccaacagccctgtacaggagacactagggttatccccattttacagatggaaaacctgaggcacggagacctttaagtagtgcccaaggccaaacrggtgagaaatggcagggtccagactcaaacccaggctgccggagccccgtctgagttctgaagacgtgtgaatgacacatggatccactccccacagaggagcagctccaagcccagagtcagcccagttctgtgtggctccagccccctcgtcctccttccacccaacctgcttccagtggacacaatttttaggatctagtgtaaggaaatgaaggagggtgccctttcatgcagatggccttcggcagctggttttagtccctgaactgggcccagaagccatccctctccagaacgtmtgttagaggatgtggagagcaacctccacggcctttccctgcacggacctgactgttctctgcttctctccctccttccctgccttctctctcctcccctctgtccagcaggcctcctgtgctgcttcttccttctcctctgtctcccactgtgtccagcaaactaaagtggccttcacccccgaggacggcagtgccgctcagggcctcagtgtgtccgtctctaactcctttctcagccggcacggcagcttgcccgtgccctcggtgagttgctccctgctgttctttacttggaaacgcgtgaacagggccgttccttggaagcgtgtgcctcagccatgtgttctgctgcccgtcgcggcccctgcccttctgcgggtccctacacctagatgggaaggctatgaatggttggttctctggggccttaaagaccatgaggcatccaggtgaggcaggggcaggcatgggaaatgtgagtggccaccttgggagcatcaccagtctggcataaactgacagagacattttagcctttttatcccaatctcgctttggaccttggatcagccctctgtgttccaggattaaaaaggaatatagccaggtgtggtgtcactcacctgtagtccccactcctcaggaggctgagacaggaggatcacctgaactccagagttcaagtccagcctgggcaacatagtgaaaccctgtctcaaaataaatagataagatagatgagatggatgagtagatgggtggtactattcctcacgtagaaagccaggtcgaggagagcaggcttcactagcgcaggatggtttgactctcagggatgtattagtttgcttttgctgcataacaaaccacccaaaacttggtggcttaaaataatagtgagcatttgtcactgcttaggacasggggtagcaggatgggtgtgctgctctggcccaggcttggccaattttggctgaactcactgacatccctgggacctgagctgagacaatggggctgatttggctgtgacccatgtagtctgtcacttccatcaggctggcctgggcttgttcacatgacagctggcgggcttccaaaaataacaaatggaagcgtgcaaggccccttagggcctcagctcagaagtagtgtgatgcctgttccattgcatttgctcagttaaattacaaggccagcccagattcagggagcagggaagttgcttctgcctcttgatggtagttgctactaagtcatgttgcacggggcatgggtccaggaagggaatgggctgcagccatttgggtaaacagtttactgctgaagcctaggggctgacactgaagaggggagtctttcactggcatctgcgcatgtccaggaaccaaaatggccaccattctccctttcgtctgttaaaatgaaacttagcacaggggaaagaactctagaacaatttcgagtcccacttgaaagaagtttggccttgggcagtgcaattctccccccatggccccccgccaaagatgcttcagcgtctttcctttgggactggattttacttgcctcatattttgtaagtgtgaaaattaagtaaaattatatgaaatgtctaggtatgtagtaagcttagaaagcttattactgttcttgctctcattgtcttagtaataagagttctggattctagtcttgttctgtttctaactttacacatgagagttaacctgtttggccttttttccccctctgtaaatgatgagtttggaccgagtgacttttaaagacttatccaaactcaagttcccagtttggtcttgtctggtttccatctgtgcccagggtgggcagtccaatgcccagtgccttcgaccaagatggtcctgcctgtctgaggaccttggagtgcattctcccaatgggtactgaggcctcacgccttagagcccccagcatccctactcatgctgggaagatgygctcccctcaccctgctgtggccacacagaagcccctggtttcctcagaggcacctctggcaagctcctttcacaaatcttgcgaaacttggcctttagacaatccgagctcttgactgagctagatttttgtttttgttttctttccccttagagtttccacaatatcccttttgagcagttagggttagaggactatgaatgaactggactgttcgctacaaaattaaattcgaggacrttttaattaagtttggttatgagtacgtcatagtttttatccctgggacatacaagagccttaagacatcttgtgtctaaaacactgcattcttagcaaaaagcccaccaaggagcctgagggaaggaccttataaggtccttatgtcattaaaaggagaatacctcaggaaccattagtaatggccaggtttgggacattcagcacccagtatgccggaacctcagagaagggattcagtacrgtgccaacatgtccttcatatatcctttggttaaattctgagatgagccccagacatagagctttggattactatcagagcggccctttattcctgactttcttcattcattgctcctgggcctgtgtggtttgtccagcatggaactctgaaggagtgccccttggaaacacagcagttgacaaatctgaagacacctcacgtggttcttggcacagtggacgattatttccactaaaagattctaaccattgaaaacctcttgccaagggaatttgtagggcactaaacctgtgtggaacaatttaaatggaggtggatactgagaagtattctcattcactccttccctgataccagggatgggtttaattcagcaagctcaggacatcaacttttccaggccgggttgcaaaagacwtgcagttgaggaggatggccccgagcaaagcagggccacrggtcagcaggctgaggaagacgggcatgaagcctgcgcagaaccaaagaacatctgcacacatattaattaattttgggtctgagtgcgtcatggcttttggttttttgtttttgtttttgagatggagtcttgctctgttgcccagactggagttcagtggcacgatctcggctcactgcaacctccrcctcccaggttcaagcgttctcctgcctcagcctccggagtagctgggattacagccgccctccacaacgcccagctaattttttgtatttttagtagagatggggtttcaccacgttggccaggctggtctcaaactcctgacctcaggtgatctgcccacctcggcctcccaaagtgctgggattacaggcgtgagccactgcgcctggccacgtcatggtttttatccctggaatatatgggagtcttaagataccttgtatgtaacatacaagttcacaccacatgaaagcacgtgtgaggaatgacatgagagttgtaggcatagaaaccttgtgggtggcggagcaaggacagggtcgtgggggctgggggtggagcttgaactgtgacttgaagggcagtcgggatttttaggagctaaaggacagggaaagcaagtcaagatgttccaaacagaaggacctgccagaggcatggaggccaggaagcccagcatccattcgggaaggtcatctcaaatgtaaacacttagaataaggtaatgaggggaatgatgacagccagccctcccgtctccccagaacctccactccaggaaaagccagtcctccccatccgcaggctctgccgggcctggactcgactgtttgctgggcttctctctcaccagcacctcccacgagttggtcccagggagtccctccaaccgtcccctgcacaggcttcagaccgagagatgcagaatctctcagtaaccattagggctgcctgtgccctgccggtgctgcagggttggcattggaaaaaacaccttcctccggctgggtgcagtggctcacgcctgcaatcccagcactttgggaggccaaggtgggcggatcacgaggtcaggaaatcaagaccatcccggctaagacggtgaaaccccggctctactgaaaatacaaaaaaaattagccaggcatggtggcgggcgcctgtagtcccagctacttgggaggctgaggaaggagaatggcgtgaacccaggaggcggagcttgcggtgagtggagatcgcgccactgcgctccagcctgggcaacagagcaagactccgtctcaaaaaagaaaaaacaccttcctccatactgcacactactttcttgtacgttctttctttgctaactgaaagttatgggtatttactctcactaagagrtctatttgggtgctagaaatctgttgaaatatttctttaccatcttggcttccagaatgaatctggataattaaaactgctagcagacccaagttgtgagtagaagttatattgaaatgcctgtaataactgtcatctgtttaaaaaaaaaaaaaaaacttcaggctaagagagttaagtgtgtatcatcttgaggactttaatttttttaaaagggtctgcagagcagctggcatcccattctgggcaaaacagtcgttttctgagatgggcccaggtttctgtgcatcagcacatgtgctctcaacagaaggcttgagcttcatgcagacgctcagtccccatgccatggcgtcccctcgctgggaaatgccaggcccagcccctcgggacctgttgcaggctccttcactctgcccattcatctgcctctcactcactcactctttctctccttccctacccacaacctcctggccacaaaccatccccaaggatgagccatcacagaaaccatgggcacactgacgggcctaaaggccaaacaggaaaggggagagatagagagasaaggagagaagaagggaggagaggaggaggaaaacggaatggcccayrggagggaagtggaagacagtccatggggctctcggcacctgttggaaaaaataagttcctgccatcctgacctttgtcctttgttcctccctgatgccatcttgtctcattggctttttgtcctggtcagagctagatcacattgagagagagagcagggagcatctgtgggcagaacccggtagccgggggtgggagaggggtttctcaaggcagcccctccttgggggggggktgttggtgcacacactggtctgaccctccctttgcacggtccacatggagtgctcctctttggggaaaaggactgtgccrctgtccccatgttgtgaagyccccttgaggcctctccctcccactggtgcatgttcctccttggcctggcgtagctcacgtagtacgtaggtgcttcaggttatttcacaccgttgactcctggactgtcctccattcttgggggtttagcagcacaatgtagtctacaagtctataccctcaagggtgtggtctaccagtctgtgcccttagggttagcatctaccagtccataccctyaggggcagagtctacaagttcataccctttgaggcagaatctacaagtccaaggttgagtctccacagatctccagctgtttgagtgcaggcttctctcctcaccagaccctgggctccctgaggtcagaaattagtccccatgcctggcacatagcagacaggcaggcagtgcccattcactcttgtcctgcccctcttgtcccaatcccaccatgtcttgctgatactgcacagggcattagccttgagcgggtccgcttctctccagcccgtggccactcacttcctccccacccccatgtctcacctggatgcactgcagctcctgactggccttcctgcctctgcagtcagaggccctccctgcttctcaaccctgcagctagactatagtgtcgccacatccctgcagaaccagggccagcttccctggctcttcagaggccctcacactgcttctccccaccttaccacgaacctgtcccctgcacacctccactgccttcccttcatcccttcccaacatacgagtttctccttcctgcacaaccctgtcttctccccaccgtgttttctccttacttgctgtatgaacctgagcacaccgccctgccccagtgccctgggccccgctttcctctgtgcagtgggagcacaaggttgttacaaggatgaaaagcacacatgtagtacgtgacgcacaaccagcatttcatggaaagggagctattagcatcagatctgtcgccatgtgggggaggctgctgctttcctgtgtcatgttccggttcgtcttctcaggattgcatgtcccctgaggagaggggatgggctgtgaactggcagctttggtgcagcctagcctctagctcccatgtaacagatgcattggtcccaggctctggccaagaatccattttcttcctcattttccttccctacygacctgaggctctggctgctgtgtctgactcaagagtttcccaggtagttcctgtctgcagagcccttgaaacacagtttggctcctgcagtgcgttccccctgtgcttttccactcttcctaaaagacccagtgctgctctgaagtgtgaaggctggattagatcccactcagcttgacctggtcttgtggaaggaggtwcatgcagaccagagccccttccaggtcactgcgaccctcgggataacgtagagccacctatagagaaaggcccagctctggaggagacggcgttacctcctgagcccaggagcgagcctgccttgccttactgtgggcagtagggagtatgcccatctcagcagcaggaytggtcacagccttgacagcaggaacagagctgagagtgcctcgcattgggggctttcaaaagcaaccactctgatgcagctgtttccaacccctggttgtagactttgagaatctttattgtttacagcctggcattttggctgatcggtgccccttgaccagcttcaggcacagtagtgtcactgtagcacctggccgtggttgtacttctgactccatccatgacaggcaaactgtcatgtgggagttcagtcagggtggtggggaaaattacagaggagaagttttaagataaagttataggaaatagacacaaaccttcttggaaggctggtacccacaggatccccattccttgtaaaggtcgtgcactgacacgcatcctgagggccagttccacgtccagtgcctctcgcctttacttccacgtcaggctactgtttccctatcgagggccttccttcctattctgtgatcaaatggttcactgcagttctagagatggagaagccaggagagagaagctgagccatttgttccaagttaagctagagccagggttggaatccagaaccctatcatgaaaaatacagcgttagattaacatttttgaactgcttaattgcccatttttgaactgcttaattgccaaataaattttgagatctcgtaaggctgggtcaaaagaaaagtgtgtaggctggacgttgagaggcgtgtatttctccttcatgttctgacatgttacaaagtgtagctacaggctctaaatagagttctaagaataagtataaattagagcccctgtcaggctgttgaaatgcaaactgagtaaaaatagttgtcagacttctagaactgaatttgaatcatttttcagtctgyactaaatctttctataaagggttgatgytattcagatcaacacttagtgaattacagagcatcctagaatgtattggaggttttgcaagagttaatttgccatgaagccattggccaaaacgtagtattttcagtggagatattgtgattccagttgcaaaaatacatcacatgagaaggaacttaataaggaacttttgcattcacccatcttctcccaagcaacgcatttttgttcttttacatccttttttcttaggatattcaggtggtttttaaaaataagctccactaargagtttatttgaaaagggagaagatattttttggacccaacataatgctaatgttgcctttctttggtgagaagaatgccatcttgtcattcacacagtgtgacccacaggactgccttcttaccaggatcaaagacaaaacggtcagtggcagatctcagttcatgtgcatgtggcattggcctcagaacctaccacttggctttggaactcatcttttgacattatgtaaggtatagttattgttttaaattaacacaagggcatcaaggaaaaggagttgcccctgggcctaaggtagaccctactgtgtaaaccagtagttaattgggaccgtaaggaaagagaagacaaagccagaggtatccctaatagtttgccaaatggagtaacaaggagtgttaccaagcacctttcctggggcaggagggtgtcctgggagtggtcataccccatctctataagaatcaaatcagataagcttttctccccagacaatcacgtgggtgtcatcatcagtgaaaagctcaatttccttccagaatagataaattagggcccacactttgaggctcacagtcccctagttgaaggacatatgtgctctgagcccagcgccagtgctgagctgtggctcccattgattctccgctgaggaaggaagcccagaccacactagaaaagcagcttcccctgaatgtgttttctcacaaatgagggataaaaatttaagcccgaaaaccagctgtccaatagcttatctgttttgctaagtagcatccaaaaactctgaagtcataagccttacttgagccaagattatgcagtaatgaccaatttctggcaacttctcttcccaaacacttcaccatgccagtgaatccattcatttacatgaccacatttcrctgtaactggtggagctgacaattctccagggcttggagctcaagtcactgtggagcaaccattctgatcaaggttcctcagcctgtgtccctaaccctcagccgctgatgagcagacagcctcctctggcacgcgctcttcctgatcagcagaggaattaagtggagtggctgttatattgaggactcagaattgttcctttaaagatctgctttcctgctgggcacgatggctcacgcctataatcacagcactttgggaggctgaggtaggaggatcacttgagcccaggagttcaagaccagcctgagcaacacagcaaaacgctatctctacaaaatccaaaaaatcagttgtacctggcgacacatgcctatattcccccctatttgagaggctgaggcaggagaatcagttgaacccaggaggttgaggctacagtgagccaagaccgcatcactgcactccaacctgggtgacagagcgagaccctgtctcaaaaaaagaaaggaagaaaaagatctttcctgctttcttgctaaggcaacacagagcccatccctaatcctttttccatgccaggactataatagagagaaggtgtcaccgaaaactagtgccttttctaagtattttacttgtgagaaaaaaaactggtgcctggccagcttcaggcagctttgccttttaatgaattggccacacgctcgcatatgaggtcatcagcctccagcatcgtttcgactccggggcccagtggctttcrggggtgtgtttccaaaggagctggttactgattccaccttttccctgcctgtcctgccacactctggccagtgcacccctctctccatcctggcttatggatcaagtctcagctcactgggctttgcatgcctggtgtcacaaagcactcagctaaggaactctgcagatttggtgaggctgtaccctgcagagctgtgggattgcatggttagggcctgtctcgtccaggatacacctcagtatttcagaaaacacgaactgattgtgatatcagccatacccacgccacctcttgccagctgtgttattaggcacgtggtctcccctcccagcctcagtattttcatcagtaataagaacagtaaggcactgtgtgtacgttaattgagatgatccgtgcaacacttacatctgcctagcaggaagcatgaggtaggaatagttgttctcgtcctcatgaggcagtccctgctgtgtttcgactggctatgtgaccagggctgacattgggggccaggcacccctctcctaactggcacccctagatcttgtgcagaagtttgcaagtctcagacaggcagcccttcccgttctaaaatcctcagcccaaacagtcttattctggctataaataaaagttcctgctgcacagagagcagcagctcgtcagaagcaaacccgggcacgagccagatcctaaaataaactccaggctgtgatgaggcggcgtttctgtggaatggcccgccctgcctttctctctgcccctgtgggtaagcgtgatcataaggggctggaagtattgctctggggaatcggtagagatgggggcctgttgtaaatggtgtgaccatgagccctgatgcagctcctggcatctgcagagcccaaggggcacagcaagggcttcatggtgatcagaaggttttccctgtgtctccctgccccgtgaaggtacctttccagtttggctcttgtcccagcacgactgcatagcttgaataccagaacgtgagctcacagctgcagaggcagaggcagagcaggccaggcccctttgtccaagagaggccgactctccttgctttctccttgctagctgccccctccttggcagcccacacccctggtcatttccctgagcctccctccccagtgtctggacctgaacccatgcagtgggtgaagttcgtctcttacccatccacactcaaaactgagacgctkctgtgagtcaggtaatattctagacaccttaattaatacagtgcctagactatgtattaggtgcctactaaaatacgtatcagcaaatatgtattaggcccctactgaatgccccagtactgttatttagggcagttcctggattgttgggagggcaggagaggacggctgctgctggccgagaggtcgtccgcaccagcaccatgcggaggacttgcacgcagcgctctgcgtctcgcggaacgtcgcagaaaccttatgggggaggggctattgttttcatccccgttttaaagatgaacagcttgagctgaggctcaagaacttcagtcacttgtactagggcacacaagcggagatgccatgaggggcaactggagaccttgcagtcagccgctgccctgtgccgtctcccggaagaggcaccatgctgtgggagtctgcccctcaccttgttgaattaaaaccggctaaacacaytatatgattggttaggaagacacttctccaacttggtacattttgtgatgacacaaaagccatttgtgtatgtgtaaatcaggtgctcagttattgcagggcacgtggaagcacaaagtgactttacacgggggcgccgatgaggctatttcaagactccagaaggagtcagcgcrgaacatgactccttaaactaggcagcagcaaggcaaggtgagggggatctgtttagcaaatctcgtggcagtgtctgggcattgggaatgaacatctggcagatctgagaattggggctacaaaagattgagccactccctgaaacagtcatacaagggttccctgaaggcagcccccccagcagcacgccgtcccacccctcagccagtgcatcctgcttgctgtcttctctgtggactttcccagccagtaagggaggcttgctgtgtgcaggcatcctccagagatcgatggaaaacccagaaagccaagcccttcaccccactgccatcccaggaaggcccagagcgagctcccaggcctgcagcrccatcctgggtaattgctgtgaaacgttgaagtgttgcgtggagcctgctgtgagggtgtaggtgagggcggcaagccagggtgtaccaagcagggtgtctgccccccgagctcctgaaagaaggatatgaagggaacttcacttgtacaggtacctgagtgttcagtgctggtcacatgtatgacacttccactgatttatttgaccatggcatagggttggccttgagtttgtaggttagatgggaaagcagatgtgtaagtggtagtgagtgcttagggcagatgtcatggatctggtgtgagatcacaggagtgagatgagggaggagcttgaaactctggtcagtgcagccgggaaggggccacggctgtacacacaggtggaaacgagagggttgcgttgtccctcgagttacggtagctctttgtacaggttaaagggtagctttgccagactgcttaagggccaggaatggtggctgatccctgtaatcccagcactttgggagactgaggcgggcagatcatttgagctcaggagttcaagaccagcctgggcaacatagaaagaccccgtttctacaaaaaaatcaaaaagtgagccggttgtggtgacatgcacctgtggtcccagctactcaggaacccgaggtgggaggattgtttaagcccaggaggtcgaggctgcagtgagcctgggtgacagagtgagaccctgtctcaaaagagaaaacaaaaaactacttaaggatgagtggctttgacctcttgttagtttaaaacttcatttttcttcctcttcttcctcttttccatgggttctgaaaatccccagccacagcaaacacagagaatgtttgagcgagtggcacgcacatttgcactgggcttgactttcctcacgtccctgcctctgtagtgggccagtgagcccggcaaggtctttgttttgtttaattttgtgactcattcattcacccatatctgcaaggactttggacgtggccacccccacagcgctctcccagctccccatgatggtagcagcatgatggcaggcctttgtaggacacgatgacatcacatcattagattctctccacgtggtggctgctgaccaggtcctggaacacctctgtccctccttcagcagcagagccccagccgggggtgctcactggaccccagaagccatgggatttgctgtcacttctcaacacagtgtctttcctctctgatgagcatctgggggagtatagccttgtggctacaaggtggcatcaaagctgttgtaagatcacatttgtttttatttgagacaggaccttgctttgtcacccagcctggagtacagtgacttgatcttgcctcactgcaacctctgccttctgggctcaagtgatcctcccatctcagcctccagagcagctaaaactgcaggcactcaccaccacccccagctcatttttgtattttttgtagagatggggttttgccatgttgcccaggctggcctcaaactcctgggctcaagcaatccacctgccttggcctcccaaagagctgagactgcaggtgtgarccaccatgcccagcctacttcatttgttaaaaaaaaaaaaaaagaaagaaagaaagaaaaaaatggggtaggaagagaaatggactcagacatcgttagcatttccatagtgcagcttgccagccacgcttaaggtttgtgccgctcctttccaaaagcattcaaggtggatttcaatgtttaaaagttgcagtgtttgactcttaaggaataaaacctgagagattcatccagaaattcaaaatgagtaattacaatgacattgaatttggccacgaagttcctgagcagacaagacagcgatgggccacgcaggttttattttctgtcccagcagagcatgtggccacttgagccgttctctgtgtcatgctgtttagatagccctgaggacagcgctgttcactctccagtctcagggcccttctcaagggaggaggtgctgggtgtgggtatcacagtggcctgaggactgggggttgcttggcgtgattggtggcccgttagactaagttattgtgaacggcctgtcactgctcagctactgccaatctaattactttttctcttttcttcttgtattctcgtttttgtttgttctccacctggattctgtagtataagtctgtgtttaggtcctactcccaggatttcgtgcctcaccaccaagcttccgttccgcctttccttccgcctacctcctcttcctctccacatttcccacctgcccaccagtctcagagctctgacttagccgtgccaaccatggccggtccacctcccagcaccgtggacgggcctctctcggcttctcaggagagcagctttcatgggaatactgtctgccttccttccgaaacctctttcactgactcggtgagaactcagcgtgcacacacacacacacacacacacacacacccctgcacatggggctgcacgttttttaaaaagcggtttcacgttcctgaaagacactgcctcccctttactagcagttgggggctgccagcgcacacctgctggcagcatggctgagctgacagctactgagggtcacaaggtgcaatgggagcccatgtgtttccagaacagaactgactcttctatacaaagttctatcaaactaggaatctgattttccacaaatggattagtggccatttagagaggaacttatcagacgcataagatacaaaatgctactagctttccatttacttgtctgtttttagggaaaggtacaaagccctttgcaagtgtggaggtgacagattcaggacaagtgtctgttyggttgcatgtggtgccgatgacagaagcctggtctctagcctgttaaagtgcctgtagcgcttcgtccaactcagagaaatgctgccttgcagattggagcagacaagtacatggggcagaggaagtgcaggcagcggaccccactccccagtatgtgggattgtcttgatgtgttgcttctctccctccataatcgtttcccgccacactggggacccctgctgtctccactacagtggggccatctctccaggatgatttagccccagacaccattggaggggcagcagcaggagacttggatcccctctagcacagaggcaagaggtggcaaaagcagctttgctctctgcacctgggaagaccagagtgcaggctgtggcatcccctggccagctgtgagggccggctggagggcctggcccatgtgtctttcctctcgtcctgtctcccccagagtgaaaacgccagtgaggaagctggtgagggtgaatatgtcaatctgtattcctctggccagagcagcgaggagctggctccctctcgaggagtaagtaacctcgggcggcctcctgcatgtggcctggcctggtggggcttgggccctgccctcccgaggccgcttcccccgcacctgcttctgttgggctgagccccctcctagtcaccagcagactgggctcctgcaggctgctgggagccagctcggccctttggagaggacgtggcttccaggtggaggtctgccctttgctcctgcttcagtgcgtgtggcactcctcagagcctggccagatgggtcatctagaaatctctgggaccagcgtggcacgggccccggctgtgtatctagtgctctctgtggggttccttcctccctyatcttctggtgttggcttcatcttctgtccctcatgcagagggagggactcttcttcccatagggcctttcagaccttcatctccctccccagcatgtcccattgctccaacactgactgcttctgaggaagcgggtgagtctggcccatagcccctgccatgactatgcacaccccctcctgagggagccacaaggtacccgacgtcagcaccctcgtgatgctgctgccccagctcccgaccatcgcggtacagcagttctattgagcaatccactttccacattttgcttcagccaaacatgagcaagttcaaaagcttcagaaattgctccccccatgagcccaggtgggacaggttccttgaagggaggcccatgagggctggaagactcccagtgatccaccccagggcgggcccccacccgtgaagagcttggtcacacccgttcaggtggttctctcagcagggtccccacaggggttcagaggcccacccagagccagccctgtttcagacattagcaggttatagaacattgaagagtgtccactccagtgggatttgacccagtccatgggagctgtctcctctgctgacatgtgcatctggcaccccccggctcagcctccccatggtgaagtccacgtgcaggkagaggccagcttcgcatggctctctccctccactgtgacacttccagggctcactggctccttgccttgaagcactctttctgtatttgtcctgccccagttctccatcaggctcagcagcagaccagggatgttggcrggccatgttgtcactgagtagggccagcccagggacccaggaggaagcaagtctgccggaggaagaggggactggcaccccagggcctgagagctggccctttggggactgaacccggttgagcactgcagccctgaggacttctttaaatcagcagagtttggttcacgacagcagggcccagtggttaagggcacaggctttgcaggtagatagccctgggttcaaatccaagctctgctgtttatgagctgtgtggtcttgagcagggtccttgacttctggcctctgtttctatgcatggagtggggacgatggtgttagctcactgacgaagtcaaatgaggagaagtgggcacagcctagagcccagtccctggctgtgctcggggggagtggctatgacagtcttctttgaggaggtagttgaggtggctttgcctaggttggcagcttacagatgagacaaatagtggcacctttcactttctccaaaggccacatgctagtcttgagggcttgtgtttcctgtgattaacggcattcatctttaatttgttcacatctgagattgctccataggaacttgcactccacagccacttgcaggcaggaatgctgggaagacagagcagccccgcrgagggcccctgtccagaactcagcacccactcctctttccaggagccaccggctgggaaagacggacatcccagagatccctcagcggtcagyggcgtccctgggaaggacagcagagacggcagtgagaggtaggaagtggacccagaggagctgggtcccccgagagcagtgcgcccactcatgaggcctgcctgagcagcctctcccagctagcccctaggcctgagggtatttcaagttgaaactcttccttctttccttatttcctttttttgttttttagagacagggtattgatctgttacccagactggagtgcagtggcacaattgcagctcactataaccttgaactcccgggctcaagcgatcctcccacctcagcctcccagatagctgggactacaggcatgcagtaccacgcccagctgattgttttagttttttgtagagacgaggtctcgctatgttgcctaggatggtcactaactcctggcttcaagcgatcctcccacatcagcctcccaaagtgctgggcttacaggcatgagccactgtacctggccctcttcctttttttctgattctcaaataatacaagctcaggatagaaactgttgaaaagcatagaaaactgcaagaaagcaagaaaaatcactaataaccccaccctgcaaaggccttcacatgtagtttgccattacttcttgattgtttgcacctatattatctaccttacaaattacccacgatagccttgtcttttctttttcaaatcccaggccaacctcccttggtcttggcctctttcaagttgatagggagtgtaaaagacaccccctccacttacaaacttgttatcagggacatttctagacatatgtgtgcatgtgatgttgctaacaagaatgtcttgtatatcttaattttttgcagccaagatcaggagctgttcattgcatttagtcattacagctctttaatgtcttataactttttttttttttttttttttttttgagacggagtctcactctgtcgcccaggctagagygcagtggcgcgatctcggctcactgcaacttccgcctcccgggctcaagcgattctcccgcctcagcttcccaagtagctgggactacaggcatgtgccaccatgcccggctaagtttttatttatttatttattttgtatttttagtagagacggggtttcaccatgttagccaggatggtctcaatctcccgacctcatgatccacctgccccagcctcccaaagtgctgggattacaggcgtgagccatgatgcctggccacatttttcaatattagcataaaccaaacctgaccaagtgtagaaatacgtagtagatttccccagtatgcacctgtgaaataygatgtgtaggatctgcaaatgggcactcccacctgcaacttcacattgacttccccttctctatgaaatgttccatgtgttcaagcttttcctccctccttaggtcaagctttagccacctctggggtctttggtgaccttagagcaagggagtgcccacttgtcattatcagggctcarcatgaatggttgaagaggcagttaataaaaatagcaaaagaaagaaaaagaaatgagaaggcattgcatagggacctgttgaagagggccacctgcccagcctgcctcctggccactcttgtgctctctgacttgtctctctgacttgtctgcccagactgagctttccccaggtgtgaagccaggaatggtgtggtttctaggttaatacctggggcagagtgtgtgggccaagcaaatgcagctcgtgggtatgccactagcttcactggaccccaragtatcgtcttcagagttccagatggttctcgtgaaagagaaggatgaacactttgactgctcagaaataattatgggatgttgtccctccatcaaggccaaaccacagggtgaacattgacgagatgtggagcagggattttctcgagactgggcagggcccactctgacccatccatattcttttactgaaggcacatttttttttttcccttgagacagagtctcactctgtcacctaggctggagtgcagtggtgcgatctcggctcactgcaacctccacctcctgggttcaagtgattctcctgccccagcctccaagtagctgggttacaggcaagcgccaccacgcccagctagtttttgtatttttagtagagacagggtttcaccatgttggccaggctggtctcgaactcctgacttcaagtgatccacccgcctcggcctcccaaagtgctggaattacaggcgtgagccaccacgtttggcctaaaggcacatatttttacatctcagatacctggggttaaaatgtgacctatgaccacaagacgggccagaataaaatagaggaacatggaagaaaatgccaggggaaagccaggcatatctgtaggcccagcttccactctccccagaacaccctaagctgggagactcatcttggacacccccggccgtcccaccttcccctttgtgggaaatgttctctcccatccttcagccggcaacttaggctcagtactgcaagcctcggctcacccatcccattccagaagcctcccgacctttagacgaggccagaccccctggctgtgctcatggtacccttctgggcttcccctttctctgtgctactgtgaccacttgttttaaaattctgtctcaaaaaaaaaaaaaaaaagactgggcacggtggctcatgcttataatcttaacactttgagaggccaaagcaggagaatcacatgagtcaggagatcaagaccagcctgagctacatagtgagacctcatccctacaatgaacagaattatccaggcatggtggcttgtgcctgtagtcctcgctacttgggagactaaggtgggaggatggcttgagcccaggaggtcagggctgcagtgagccaagatcgcaccactgcactccagcctgggctacagagggagactctgtctcaaaaaaaaaaacaaataagtggctgggcacggtggctcacacctataatcccagcactttgggaagccgaattgggcagatcacgaggacaggagttcgagaccagcctgaccaacatagtgaatccctgtctctactaaaaatacaaaaattagcaggacgtagtggcatgtgcctgtaatcccagctactcaggaggctgaggcaggagaatcacttgaacccaggaggtggaggttgtgatgagccaagattgcrccactgcactccagcctgggtgacagagcgagactccgtctcaaaaaaaaaaaaaaaagcaaataaataaattctgtctcctgctcgactgaaccctcagggacaagaggctatgtctkcttggttcacagctctttcttagcgccaagcaaagggtcccgtggcaagtcggtccttggagaagacttggggagcagcctcaagagcaatgcagctttctctcccattctgcttgccccttagstcctcctctccctaaatgctaactgtgcggtgggccttggcagggagtggctgagaccatcactcaaacagcttaatggaacctttttattttcccagcggaatcacttccgtgtacagatggaacatccagaggcagcagcgactgtcctatggccacacagccagtcagtagcagagctgaggatccagtccatagtgacgtagctgccatcggggcaggcatgttccgggagcggtttcgagccgtgcacaccggcactgccttggcctccaggcatcgggagctgagccggtttgacacttgcaacacaaaccacttctccccgcagggccccaaagtcaccagatgctctggagtcggctcagtcggargaggaagtggacgagctgtccctcattgaccacaacgaaattatgtccaggctgacgctcaagcaggaggtgagaacttcccgggctggggctttgcagcctggccccacagaggagagcaggtggggcagagaagartgtgatcttgtcataagcagaacaaccctaggaggcttagaraccaagtctttcaatgcccctggtgagcctctgggctgtgggctctggaggggtagactccaggggaagtgtgctgtctccttctgatgcttatagaaagtcatcttacacaggtcaagttctgcagcctctctagctaaagatgccagaactcctgagggtgtggagatggaacccctgtaaatgctctgcagacagagcctgcatgtggccggccctcactaatgggaaactttttctgtggttgaaaaaatagctccactgtagcttcagtctgggagacagaggcaggggaatggcttgagtccaggcgttcaagaccagcctgggcaacacagcaagacccatctctaaaaaaaaagaaaagaaaattcaggcctggacactgtggattccctggtcctgtgccttgcctgcagaacctcgttggtgaaaaagggcccaaacctgtgacagtggagaggaagcaggacagagagtgccctgcctctccctcctgccgtgcagtgctagaagtacaaaggagcggcttcataaagcagccttggcccgcaccaggaggcaactgttttggggcttcgatttgatgacacatggacaaaagggcagatactgccctttgcgcactcccaggcaaggatgcgctggctctggccatggcagggagcagcccaggaatgtgtctgcgccttgggctgtcacacacaggcagggctgatgagggtactcacacagctgggctcctctgcagagagatccttgccataaatttcttccttaaaatcaggtcaaaggcatagttcctactcctagaggtaaacccaagacaatctcaggcctctggagtcaggaggtaaaataccaaagcctaaaaataaaaaggtgggctagtcccggagtgtgtaccgcagctgagagggctggttccgtccctccagcgttacagagcaaggagcattgagggccaggggcagaaacaggcctggggggttgtcctggacctctgttcctggccctagtcacagctctttttggctctacgctgggtggcctctgtttgcccacatggaagcaagacttgcttcttaagaggcaggtgggttggtggcaggtgtgcagcgtcagaagtcattgaatatttctgtctgtaatgctttgctctcctttaaggaagggccccacagaagaaccttgtgccaatgcaagtaacttctacttccacctggggagacggatttagatgtagggcygcttgctgcagttttggggaacatgaacatgcttagaaatagtcctgctgcctccacaggcatcctgggcaaggctggggactgtcttgcccccagggggtcctacctcacctctgacttgtggtttggtgagcaaggaaggatggaaggtgctatgtcccctggcccaagttgtgtgctcaaaacagtggcatgccctggtgccttggtgccggggcagctcccaggccatccagctcccagacacagtccagtttgtgcctgtcaccaagcacaaggtgagtctggagggcacccctggcttcgcagcgcagccacactgctcctgggccgaggagcacagaaggagaggggacttggggttgcagggcattttgtcatctcattcctgcctgtttcttcctaaactgattctctgaagggcatactctgcctcataccttccttggctgtgttcattacagggtgatgacgggccggacgtccgcggaggatctggrgacatcttactggtccatgctactgagactgacaggaaaggtagggtgtcagtgagctcactagattggggctggtcctgccccgggtgccactcggcctcccaccgctatcctgtcccctcctggcagccacagccctgagcaggtctgatcagcagtcctggtgcgcctgagtcagagcagggagagcccaccttggaagacaagtagatcatgttcaactccaggcgtgcgtggcatctgtcctccgctggtacaaggtagtgaccccagggcctccagggtccttgaggggctcagcgcatactaagcgcaccacagacagcgccttgagtgatggcatgtcacccagtagtactaaacttaagataacatgcaggtaccttttgattcctttcctgactgctgagtcactctattgttgcagaccattagaccggacttcactcacatactccacraggaaattcttgaaggtttgttctgtccaggaaccttcaattctgtagcagtggcctcagtttcacagcacacagctgccccaccctaccacgcattcagtgtgctgattgagagggctggaaaagcagggaccgtcccctaatccctaaaacgtcttgttgggtggactctgctagcaaaagagttgtcattcccagtcatgctctggaaaggaggtgctagtgacctgatggggcatggccacagcacccttcactgcctgccctcaaggggccagcaccacctggccggccagtctctccacacgctgcttctctttttacgtttaaaaaaatgatttaaaagatgatgtcagagcaatggtgaagtaaattgtggagggaatgaaaacacccccaccttgaaatcctagcccaacccgtttcatttctgtaagggactctgtccctgtgtttcctcagcacgtttcccaaaacatgtgacccagagtgactcggggaatttctgaattatggaagtagtactaaaaaatatttacattgcagaaaattagagaaaaagaagagatggctcccacaaactcaccgcagccactgctccgccctccccttcactgttccctcaccctttgtttgttctgaccagggcagggcccagacctggcgatgctgcatcctagccccagctgtgccatgacaggctcagagggcccctgggcagtccccgggcttctcggcctgagccgactccacttgttgaaggggtgaacggtgcctgttgttgtgtggattacgtgagggagtgtgaaacctgccccgcatgtcagcggtgctgggggcgtgatcagcagcatcctgagcgccgagtgcagcccttgcttggcttctctgcagtgaatccccctccctgcctgacatggggggctccatactcagccaggcatgggagcgactttcatttcctttttgtccacagcgaggggctgaaatgggagctggcttcagacctcggctccaaagggtgaactccactgtcctgtcgggtacagccagctgtggccaaggctggaggggtccctgagacaggacagccaagaggcttctggcttttgctggctggacctgctgagaggacgctccgtgccggtgggagctttgcctgattttactagcagaagggttggaggctccccagaaccaaagttttacgtaggaagtattactgaggcagaagccatggctccactgggagggtgaagcaccctgtggcaggtaacaaagcaagctccttgggcaggtgcatcctgcaagccagagactgcaccagcatcacgagcagctgggagccccgtggctyaggcccrtggagcccagcctgccaagcagggcttggcagggagaggccgtgtgggggtgctttgtggttgcacggctctgctctcaggtgtcaggacctgcatgggagaaggtcaggtcagccttggcctcaggcctcagcttagatcctgtctatcccttgacaactgtgtgccaagcctgtcacttagccccggagcttccgattccttaggaggaaaatgagggacaatttcggggccttttagggctgtcwcaaagaccaggtgagccagggcgcacagagtgctcaggaccgcatcgagagtcctgtgatctctagaggggtggcacagcactgcccgtcccagaagccaggcgctgtcccatctgccataatccagggcacagcagatgggggagggctctggaattgggcagacatgggcgccgaccccgccacattgcttgcgggtggtgtggcctcgtgcctgggctcctcctctctcggtagggtaacaggactctgtccttgtgggattgctctgggcattgaaggatgtggcatatgttcaaggcatggcccagtgctcaccagcgagtcccacgaagttgtcatggctactggcaatgatgcacccgcaaaggccagttgacttgggccccttcttccagaagcaggtatgggtctatgctggtgccatctctgcttccttccccaaactctttgaacaaaaatccaagcttgacagtgaactgggtgggtgtgggggccgaggaatgagcctgagcacagtgcggatgggccctgctgtgattcccagcccggagcctccttcacctgccagccccaccccacgcagcccccagtgcaagagcaggcgtgggttttcctctcgtttgatgcaagaggggatggggcaagggtgggggcaggagccaagccagcatgactcagctggagatgtgggttcctcgagattcctctacccagcagctcgggaatgagggagaaggtgggagcaggtggtgtatgtccagagcacaagatttaagcagtgcrtgtttgcacccagcctcacagtgaggagcacagctgcggagcctccttgggcctcacacctcagcaggcacggggggtggctgcagggagtgagtctggccacccgttggctcaggcagtgtcctacattttaaaattccacttcattctgtaatatcagagacagcacagttgagaaggtgtcaccacagcaaataaatagggctgttgtaattctggaaagtctgggagtccctgactggtaccagccccctctaagaggaggcaggcatggagaggtgaggggtaagctggagctgccagcccacacctgcccagtggctggcaccatgcctctccttggtacccggcccaagccgtgcctcttcagcctatcccttaggacccaaaacgtggaatttccccggatttttctgattggaccctaccatctaaaagtactgaccaggcacggtggctcacgcctgtaatcccagcactttgggaggccaagctgagtgaatcacttgaggccaagagtttgagactagcctggccaacatggtgaaaccttgtctstaytaaaatcagccaggcgtagtggcgcgtgcctgtggtcccagctactcgggaggcttgaggcaggagaatcacttgaacccaggaggcagaggtggcagtgaaccaagatcgcaccactgcactccagcctgagtgatagagtgagaccctgtctcgaaaataataatcataataaaaatttaaaaataaaagtaaagcctagggtttcatttcaggatcctgctgacgggtttgaacagacgattttctttgttcccatgatggctgagaccctctgaagcataaagccttaggacaggcagagcctctcagagtctaatccagggctggctcctacctggaacaggcatgccaccgggttttgatgcctagggcaggcgtcactcgtcagcctaagtgcccttttccsctgggaccagagttggcctcagctcccacagcacggttctccaggcagcaccatcatcggtagaaagtgcccatgagataaaaccctttcctgtttcccctctctgatctgccgtttcctttgagagatggacagagaggacgtgtgwcttctctgggacatgcaggcggagacaccagagggggttcccaagccctcggctccctcgcccatcccactccccgtgccrtctcccctgcctctctcagagcaaggactcaaatccaccstggctaccaccccccagcactctgcacccagacaagcagtttgcattgtttttccctctagatttggtgttgtactgcgaggcattcctgaccacctacaggaccttcatctccccagaggagctcatcaagaagctgcagtacagatatcctttccttcctgacccagggccccygcaccatgggcattttggagagagagggaccctcttgcccttcagtcctcgtgggggaagccgagcagcatattgggtggcagtgtgattgaagtagggacacaggagccccatggaccgaggttcccacctctaccctccygcattccagctttgagctcaggcaagttcctcatctctaaaagggccgagtgaaatgatgtgaagaggctggaacatagtctgggaatgtgtgtctggtggcagttgtggtcattggatgattctaaaaacgaattagacatgccccagactgggaggggyaagtgtgccggtcctgcagacgcctctgagagaccctcatggtcggctccggcagcttctcagagctgagccccagggcgttgggcacgaaggataccaagacccaaatagacagctcaggggtcagcacagtcaccttccctggagcggaccctgcgactgccacatccacaactggaatgggctcctgtccccagatctaccccatgggcccaccctcagtaaatgtcaccctctgcagtagtggctgaggaggaccccaggggtttggaaggacccacttgtgtgacccattgcctcttcaagtccaaacctgcccatcctaagaggctgacctgcagctgctgctctaggagggtagcctgggtcagctgctcctcagccacctctttgcacatagcccacggctgccatctgctgggcagccaccaccacctggggtaggaagtcctgagtccacccgcgcccccgctccttcctgtgtgccctgagccttcactgctccactcagggcctcctgcagacctcctggcctcctattctcccctcgtgttgacctttagaatccctgatctatcaagacagacgtggacatcctccattggcggagcctcgggtccccggcaagttctgttactcagagcacctgctcacaggcctgactcagtgaatggctgtcactcacacgtgtcaaggacttgctggtcaggcgagatgtgctttacacctgtgctttcacctagccctagctctatgaccattttttaatatgtgtgtgtgggtgtgtataaaattaccatattatacatggggccactgctctataactccctattgtgtaattgaggaaaccgaggcccagagacatgaaggacctgacccatgtggctgcttggtgggagagcagccacacgctgcttgccccctgctgcctgcgcccaggctctcagcctctgcctggctcagccatcatggaaatattgcagcatcaaggtctgggcctggttggctggcgacccctgtgctgtgggccaagacacagtccctggtacgttgctctgtcctgagccccatgacttggaaggtcgtggatcactagagagcaggcaggagggtgtcagagagatctggggagtcgatggcgagcacaacagccgggcaggaaaccctgaccacaaagcagagcccgacctcagggcatgagctagagctgatcgggtgcttgaagtgctgccctggagacagggagccaatgtggagcgtgctgcagctctgggaagagagacccggcccggtgtcacggaggtgagagttcccttgcagagcccagggaggcagcctcaggatggaaactcacagaaagactggagggagatacttctggcctacacacctgcctagggacctggggtttggagggtgtttggtttgggcccaccgttctctacctaaagttcagcaaggcactctctacgtgtctgtaatctcatgggcacctcggggtgaacccgatggaaaggcgggtctggacagtgcagcggagatggcgtggcagggaggagagggcagcagccgggggcatccctggggacagacgcctgtgctcaaatcctggctttgcagttgttccactgcgctagtcccgtgccctcgtttctggatgccagtgctttacatgcaggaagatgggcacattgtgagcgctcagtgagtggtcaccaggagtcagtcctccactccacsaccctcagccgrccacatggctatttctttaacccgtgctccacatatgagaaattctctccctttgccgacacattcaagaagcgcgtcagcaagaacacgttcttcgtgctggtacgggtggtggatgagctctggtgagtgcttcacccttggggtcctgggggccagtggggaggcaaaggctccattccacctgcttctcctgcccatcggctctgggcagagctggctcttgcctgctctatcttggtcctttgagagaatggcctgtgcccgatagaccagggtgagatgggtgaggtgtctctccaccctgcacccaggccctggatttcctcatgaggtccctcctggaccctcaggagagaacccgcccaacgcacctgctcccatggtatcttargtccagtctccagcaggccgtgctctcagccgccagccatggtggaggctgtgtggaggctggaatgggagaggccacctctccctcgctcctcagtgtttccatggctggccatctgacagcatggcacttggccatatccgttccgctaacaaatctccatcaggcggactgccttcctcctgctgggggagatgaccatggtaagtggctgtgcggctgggaaatggccacgtgtggacagtgctcagcagggcaagttggggagcatctagtctgagaggccgggaagtcttggtgtctcattgcccaatgggagcagcagctccccagggcgggattcgtgtaggacttgtccctgcagcccaggccccagcacagtcactggcgcttgtccagcgccaacagatggctgttgagtgtgtggcaggtgcttgtgaccatcccaacacctccaaggacacaggcagccatcccaggctctcgtctcctgctctcttcccatgagaaatttcccagccagctctgtgccggtcacagccccgtgccctttgtgtgtctcaaggcaaagasagactctgcctgggccttgcgttcctgctcctcaccttgtgctcttttgtccttcagcctggtggagttgacagaagagatcctgaagctgctgatggaactggtcttccgcctggtgtgcaatggggagctgagcctggcccgtgtgctccggaagaacatcctggacaaggtggaccagaagaagctactcaggtgtgccacctccagccagcccctggcagcccggggggtagcagccaggtgagaagcccacctctccagccctgcctsttccccaggagccgtgcctttctcagtttaccctccctccctgccagccccacagccccatcctggttctgcacaggccctttgatgaggtgcctcaggaacagccccgtggatccctgggggctgggcctcttctccaggaggcacatattgggtggtgatccctttgtgaccaggaagcgggcagcagggcatggggcttcataggacagggcaggagtgcacacaccctgggctgtggtcagttctgggttgtcccagcacgaacatggcagtggttgatgccagtctgtggcccgtcccctcgacaccgacggtgagtgtcatttgcacctatacatgtctgttgagtagtgggctccttccagtgagcgcatagccttcgtttctttggcaccatctctgttcttgctggccacctggaagtgggctccagccgtgagcgagccttcttggcatctcaactgtccatgagctcacgagggaaactcagtcttctgattccagaagctgctggacatacccagcagaagcaggagagaaaggcagacagtgtcgtcccggagagaggcaggaggccattagggccccagggagccttttggggcttccccgccctgtagcctccacgctcctgctgggcagagargctctcctgctctgackcccgcagcccgggcctgctcagccctccccaccggcctccccacccctgacggctcttctcacacctctgtcttccaggccggggaccttgcacgactttcacagccatgagatagcggagcagctaacgctgctggatgctgagctcttctataaaatagaggtacaggctgctcctgccagggggagccacactgtttgtccctgaatgagagaaacccccatcaggggaaagccggggctccacctccatctgccttctttccttttgtagattcctgaggttttgctttgggcaaaagagcagaatgaggagaagagccccaacttgacccagttcacggagcacttcaacaacatgtcctactggtaagagaggcccagcgccaagccctgttgctctggatggtggcacrtctgggtgggctctgcgttttcctttgcagggagctwgaatggtaggagaaggagctgcctctttcattccgctaagctcctgggggttcccrtgagcactgacaggctgaggacaggggcagggacaggatggggcttgctggaagyggccacctggtcgaggaggctcagcagggaagagtgccagggtygaggagcgatgtctgccataggtggtgttgggaagggcgtgagtttgccctcctgccctggtcactgccaggcaatctcaagctgatgctcacactgactctgcctgacagaacagttagcaaaggagtgggctctataacgttaatgtttgcatttagtctttaattcgtgtgtgtgtgtgtgtgtgtgtgtgtttgagacggagtctcgctctgcaggtgtgtgtgtgtgtgtgtgtgtttgagatggagtctcgctctgcaggtgtgtgtgtgtgtgtgtgtgtttgagacggagtctcgctctgcaggtgtgtgtgtgtgtttgagacggagtctcgctctgcaggtgtgtgtgtgtgtgtgtgtttgagacggagtctcgctctgcaggtgtgtgtgtgagacggagtctcgctctgcaggtgtgtgtgtgtgtgtgtttgagacggagtctcgctctgcaggggtgtgtgtgtgtgtgtgtgtgtgtgtgtttgagacggagtctcactctgcaggtgtgtgtgtgtgtgtgtgtttgagacggagtctcgctctgcaggtgtgtgtgtgtgtgtttgagacggagtctcgctctgcaggtgtgtgtgtgtgtttgagacggagtctcgctctgcaggtgtgtgtgtgtgtgtgtgtgtgtttgagacggagtctcgctctgcaggtgtgtgtgtgtgtgtgtgtgtttgacggagtctcgctctgcaggtgtgtgtgtgagacggagtctcgctctgcaggtgtgtgtgtgagacggagtctcgctctgcaggtgtgtgtgtgtgtttgagacggagtctcactctgcaggggtgtgtgtgtgtgtgtgtgtttgagacggagtctctgcaggtgtgtgtgtgtgtgtgtgtttgagacggagtctcgctctgcaggtgtgtgtgtgtgtgtttgagacggagtctcgctctgcaggtgtgtgtgtgtgtgtgtgtttgacggagtctcgctctgcaggtgtgtgtgtgtgtgtttgagacggagtctcgctctgcaggtgtgtgtgtgtgtgtgtgtttgagacggagtctcgctctgcaggtgtgtgtgtgtgtgtgtttgagacggagtctcgctctgcaggtgggtgtgtgtgtgtgtgtgtgtttgagacggagtcttgctctgcaggtgtgtgtgtgtgtgtgtgtttgagacggagtctggctctgcaggtgtgtgtgtgtgtgtgtgtgtgtgtgtttgagacagagtcttgctctgcaggtgtgtgtgtgtgtgtgtgcgtgcgtgtgtgtgtgtttgagacggagtctggctctgccgcccaggctggagtgcagtggcgcaatctcggctcactgcaagctctggctcccctcaagctccacctcccgggttcacgccattctcctgcctcagcctccagagtagctgggactacaggcgctcgccaccacacccagctaattttttgtatttttagtagagacagggtttcaccgtgttagccagggtggtctcaacctcctggcctcgtgatccacccacctcagcctcccaaagtgctgggattacaggcatgagccaccgctcccagcctagtctttaattcttaaagcaaaatgaatcccagtaatgtgtttataaaccagagctcttgtctcttcaagaggcgacaaagcccccatagcagctcagcatcaggcaggaccccctagagctcagcagctgtgccacccccacccacccactgttgcctccaggagaatgtctgatgtgttttaaaggccccgagatcatctcccgtttgcctatcttcctccccacagaagcactccatyctggggaaaagcatgtttagctatggcagtccagcgtagggttttgcccaacaggatgtggtttctaaagcagacggaagctgcacacaaggccccaagcctggcttctgacaccagcctctggctgggtgcaagaagctcaggggcacactccacagggcctggctgcacagaggtgcgagtgcagtggctcacatctataatcccaggactttgggaggccgaggcaggagggtcacttgagcgcaggagttcgagaccagcctggacaacatagagagacgcccccyccctacaaaaaattaaaattagccaagwgcagtggtgcacacctatagtcccagctactygggaagctggggcagaaggatcagttgagaacaggagttcaagactacagtgagatatactcacagcactgggtgacagatcaagaccctgtctcttaaataaaaaagaagaaccagcagtgcaaagtgcggcaccacctccaagtgaccctggtagtggcccctgtgaaccacaggaaattgaggccagggtgacatccctgctgcatttatcacacagatgagactggcctttggctttggtctcggctttggttgctactaaggttctgagagtttccttccctcgtggctgcccaaggtgacctcttacctcacgtgctagcgggtctccccgagccagtcctgcatcacacaaggaacttgyccagccccctggtacttggggcccatgcttgtcaggaaaggctctgctttcatcctcccatgctccacctgcagattcgaagccccctttgggccttcaccagatttccttatggtcaccagatttattgtcaccagatttccttgtgcctctgtcccaggatgttatgagctcctggagagcagaaactagatctatgcctggggcaggctgcaggtattcagtaggggtgggctcgtggccactggcatgggggtcgtacaggtcctgtctccaccaggacccctgggacctgcagggacttgtcaactcagctgtttctttttcccttggtccatgcagggtccggtccataatcatgttacaggaaaaggcccaggacagggaacggctgctcttgaagttcatcaagatcatgaaggtaatggtggccaagtccttcccaggcccccatcatcagtccctgctctgggagcccgggacccgcctgccctcctgcctcacggcaccgcccctctctcggcagcacttgcggaagctgaataacttcaactcctacttggccatcctctctgccctggactcggcgcccatccgcaggctggagtggcagaagcagacttcagaggtgagtggccttggggcgtgggcgggagggtggctggtaaggggggccgcccagccctcaggcgactagctgtggcagaaagtgctcccactggagcaaatgctgggcctaggcccctgctctgccaccgacatgctgtgtgaccagaacagctgccctcccgccttcctgtctctgatccccaatcttcaggcccccgggagcttcgaggttggttctggggtggtcacatcccggtgttctgctgccacccagcaggcccatccctgggttcccgcctcccccgcccgccctcagcccgttcttctgaagggtctgcttcgggccgggcactgcggtaggtgctggggacgcactgtgaacagcccaacatgatgttgggtgagtttctgctagataagcactaaaagaagaagggtgggcaggtgggccagcccagaggaagtgtcactcatgccaccatctgcagaggaggaggagtttcctgggaagggaagagaatcaaaggggacaaaggagtgcacagccaggagcaggtgggggtcagcacctccagggacaggaggaggccaggggaccacatcccgggagaaggggaccagttctaggtcatgagagcctcaggagcctggtgaggagttggacctttatcctgtgtagggaaataatattgcaaatgggggcaaaacccatggcttttgagtgtcagccaggccacccaggggtcatgtcagggacccaagttcagccaggccacccagggattgtgtcagggacctgagtgtgaccagaccacccagaggtcatgtcaggaacccgagcgtcagccaggccacctgggggtcgtgtcaggaacccgagtgtgacccaggccacccaggggtcatgtcagagacccgggtgtcagccaggccacccagggtcttcttgttcaagcccatgttcagggatggttgtaagctagtgtatggggagaggtgggaaattcacacggcctctgcatggggggtcctcaggaggcagcacttcagggagaggcacgtaacaggagaagaggcaggagaggggccttctgagtggggcagggctggctgagtctcctaggtgggagccccccacccctgcaggagagaagccacccagccctggggagggcgaggtcacatgctatctttagttggtcctccctgagtacagggcagagcaaaggcagctccgagtcagragtgacgccactcagtgtgtgcctgggaagctcctctggctgcaccgccgaacagggccaggcaggagcccatcttccgggatgtcgtatacacgcaagcgctggctgcccaggcacaatgagtactgtggggtgtttctccacaaaayggcctgaagtcccctgtgaccaggggttgggctgacactcgttgaaaaggacagaatccctgctggccagggccaggacccacacctggctgggtgtttgtgcgtagtgggacctgtggagttgggcagagggtggttgaccctccagttagtgaggaggaccagggctctgcccyagcattgccccagcactcgctcacccctgtccggtcctktcctgtcctgtcctgccagggcctggccgagtactgcacactgatcgacagctcstcctccttccgagcctaccgggccgccctctcggaggtggaaccgccgtgcatcccgtacctgtgagtagcagcccctccaggcccccagccccgcctgggtttgcctccattgctctggggaagatctgtcaggytccagcagagaaatcttaatttaggggtttctaacggagacatttgtacttggttttacttaaggttmttgtaatacagttataatgcataatatmcaatacatatatataatataatatataatgcttcttataatacagtttaaacagaaaagaagygctcaggtgaagaatacgggttctcctttcccagcccccagccccactctcatttccttctgtagcctgcccgtgagcatgtgcagccatgcttgtgacagatgtatggctcctctccccacacatggcatcacacagtattccagtgtcctcacacgtggctgcgcattagaacaacytgaggatgcacggccacccagggaccttgagagccttggtgtaaagaagttcagaaagtgcttcctgagcgtggaccatgggcgagaggaaatatgtgtttcatagaaaagggacgtagcggaataaccaaaaccaaacaagtgtctgttgcaggacttacgagagcctttagtatatactagtagacactgagaatctccaagagaccaaaagcgcagcagcatcccagtgctgagtgttcaatggcacatcctatagggttactgcagggctgccctcgaggcctcaaccctcagagatacaaatccccaggcttcctgctctgagcactaacagtctttcccactgtggctctacatctgctccctcaagctgagttctccctgagtggaggaactgcccctgtctttctcatctggccttaagtcctctgcrgtcagaagcacctattaagttactacaccttgtttgtttctttgtttctttgtttgtgatggagtctcactctgtcacccaggctggtatgcagtggcatgatcttggctcactgcaatctctgcctcctgagttcaagcarttctcccacctcagcctcctgagtagtcgatgggactacaggcatgcgcaaccacgcctggctaattttttttttttgtattttttttagtagagacggagtttcaccatgttggccaggstagtctcaaactcttgacctcaggtgatccacctgccttggcctcccaaagtgctgggattacaggcaggagtcaccayacccagccagtttctttgtttaataaagacggagtctctgtcacccaggctggagtgcagtggtgcaatcatagctcactgcagccttgaactcctgggctcaaggaatcctcccacatcggtctccttagtagctgggattacaggtacacgccaccatgcccagctaatttttgtattttttgtagggacgaggtcttgctatgttgcccaggctggtttcaaactctttttttttttctttttttgagacagagttacgttcttgttacccaggctggagttcttgttacgttcttgttacccaggcagtggcgcaatcttggctcactgcaacctccgcctcccaggttcaagtgattctcctgcctcagcctcccgagttgggatgacaggtgtgcaccaccatgcccggctactttttgtatttttagtagagacagggtttcaccatgttggccaggttgatctcaaactcctgacctcaggtgrtcctcccaccttggcctcccaaaatgctgggattacaggtgtgagccaccacacccagcctagctgttctcaaactcttgagctcaatcctcctgccttagcctcctatagtactgggattacaggtgtgagccattgcacccagcccaccacacctgttaataaaaggagatctctgcccctgccccctggtttgggttttgttattttttttttttactgctcatttgttaatgttactttagcagcccacagcttcgcccttatgggttgagccatggcagccgcatcaccctcaggctcctcatcagcatactggcttccgaggtccccagcaggtgcttgtggagccagaggccagaggctgaggcgggagtttgttctgggaaacagacacctcagactggctctttggtttgctctggggtttggaagctgctcactgcgagtcctagcgcctgacacatgtctctagcccttgctgcttccaaaccccgtagcagtaacaggctgcctaacccgtcctcccagggggctgatcctgcaggacctgaccttcgttcacctgggaaacccagactacatcgacgggaaagtgaacttctccaagcggtggcagcagttcaacatcctcgacagcatgcgctgcttccagcaggcgtgagtgccactgccccggggggaccaggcagagctgagccccgggccacacacaaggagagacagcccgggacaccgaggggagggggagccacagaggacccagggacctgccactgctgagatatagtccgggcccttcagtttctgccaggatgacttgagagcatgcccaccaggctccatgccaggcctagcctggccctgggcctggaccccgtgacagcacagctcgtcctcccattttacacaccagaagctggtgcccaccttgctgtgagaagggcctgacaaaccctggcctgcctgactctgaggcaccagagctcccccagggcgggccctggcatgcgttgttgggggcagtgggatcacctggggccccctccctgtgagcagcccagcctcagggccctgtttgtgctccatgtgctggtggcaccgtctctgagcactggtgtcccctctgtcacattggtcaacggtagcccctgcagcatccgtttgctgygaggctgtggggatggtccccgcggcaccttccaggagggtggcgccatcgggccatccagcccacacaggtgctcactgacygctccccatcccctgcaccaggcactatgacatgcggaggaaygacgacattataaacttcttcaatgacttcagtgaccacctggctgaggaggccctatgggaactgtctctgaaaattaaacccaggaacataacaaggagaaaaacagaccrggaagagaagacctaggagcagacgccgggatccaggagaatgctcgaggggcgcagagggcagctcccagaccggagaggaccttggacctgttaggcgcatggcaggagtcccggcctcggagccatgaggctggccagccctcagcggggccgggcgggagctggagcctgccagccgcttcctgcctccttcctctgtgggagcagacccgtgggcctcagggcagccagcaggcaggtcttgttgccaatttacaaaccggtggttttctggtttggttttgttttctgcttttacttccatctctcccctcttgaccttccacccactcccctccagggagagagcagcagagacctcatcagcagaccaaggaagtggtgggtgctccccctccctaagctccagggtccctgaatcttctgaaatctcaaatgagtggaggcctcctggggtggcctgtcctgcaggggccctggaatgggggcaagcagctgggtgggcagaatgcagagtagactcgggggaggatcctttcactttccgcttccccttctgatgcatggaggatggtgtgagcttttcagcaggcccggaaaggtacgcaggtgacgccttagcagccccgcagctggtgctctgccccgcggtactggcgccatcagggcctcccttgcccgcctgagagcagcagcagtctctgtcatcccgtcgccccttaccccccaccccaggccactgggcccctcccacaccacctggggagctgagaagaggaggctggagtaagggaggacttgatcatccaagaaatactttttattgctgggagtcttctgaacctcaccaaactgaggccagagctgagctcctgggggagttaattcagaggggagaggccagcacctccctcctccatygctcgctgtgtgccttaaactccatctcatgtccctccccatcccctggctttccctccctccttgccccatcctgggccagccakcagggctcctcctctggctcttcagacctttcagccagtgctgtcagtgcccctgggagggaagggcatccctgaggcacccgaatggtccctcagggtgcagggaggcagaagcctggccacagaggagcctcctaaggcagcagctgcagcaagcgcaccctctccccactctccccacgccagagcggcttccagagcagatgctgtttccatcctcctcgtcaaaaccattctcgctgctgagcttgacaatctgggcaaggcttgtggggcgcttgacaaacagaatctgccctgtgccgcctggttccgtggcctccagcatgagcctgcaggcagggcgctgcgggaacccagttgtgctgccccagcccatgcctccgggtctgctgtgcatgaatgagtgctcacttgtcccgggtttaggacgtggtcaagtgaacagcagggtctaactgtgcttacttagcccagttcaaacagaacaaaggaaaaatatagaaagcaacatctgttgatcatttaggtttttttttaaaccaccatgtcactttgagtccttcatgggtttttgaacagcatttatcaagaagaaaatgtgggctttttcccctctcccgtgttttgtttgtcctgtagatagagggaggaaagccgtgcagtggcaggcgggaccccctctggtggcgggaccccctcttgcggtggtcttgcggggccagccgggacctgtcactttattatttaaggagtgtgtgtgtagagtcgctggcttattaacagtattgtgtgtgggttgggtttttagtttgttccttctttttgaagtcccttcatttcaatccttgactctctctccccttcccttgcccagctctgttgaatgctgctgtgcgcgtgtgagggccgctctgcacacagggcccttgggttgtgtgaactgaaattctccctgtatttgtgagactcgcaggagtccccatctgtagcacaggcaatgccagtgccatgctgcagcctcagaaaccaggcctctcactccagcagcaggcagaaccgtgtctgtggtcgggtgctgtccacagctctgtctgccttgttcttgggcttgagctggatagaggtggggtctcttcaccttccctgaattcagaacagaccctgtgcctggccccagtgtgcccaggcaattccccaggccctcaytgggagcccttggtgttctgagcagcagggcccaggcagcacatgagcagtgcccaggggctccctgcgtgaggacggcaaggtgcgatgtatgtctaacttattgatggcaggcagccccctgtgccccctaagcctggccctggttattgctgagctctgtgctcagtgctgcggcctggccgtggctcgtctgttcctttggggggcccgggcgggttgtgggaatcagtcttcacagacagacgtgagccaggcggaggactcgttccttgcagaggtcagtcctcacctgcaggtgtcggggtggrggggggcaaggaggggcaggcacacaccatgtctgacctgaacccgattctggggagcatcttcccgctccggccccacgacctccacagggttacattgtaatatatatgccccagctaacctgtctgatggtggcatcttcctgcagacatttcaaacatgtaacttttatatgaaaaaaaataaacacagatgaaagctgcccaatgccatgtccgcgcccagctgcatgtgtgcaactacagtgacagcccagcctgctccatgctggccttgccatctcttttctgagacccctgtcgcaggcggggctcctgggaggctggggtcattcagctccactcccaggcccacttgctgccattggggtagtcgtggctgagtgaaatggacgtcaccagaactttccctcctaggccttgtgccctagaagcattcaactggacaaagaattgctcgtgctccagaggtcggttcatgcacaagagcccctcaccccagtgtcctgatgaaaagggcattcctcgggtgggattcgggggcacaggctctagaattgctccttcggggcccggaagcactgtctttatggcgtgccttttgcggtgtgtcctctgccgcccaggaggcagcacacagaggctcgggcccagccccagtgaagaacagcagagcctctgcacttacaagggacagagtgaggaggccccagggattccagtcccttctctgccccgaggtgtgctgtgtcccctccatgcggagtaaggcacggggcccaatggctctgggaggccatttgtctccctgtcttccttgtcctcccacaccacagcccacctgtgccccattgtttccatcctagcacctgagaccaagcaccccagcatagccacccagggatggcggggatcagggccagccctcatattcaccctggttcccagtccccaactttcagccccacggcggcccctggggaagcccaggatctctgcatctctctgtacctgatcgtgcagaggtcaggcctggtgaggaggaggcatctcccctcatgccccgcaaaggcagcagcttaagtctgtccctttaaagggaaggggccaagtattcctgggctgatcacaagatctgatagaagggaccctgcatcaggcaggcatcaaccatccggagctgttggctgcctgtgtgtcaggcgccaacgccaaagcctccatgaacctcgtaggtgatggaagcccaggttctctcttttgttccttgtgtcctcgggcagattgctcagccactcatgcctcaggctcctcattatctgcttttgtccatttcgaccaatgagcacacagaagcccgagagagaccagtccactcctgagtcctccactcgcatctccctcccctgccagcaatgccaggaagctggtctggccccaacaaccccagtgagcaggaggtgatgtgccaggtatggacctcaggcctcagccttcccaccagggctgcggggcagcagctgctgcgacccaccctggtctttggtgaccggcagaccgcgagattcaccaagggagccgccatagtcacggaggaaacaccttggcttccaccccacccccacagtgtccccgcccaggacctgcgagtgtgcatgcttagccagtaacccaggaggctcagatgcctgctccaaccaagaactgcggtccccccgaaggtgtctgagctgagggccccaagcctcccacctgctctgaccttgcagtaggtcgacaatctgggtcccgcccccagtggtgcaaggctggagaatggggtatgatggctgactgctcattgttccccctgtgggatgggaggcaggccccagcattcattcaaaccttttttttcattcattcactaggggtgcattatttaggaagcagtcaaggtgtggttcgggccatctgagtccctcattggctgccagcagtctgggggaatatgtccttggctgcaaagggctgtgtcctgactctgcagctgataagcaaaaggaccctgggtaagtggttttcttctctgcttggcagtttccccagctggaagtggggtaataacagactctgctttctaaggtctcacaaagtttcaatgagttaatacttggatataataatattttggggtaccaagcactttgcagactgctttacctcattcacttctcttaatcgaaaaatcacacaggctgggtgcagtggctcatgcctgtaatcccagcactttgggaggccgaggcaggcggatcacatgaggtcaggagttcgaggccagcctggccaacatgatgaaaccccgtctctactaaaaatacaaaaattagctaggcatggtggcaggcgcctgtagtcccagctactcaggaggctgaggcaggagaatggcgtgaacccgggaggtggagcttgcagtgagccgagatcacaccaccactccagcctgggcgagagcgagactcctaaaaaaaaaaaaaaacccgggtatggtggtgggtggtgggcgcctgtaatcccagctactcaggaggctgaggcaggagaatcgctggaacatgggaggcagaggttgcaatgagctgagatcgcaccactgggctccagcctgggtaacagagtgagactctgtctcaaaaaaaaaaagggaaaaactaaacttgttttatgaatggaatataaccttgacatcgaatcaaaacaaggacagtacaagataattacaagtccgtctgatgtatgaatactgatacaaaacttataaaatcatcttagcagccccaaaccagcatcacataaaaatcagtccttcctgaccaggttgggcttatctcaaaaatacaaggatggaataatttcaatcagttaatggatgtcactgaccccatgctagacgctgctgctccacacgtctggtttgcatctccttcctgggcacacaggggactacacttcccagccccctgcctgagatctgagaggcagacacatgtcactgtgggctgggcgtttaaggactattgtgcagctccctacttaatctttcccacccgcggtactcctggagtctgggtgttgagatggcagagccccgacttgggggagcctggtcagggaacaccccactcacccacacggggcttgcttgatgtgaatgaaaaatgaagccatggagaccagggttttttttcacggcatggcctcgcttctcccgaatgtaccacgttaacaaattaaagggagaaagccatagaatcaccgcaatagtcacagaacagcctttgttaaaaatgcaacatccattctttttttttttttttttttgagacggagtctcgctctgtcgcccaggctggagtgcagtggcgcgatctcggctcactgcaagctccacctcccgggttcacgccattctcctgcctcagcctcccgagtagctgggactacaggctcccgcgaccacacccggctaattttttgtattttcagtagagacagggtttcaccatgttagccaggatggtctcgatctcctgacctcgtgatccacccacctcagcctcccaaagtgctgggattacaggcgtgagccaccgccacctggccattatttttattatgaataacaaaaattcagggtttcgcttttgtcccccaggctggagtgtgtggcatctgctcactgcaacctcgacctcccaggctcaagcgattcacctcaccctcccaagtagctgggcatataggcacgcaccgccagacccagctaattttttattttttgtagagaccaggttttaccatgttggccaggctagtcttgaactcctgagctcaagtgatccactcatctcggcttcccaaagtgtagggactacagacgtgagccaccacagccggccaaaaacctttttgttaactagaaatagaaagcctctttaatctgatgaaggttaccttccaagatcgtatagagacatacttaattgtgaaatattcaaagtgcttcttttaaaatcagaaacaagagaatgatcccactaactccttgtctgttcattgtactggagatccttgccaatgatgtaagaaaagtaaatgactgagagatgaacaagaaaatctatcaaggtggctagctatacaaccaaataaaaagttcagcatattcctatatacagtcagtcagcaatcagaaaatgtaatccttttttttgtttgttttttgaggatttggggttgttttctgttttgtttttgtttttgtttttgtttaatggtgtcttgctctgttgcccaggttggagtgcagtgatgtggccacagctcactgcagtctcaaacttctggtctccagcaatcctcccacctcagcctcccaaggaactcagattacaggcacgtgccaccacgcccagcttcaaaaaatgtaattcttaaaggaccccatttatactagcatcacaagtcttaaggtcctagaccagcaaaagatgtgtgaaacctttataggaaaaatgataagattttattaaaaaccataaaaaaaaaaccttaataaattgagaggtgtgaatgtttgtggataggaaaattaactttctgggagttttttgagacagggtctcaactcccatcacccaggctgcagtacagtagtgtgatcttggctcactgcaacctcatattcctggactcaggtgatcctcccacctcagcctcctcagtagctgggactacaggtgcatgccaccacctccagctaattttttttattattatttttagtagagacggggttttgccatgttgcccaagctggtctcgcactcctgggctcaagcaatccacctgccttggcctcccaaagtgctgggattacaggcatgagccaccacacccagccaatttttgtaaagatgtcacttctcccccagataatgtataaattcaaaactattccaaaggaaatcaaagaaggactttatgtggtccttgatgaagttaattctaacatgtgttaaagaattaccactctggcgattccacccagccatcctgctaggaaagcttgatcagattctaaaaccctacctgcagtcaggtcaggtggctctcacctgtaatcccagcactttgggagccctaactgggtggatcacttaagatcaggaattcaagactagcctgaccaacatggtgaaaccccgtctctactaaaaaagaaggtacaaaattagccaggtgtggtggcgcattcctgtaatcccagctacttgggaggctgaggcaggagaatcgcttaaacacgggaggcagaggttggagtgagctgagatcgcgccattgcactccaacctgggcgacaagggcgaaacttcgtctcaaaaaataaaaataataatgtaatatatataataaaaccctgcctaaagtcatcagagaactaggagagaaggaggaattactgggccaagattcaggaagagacaggagggaagcctgacacctggggccatgtaatgtaaagggcgtctgacaattccagatgacgtggccgaggaactgagcagaacttcagacaaaagagtagttaaggaaaaaaggggagagtctagaactcaccaggctttgaattgaaacctcagggagctgccctgcaggtggaagggtgacccatgacaagtataccaaccctcacagggacagagccagctccagatggtctcagtccctgaaactggattaagatgattctggacacctagcaacccaggcacttgccagaaacaaaggcaaagaaactggagaggtttggccaggcacggtggctcacgcctgtaatcccagcactttgggaggccaaggcgggtggatcacaaggtcaggagattgaaaccatcctggctaacacggtgaaaccctgtctctactaaaaatacaaaaaatgagccgggtgtggtggcaggcgcctgtagtcccagctactcgggaggctgaggcaggagaatggcaggacagggaggtggagcttgtagtgagccgagatcgagccactgcactccagcctgggcgacagagtgagactccgtctcaaaaaaaaaaaaaaaaaaaaaaactggagaggttaacatcatcctaggtctctagttatttcttaatttttcaca

SEQ ID NO: 17739 - DNA, 76064 bp, Homo sapiens
  misc_feature (1)...(76064): n = A,T,C or G, or insertion/deletion polymorphism (see Tables 1-2)
acattagcttgtgcacgatttcccacataatgaaatgctcttcaagtatatgaatcttagcagcttcactgtatttcattcggtcgctctcctcctcgaaatattttcttatcttggctcctagaacaccacattcttcacttttcctccttcctcaccaaccccacggtctcctctgccacgtctttcttatcycccttacctctaactgttgaagaagctccagattcagtctttaaactgcttcttcctctactcggatatttagggaatcacattctacctcacagctttcaacaccacgtatatactgacagtttccaaatttatatctgcatcctggacctctgtactctatttcagactcttatgctcagtgtcttatagacatagttatttgtcttacacagacctcaagttagcatatccaagactgatctgataatcaccccaagtaagctcccactgaagccttgactatttctgttaaggacgatgccccattcttctagttgctcagatctaaaaccttcagagtgacgcagctctcttctttctctcacgtcccatatcctatcattatctgtcatcaagttctgttggctctacctttaaaacatacgcagaatctgaccatttctcacaaacccactagcactaccctagtgaaagccacaccatctctcacctgaaactgatgttcttgcttccctccccctcccctcttgaacccattccattgggctgttattccaactactccactggaacagttcttatcaaggccaccaaagactaccattttgacaaattttacggtgatttctcagtccttattatactcagctggtcagaaggcatttcacccagttgcatactcattcttcttggccatctttcttttcttttactttaggattacactttctctttgtgtctctcctaactcactgggtgccccttttcattctacttggcaggttcctccacactctctgacctaaactattgcagtaatccatggctgagttctcagacctcttcccttctttatctccactcactctcttagatgatttcacctagtagcataccttaaataccaacatgccattggctatttgatgtctcttccctaaactctgtactcatccatgctactgccaactatttcttgaatgaatgaaggcaggaactatgctcatcttcatggttatactcagcacctataatagtgcttgacacagcagtcaattatcaactgttaaattaatgaatattgttcaactcggtgccactgtgagaaaattaaaaagatagatgacagtcattagctaatttcaagtagtttttttttttagatacaagccagtgccataatagaaggcagttcatgatattgttttctaaatatacattggtccgatggtctggcttgttccaaacctaagtatcagagcaccaaaaggaagtgatagataaaatgtcagtcagtaaaccctctgttaatatttttttcctcattctcaggccattagtaatgtttgagcagcagaaatcttagagacatattcttaaatatcatagagtaaaagaattctatgctgccaattcataacaaaatcaggcataatcaattgagtgaaggttaaggttggcactgtcttgaaaaattaagcagcttaaaaaggacaaacgtaacaaagaaaagggacctattctatgttcctttgaacaagaaaaaaaataaatgttgaaaccccaaatgtccaggccatttcagtttctcagactacaatccattaaataatcatttaatcacagtgacatggatgaacacacagatacactgttgagtgaaagaagcgtgacatagaagactgcagaagatgctacagtctttgcctccactaggaaggagggccacatgtgtccatttaagttaaagtcaaaaaaggataggagagtactttcaaaaatgatgaaaatggtggatatcttaatttgggtgatggttacatgggtgtacatatttgtcaaaactcagtgaattgtatacttaagagcattatgttttaataaatttaaaatataactcaatttagacaaaattaaagtgtctttcaatgagtgttctggatgaagaggaatgaaataaatataaacaaatttccttactgcaggatctcttacagcttttaatatgcaattatgcactgtattatttctaagaggagactataagatacagtaatgttccagacttaattggtcaaggaacctttttttctcatatacattgacatatgtaagacactacagtttcagaaacccaataactttagcctggaaaaaaattcaaacaaaggctacaaataccactgaagtcattgagaaaatattaacatctaattttaagcaatcactttctagtgaatcttccaaaatgaactagttataaaatgtattcctatatatggtccaattaagaactagagaaattctgcccaagataataaatatagttctggtattgttaaccttaaattccttctggcagtaattagatagcaaagccagatgtatattgaagaattctaagcttatggcaaggaagcatcattcatcatcacatagacaacacttatctgttttgtgtaagacatccaactcacccagagatgttattcaaggcattaatacacagctaaagatgataggtcataggttgagctccccaggaagctgactctgtgactgatgtgtgtgcaagagatttgtgtggggcgagctctcagatcaacaccggcaggggagcaagagaagccagactggacaaggggagatatttaacttggatttgacacaacaaaggcctcagtgaatcccatagaagcactggaaccaaagttcttcagccatcaggcaagagggccagccctttatatcctcacaatggaccagtctttgcatgctggctgccacagagaaggggcatgaccactggcaagctggcttccttggctgaggggagtgttcacagaaagagtggagagccagccaccaatccttccagcagcagggagcccgagtctcagccctgaagcagaagctgggcgaggcatcacggtgcgcactacagcagccaacacacactcgtctcaccaaactcacaggggcatctgcccagcaagaaactattcctacctaatctaaccctcatgctattaacctagaagctctgtttaagaatcaggagcctagattatgcccctactgctttgtccataacaagtattcataaaattgcaataaaaactagaaataatcttagatggtagccaaaaaaatatttcccagtgtaaaccacataataagaaacactgattagttttggcatgactagaagcctagctgttcttcatgagaaataatggactgagatcatcagaattctctaagagctataacaagaacatccataaaatttaacctcagaaaacttttgaataacttcctgacactggagtattttttatattacatttccctctgctatctttaataaaattaaattggtatcccaataaacaaagtaacaagaaaaaatgagaggttctaagtttctccctggttctcctttttaataatcaattcatcttaatttatgctaataacaattcagtcagaacacatctgttgaggaccttccattatgagataccatgcttagataccacatgtgaggtttatgaattgcatctgggtggataatataatagtataagatagatgtaatatagattacatctatattaagggtatggaaatgaagttcaacatctaatagagaagacagacatttacacagatgtcatgcattcattcaacaaacatacttaagcactatgcgcccagctgttaacaagatagacacagttcctgcctttatgaggcttacatgagacatgatgtgttaaaaatagaaggctgcagaaggtgctatagtctttgcctccactgggaaggagggctacagaaagcttaggaacagtaaacttagtaagaataatagcaactaacctttattgagtgcttaaaatgtgccaggcaaatatgtaaatttatttggctttcacgtcaatcctgaggtctttttattattaatgttccctacttgcggatgaggagactaaaacacagagattaggtagcttaatcacgcttacagatgtggtgagtggtaggcctgggatccagagctgctctggaactgagcacgaatttgccagatggacacacacaaaaaaggaatggtaagagcactccgggcacagggaagtacaagtacagagacataaaaatggtcagaaacatgtaagttcagtctgcatacaggctgactgggagagtaaccagagtccaggcctgcaaagtggggcaagcagggtacaggtagatgaagaaaagtgttatgtgccccacaaggaagggactgcaggagtgtaggcatgggagtgatgccaattgtgtcattaatatcagtaagaatatcaataggaatgaaagtggctgacattacttgagaacctcctataagccagacatgggccaaatacttacacacattatctcagtttagcttcactacaatcttatgaggaaggtattatcccattttacaagtgagaagactgagctttaaagggagcaactagatgaggcgaggttctactgtttatgagtgatagagctaggatccaaaaccaaggaactctaaggtctgtgttctccgctgcctgctcgccagcgtgcatatttaacgtggaggggtaggagggtggcaggcagggcagtgaggggggcactaaggcacccacccaggaaacaggtggctagatctcgaccacagggtgccagctgcaggctgcaggagaggacatgtgagaaacacgcatacagaggtagcaccggagacgaagtgggatctggcagcgagaatgaaggaagagtcgcggataacagcagctgtctgaagaggtggtgattccatcatgcaagccaatgggtaggaacaagcactgagagccgggcagggggatgcggagtgagggaagatgctgaggtcaaggtctcccaggctaccatggaaggagccaatgggcagctagagatttaggtctggaactgagagaaataatcagctatgaaggtacagacttggccacaaacatattgaaggcatgagagtggttgaatttgtctagggagaatgtgaagaacagaaggtgatagaactgtagcaaaacccaactattgaggaaaatattttcatgcctgcaaaaagagagagatcgaactgcctcctttagaaacctacttgggaaagggctttctttacaagtaaggcaagttgtcattactggtgggggaaaaaaattggtactgcgaaaccaacttatttcctaccacatgtgaggttttgaataatatctgggtggcatatttctgctgaagaaaataagccagttcaatggtgtatctattaaataaaaatagtgctaatagtttatcagagttatcaccacagacgtgcctagccaccctgagcctatgtggccaatgtcagtaattccactctggacacaaacactgttggctttggatggaagtgccagacactcacagcactcygaggacatactgttttctagccttatttatgttctctcttcacccttcagcctaaaaaattaccacagtgccacttacctaccttaatgggaatctgcacaaaaggccatttctccagtttctctcaaaagcaaaggaaaacttcccaatattaatatgtagcaaaaagagggagaagaaaaagcctgtttggtccgccctcctggctgttgctaccttgcagcttatgacatacacrtagagggaggtctgatgaaatgaacgagacagtcagagagctactccattcccgtggaaaccaggagtcccttggtgcagacagctcttcctactttcccatgcagttcttttgtgcgactttgaggggctcgtgaatgatttctaaatgtgtgcctgctgaggcgagccgcacagggagggaggaacccagccgagccgtgccagaggaagccaacaggatcctagcagtgcgggagctggctcagctcttgcatgcagtttttgaagtcagcaaaacagaaaccaaattactatcatattatgctggtggaagatcaagaagaggggactctacaccagtttaattactgtgagagatgcagcgagtcacagaataacaaatgtatctcatgtgtgraccctgaagacaaatgtaagttctcatgccgctatattttattgctgtgtaattttctttccggtttgaaatcatgcttggccaacatgtaatcatttcaatgagaatttccagggaggaaagttgtctgctaatctttacttaagacttttttgttttccttttattagctaagcaacattataggagctgaaattcctgacagcagctgtggcaattcarcytaagaatggctgagaactgtaacccaaagtacatccaattactatgggattaacactggatgtatttttaattgactttcttaatgtagaatgtgtacatccccactgtttctgattgcatgctattttaataatactgttgctaaactagtaccatcrgcataaccaacaaaatgagatatagttaaacaagagtcccagtagttataaaacttttcttctttgtccaggacatttatcttyccgarcgctcaaaaaaaaccctgcaacctctatgctaaaagttcattctgcttttttgtcctcgstttggtgagaaaataataaaaccaaacagtggactctcctaaaattgtgaatgaagaaaacttacagccaccacagttcagttctttaactatcattgtaataatggaagacaaaaatccagccccgggagaacagcatgtacaccagcctcagtgttacagagtgtgggtacatcaaggtgaatrgtgagcagaaactataacctgttagtccttctacacctcatctgctacaagttctggcttagacatggatattctttgtgaagaaaatacttctttgagctcaactacgaactccctaatgcaattaaatgatgacamcaggctctacagtaatgactttaactcyggagaagctaacacttctgatgcatttaactggacagtcgactctgaaaatcgaaccaacctttcctgtgaagggtgcctctcaccgtcgtgtctctccttacttcatctccaggaaaaaaactggtctgctttactgacagccgtagtgattattctaactattgctggaaacatactcgtcatcatggcagtgtccctagagaaaaagctgcagaatgccaccaactatttcctgatgtcacttgccatagctgatatgctgctgggtttccttgtcatgcccgtgtccatgttaaccatcctgtatggtgagtggcattagtttcccagctatattcgcactggtaataaagagcatgtgcatgccaccagcagatgagatggggctcagggggcaaacaaactataaatagaagtctttgtttatagactagagcctactatgttacttatattttactcttaaaatgggatttcacataaaaatcagacagtctatgacctgtgatcactggagagttttgtgcttcaaaacgcgtacatcctgtgtaaaaatgatcattggagagttttgtgcttcaaaacatgtacatttaatgtagraatttttataaattaccccatacagtcataaaccaataacttacccatcattctgaatctacttgatttttgcttctttatattcccaaccaatattccagccttcaggacagaacagttttaatctttgtcacacagttttcagcacttttaatggagtgataaagccttcccaattactttggaacatttgcagagagaacattagtggtgcaataggttttatgttaaaatatgcagaacctcaattagaataaatgaattactccagttttaattgttccctgcccagagaagctaatttggaaatgtgcctttgaattatatcctcaactctttgaaaatgcatatgcataaactcctccagtctggtttggaggagggtgggaaacaaatgggaagggattaatcttgctttcttctcaacagagtttgaaacagtcagacctctcagcaagggaccagaatgtgatattctttccaaattatgagtaatacagccagatacctccttaaaggagagactattgtgactgctgacacaggcacaagcagcagtcactcagagcttagagacaggttatgatagctatctttaaagggaaattttctggtcaagtcttaggggctaagattaaaaaacatcaacccagccctagagaatgtgaaggaggaaggcggtacgcaagggcgagcaggcgccagtttgcacaaagctagtaacactcattccaagtccagccttcacttgaccrtttaaatgccacaccggaatgatttcatttaatttgcctgccctttccccggcatcccggggaagattctcgcttcccaaaccccctcccctagggggcaaactccagtgggggtaggaggagtgacagagcgggacccaaaacagaggctggagggtggggtgacccccggcgtcacccgcttggggagcaagggcgccccctggcggccgccgctctgagagcagcccgttccctccggagccccgcccctccctaggctgctcctccmgcctcccccagcccacggggcgtggggcatggggcttctcccacaaggaaatgccccctccttatcccgcatcagaaacacggactgaggcctgggccgcctcctggcagagaaacccctccgagggccgacatctgttccgaacagacagagcgtggcttcccccataaggcgctgcaaaggaaaaggctttcctttcggctcaagctctttgcaaataatacatgtgaatggctgtaaattaggcttgtacctacgccctttacttgtctaaatatcccttgtggcattttggtagagagtgtacgtttgcgttggagtttgttcggctttgtgggtctgtaataagaaaagtggactttaaaattttccttcttacatgcaggcagatctaactccgctgcttatactgtgatcaaaactaattaaggtttacataactgcttaatccccctccaaaacacaaaaccaggacactttgtttatgtccataaagcacactctaaccttcctcatatagcaggtgacctgcagtatctcttacattggaattgtctggggagcttggaaaaagctttgcaaacgctttgacatttgatgtccacctcagcccaccctccaaacatgatttaattgggctgggtttggcatgggcatcaggaccttctctaaagctctccagytgatactgatgtgcagccaggggtgagagccactaccctaaagcagctattcacaaagcgtggtccctggaccagcagcatcagcatcacccgggagcttgctaattcagatgcaaattctacagcctgctccctactaactgcatcagaacctctggacggagktccagcagtgtgtgttttaagaggtgtggcagagtctgatgctcactaaagtttgagaaatgcctccctaaaacaaagctcagagcaaggacaccttyctttatttttcttcacccttgtcttcagctctccctacacataccccaaatttgagtttggcacccaaagcattattagatcattatttttcatttttacaaacagacatattcacaatctgaatttttagtcatttagtcatttgcactaatgcaatttattgccawcactgtatgggactggatggttataataatgactaagaggtgagactaaccttagggaaatacartccagagaaatatgtgactaaatcctgacagtacagtgtgagaggtgctccagaagaggrgccaaaacacaaattttgacataagccattaacaaaagaaatgttttgccaggcgtaagggggaagaaagagaacccccaaatagagaccatccaagcttaccgtgccacactcacatamctccagacactagaaattttcaaaccctgcattcatcagccagtgctagcttatcatagttaagtacagttgccagtgggcttttttcaaatactaaaaatatattgtgttgccctttgccaccacctgtgcctgtcccagagctggaaattgtcataggatagggatmcatgtgctccaggaggcacagggttgctcactgacaccaaccttctgcctcatagggtaccggtggcctctgccgagcaagctttgtgcagtctggatttacctggacgtgctcttctccacggcctccatcatgcacctctgcgccatctcgctggaycgctacgtcgccatccagaatcccatccaccacagccgcttcaactccagaactaaggcatttctgaaaatcrttgctgtttggaccatatcagtaggtaagtggcaacatatttcagagtctcatttgaaatgacagttcgtgctttctgaaaagacttgttccattttgtkgtactgaaacctgacatcctcaatctactgttttgggtggtgcaagatatgttacaacatcatarttatcagattcgcttcaggaaagaaaaatctgtttatgtcactggctgacaacatgaatttgtattgctttgcacaggcaaaactataaacagtagagccaaaaagtcagaaataactgtgctgttttccctatttcttactttcaagtccacractctaattcttgggtttcccaaagacctcaacttttataatcactgaacttatgatcaacgtaaggatgcagaccactttgctagagaacataaagcctctgggctctagagaaaggtaccatgtgctgtagcttggagggaaaaggtgggccagaggaaagtgccaggatttgctttggggcaaggctgcttttcagtccgacccagtgtccctattgaccttcctccttttatgataccacacaccaaaggatttcaacttgcttctgttaggttgattacatatattcatctctcgccagtattgatcttctgtcacacacctaatagtcagaaaagcccaggtaatggaagctaagggggcgggtctcaggcagtgaagtgaattgtacctgtcaacctcagcagcttggttggtaaccaaagattctctgacattcattttaaaatccaaaagcttagcaggcaggagtgttgcacctgtttatggccacgccagtgccagcatccgctaatatgagagactatgagattccaccgcttgaaatcaagggcttgagtgagcttatccacagcattggaataatagtaccaataataagagccaacacaataatactatatcttgtgtattttagttcccattgttttctttgctgctagcaatgggaactattatgcaatttgaagagtaagtagctccatcttatagatgaggaaaaactgggattcaaaaagcaaaatgagctgtgcaaagccccacagccagtaagtagcacaacaaggattttattgaattctgatgggaacatctgatggaaacactaacaaatcacacttgtgtcactttcaaatgtttaaaaagtcttacctacttcctattttaaatttcccattaccgtttgagatagaagattctatggtgcttatttgataaatgaggaaaccagaatacagaggtattgtggcttactggatcatgtctccaacttgcagcaggactaggactctaaacttccagcaccatgccctgttctttctgtaccttccttaggaaacagtttttgctcctagaaaatgcttgtagtttctgggactgtgcaagttggactcattctactaagagcaagaaagtgaagggccagtaaccactmaatcccaattacacataaaatgcccctgggaacattctgatttaattgcctagggtgaggccaggtgattctaaggggcagtcagagttgaagaccactgagacaggttttcagggtggtcagcgtgataagtaggagaatcaagattaatgcagagggagcaaatgaagctatttatttttaccctgatacactgtccatagttttaccccaatayactgtgccattggtgagacaaatgctgggaaggtcaaccatcttttcctcagccacactgactcccccatctcattcaggcttcatgataacaccagtagtaaggtaacagtttctgagcactgagtacggacccagtagtatacaaagccccttaaagaaaatcagcttcagagaactcagttgcacaggatgatatcacttataatcaggagtcaatatgggtcaatctgagtccaaagcccatgctctttccactgcacaaaagatagccagaaagagccagaggcagactatcaccacaggaggcaggcaggctggaatgattgtggtggtgccaggcagggatcattcatccatccacttggccagtctttttgagatgaagtttcgctcttgttgcccaggctggagtgcaatggtgctatcttggctcaccgcaacctccgcctcccgcattcaagctattctcctgcctcagcctcctgagtagctgggattacaggcatgtgccaccacgcccggctaattttgcatttttagyagagacaaggtttctccatgttggtcaggctagtctcgaactcccracctcaggtgatccccctaccttggcctcccaaagtgctgggattacagtcatgagccactgcccccacatttgaccagtcttgtaatgtgcatctactatgtgtttggcactgtatagaccaagatgaaaaagatatgcattcaaagatctctcacagtaaggtaggagaagacaaggaaacaaaagaataaaaaaaagttacatagaatctatactagaagtctgaggtgtgtgccctgaggagggggcaagcggaaaatgtaaaaaggaaaaagrcagatctaatgaaggacctacagagactcagcacaaatattctcttgagttttcttctagtgtttctgttttgattattttgctttgggtttagttttttgtttgctttgtgtgtggtttcttttaatttagatccttagtctagctggaattttaaaatatgatctaacytgtttgcttctactagtaactaaagctttttttagactcaattgatattttctcttcaagctattgatatgttcactctcttggtaaatttctaaatgtaatactgtcttacattcctggaatattgagtttgtatgacaaagttggttggtttatgattcttacaagttttctttttctagctttattaaatgatagagaagtttccactttccctaagtcttgaagtctttaagtagaaattacatgtttttgagaggttatgtagaacttggttccaaatctcttcatcctggctcctttttaaatagtattttaagttacatttctaacttctatagttattgcatttacattttctataccttcatgggttattagctgcatacaaattttaacctttacattgattcttttatcattaactgtcccactttatatctagtgatgcttcttgatttaaaatctatttgatcttagtatagctacgttaattttcttttgattatcatttttggatatatcttatttcatcctgttactttcaaaccttttgtgactttaaagtgttagcctgtaagcagcatataaagttttgtttttaaccccatctttgtcttttagttggagtatttagtccttttacatataatgttaactcatatttgggtttaaatctgttatcttacaatttgctattttcttatttgttctatattctagtttcttttcattcttaccttcttttggactaatcaagaattgtcaattcatcattcccctttatgagcttgttatccattgttttaaattacttcaatgattacaacattccttattgaccttagagtctaaaacaaattattacttgtaacacttctcggatagtgcaaaaactttagaaccttttagctccatctatccctgttgtcttttgggtttttccctatttactaaatgtcttttttaaacccataagacatcattatagccattctattcactatttctcacatattaacccctgttgctgtttattgctttcttcattttcatgattttgcctgggttcctcattcctgaagaatttcctctagaatatcatgtcgtttgttctgtttttcttatcctaagcatctttattttgctttcatttcaaacacatttttgttcagtatagaattctaggttgacagtcatctttttttttttttcagcacttcataggtggcaaatccaacattccaggcttatattttttgtttgtaagaatccagctgtcagtcttatttttattccttcagaaacatcaccttgtgccacgccctgctgcttcagaatgttttgtctctattttagcaactttatcatgatgtacttagttgtgaattagtttctgtttttatcctgcatggtgtatgtactgattcttaaacttgtgactttggccactttgacaaaactcttggtcaccatcttttcaaatattgcttctgccccattctctctcttcctcatgtctgggactccaatctcatgtatgctaaaccttttacctaagttctttataactcaagcacttctacattttttttttttgctttgttcttcaacttttaagttcaggggtacatgtgcaggatgtgcaggtttgttacatgggtaaacgtgtgccatggtggtttgctgcacagatcatcccattacccaggtattaagcccagcatccattagttattcttcctgatgctctccctcccacctccccccaccaacaggccccagtgtgtgttgatccccaccatgtgtccacgtgttctcaygattcagctcccacatattagtgagaacatgcagtgttaaacacttctacattttgtacatttttctcctyttatttcttgagatagctttactgacttttcttcttctgttactagtcctctcatcagctacttctaatctgcctaagacccatctcttgttttcttaattttaattcctacacttttagttctagattttttcatttaattctttataaattccaggtttttagaataattctccatgttttcatctatttycttaaatattaatcacaagttatctggatctctcttttctgggttgtgggattacctagggatttctcttttctgagttttggggttgtttttctcttcattctgtctgttgatatgtytggtaatttttttaattgagtactgtgtatgcctgataattttttttttttttttttgagacagagtctcactctgtcgcccccgctggagtgcagtggcgcgatctcggctcactgcaagctccacctcctgggttcacgccattctcctgcctcagcctcccaagtagctgggactacaggcgcccgccaccacacccggctaaatttttttttgtatttttagtagagatggggtttcaccatgttagccaggatggtctcgatctactgacctcatgatccgcccgcctcggcatcccaaagtgccgggattacaggcatgagccactgcgcctggccgcctggtaattctttttaattgaatactggacactgaaataaaatgtttgggtgttttgttgatactgcctttctccagagtggagtcttttagcattaacagcagttaaagtaagcacagttccccttaatccaataagggattgagtttatttaaggcaaggttcttataaaagccagtctatttctagtttgcctttatacctaggatgtattttttcatgatcccagatgaaagcctgacgtgttctccattttgaggagctctgagcttcaagtttcatatcctcaacatcgtaagactactgctaactctctttagctattcggtctctcaatctgttcctttaacaaactggcaactgcctgagtagaaaggtagctcatagtattaccttgctttcttgctcttcccttcactccagaatcttaacttcttaacatcctggctaccttggtaccctctcaccaattgctttttctctccctgaccccaaggacaggtttgggaccttgaattctgctttacgtggtactaatattactctatcttttttgtttgactctccccaggctattttctcaccttttcatttttaatatgtttttgtagctttgctttatgtgcattttcacaagtaacatatggatagatttatttaacaaaatctgttagtctttgcctttttaatattgaaatttgacctgcccacatttgtgacaatcagcatcagttttagcccttccatcttatatttatattttaatagctcatttttaaatgaactatttcatttactgacttgcacaatrtcttaatttccttcctccaacccggttagtttgaattgttatgggactcttccattgctcttatgattacagtcccatttcaaatcatcacgttatttctattaatatatctaaaataaataatctcattaagttatttcctcattaccctgagtcccaattcacaagttttccaataatttctaaataacctagtggcagaatagatctttaaaagcaagtcaaaaaatgcagatgccataaagaagaatatatacataaacagttatataagtytgatacggctaaaatcagtgtaagcaaagttaaacgaaaaatatttgcaatgtatatgattggcagaccaagggttaataaccttaaaatacaaatagcaacatatttaaaaagaggaaaaggaaacaatctaacagagagaataagcaaactaaaatttcaggcaattcacagaaacataacttgaaatggacaataaaacttatttaacatgtttagcctcttaaacagtcatggcaatataatctaaaacaatgcagtaacgtctttcacttatccaattggcaaaatgaagttagtgaagacagccagtgctgccctgaatatggcaccacttgcactctctcaaaaccctgcttgtggaaatgtgaattatttgttcttgggccatctagcaaaagctattaaaacttgacctaccaattccacttgagagaatctattctatagaaaaacaaaagcacatgtaatgatttttaatgcagcaatttcttcagaaagaaatggaaaggttggattatgtttagatatgtcacttttctctaaattgcagaatattttgaagatcttaaaaatattaagttgagactacagttgtttccattatccagtttccctttccatagttttatttacccagttaaccacagtctgaaattgttaaatggaaaattcaagaaatagacaatttgaaagttttaaatcgccctccataccaagtagagtgataaactctcccgccatcctgcctcgtattacccagaatgtgaattatccctttgtccagcatatccacactgcagatgctatccacctgtgagtcactttgtagccatctcagtcatctgatcaactgccatggcatcatagtgcttgtagtccagtcatctttattttactcaatcatttactaatactttaattcttactgctgctaatctcttactgtgctttctttataaattaagttttatcataggtacgcatatacaggaaaaaaaaacagtctatatcaagtttagtatccttggtttcaggcatctactggaggtcttggaatgtatggccctcagacaaggggggaccactgtatttgatatttaagtgaaggaatgttcataatgttaaatgcaagaagcaagttttggagtggtatgcatggtgtgagctcattctggtaaactaatgataatatagtgataatatgtggagatatatatatatatgtatacatacacacacaaatacacacacaagtgctgagaatctgtcaaaagacttcacacttatcaagatgattaaattagaaagaatrgcaggattgtcatctttttccttaagcatttctrtatagttttgtcacagttttgttttgttctgtttttatcttgagacagagtcttgctctgttgcccaggctggagtgcagtggtgcaatcatggctcactgcgagctccgcctcccaggttcacgccattctcctggctcagcctcctgagtatctgggactacaggtaygcaccaccactcccagctaattttttgtatttttagtagagatgggttttcaccgtgttagccaggatggtcttgatctcctgacctcgtgatccgcccaccttggatttgtttagatatctcacttttctctaaattgcagaatattttgaagatcttaaaaatattaagttgagactacagttgtttccatttatccacagtttccctttccattgttttatttatccagttaaccacagtctgaaattgttaaatggaaaattcaagaagtagacaatttgaaagttttaaattgccctccataccaagtagaggccttggcctcccaaagtgctgggattacaggcgtgagccacttcacccggcctgtcacaaatatttttattccaaagtgtttcagatgatccakaatgcagctgttataactgcatcatgggtcaaagacagcttcttggatgaggcggccaactttcaaagttagcaaggatctgacacattttcacctcggtaaccacatcatagattagtcaagttttcctgcactcagtactcctgaaatgtactgctgctttccccttgctcaccattatcagtgtggtcacttcactgcttgcsaaggattccatctaattctgaggaaaaggaacataattgcaaatcattgtgttttctgtgtgggagcttctgagtaaagcagcaatgacaggagattgaagcattggattaagaataatcctgcggggtggagagagagtgatcctagtattctctatggatttcattttccctttataaacctacttcccatgatcagcagtaactgtgacttcaccgcaacgtataaaatgagcaaaccctttcctcaggatggtttcttttctcatggacccttcatgatgtatcctttttccatctgccaatgccatgagaagagaaaatagaagctactttatttcctgtctttagcaaagacatatctcagaaaaggtgaaaatgactattctcacattgccgtattctgacaggcaaccaaagataccactttaaattccttttccagatgttatttcatttcagaaatatatttgcagtttatggggtaattttgaagtaccgtcagtctaaatagatttttttccctcaaggataaacataatcatgtattttctgcattattacttttgtaatgggaggaaaggcaagctgggttacatttatttggggccattcccctcaagctgtgacaccttacatagaatcctaaccttcctggacctaacctcttgccttcatgcagctcaaatagctrccttcctagacagtgcagatgtttcaggaagctttgaaggacagagaaaatgataaaatctcattgtagttttgtgttgatttagtatatgggggttttagcatcgcttcatgttatgtttttattttctataattggctgyccatggtttttgctgtaggacttggtgaatataagcaaaatgtctggagccacactatctggatttgaatactggctctgtcccttctaagctgtgtgaccttgggcaagttacttcacctctctgtgtctcaggttcctggtgataaaatggagatggtaacagaacctacattatggtttctgtttgcatggtggatctctcttggattctatttcatatactaattagccatgtgagaaaagaaaatagatgctaatttattttctgtctttatgaggttaaagattgagtaaatgtaatgtttgtcatataagtgttaattaagttttcaacataatttgaactcttgtcttggctttttcctaattggtaaattaggggattaagctctttgtgttatcacatcttacctgtatattcccagtttgttacttgtcacttgacattacttgtttttttccacatggatttatggagtctcatttattaatgttcctttctcttatggcttctgaattttgaatcattgctacaaaagccttttccactataaagttaaatgtttcctcccattacttttatggttttgttttataaatttaagtctttgggccatttagaaattaacacgtgatctaattttatctttttctgcatggcaacctattgtcccagcatcatttgtttccccatagacttcatataccacctttgccatctactgcattccatgtgtatttaggtgtttattgactgtttctactgatctgtctagtcgttcaccacagcatacttttaattaaggatttttttattgtctctgatttagtactttctcttttttttttttaacttccctgaccattttcacttgcttgtgagtttcaaaactcagcctctaatttcccaaaaactactatacttggaattgcatgtaacttcatgtatctactttctagaccttttgactggcatactttttgcactttttttggtcttattttttacttctttttttatgarcracctcaaattctatatggaatgaagtgaatgtatacaagcaaatgtaactacataaaatctaagcacttaggttgaaaaaatagcatgctcatttaggtccaagaggaatgacagcaaaatatattttcctatgatacygtatcttctggaaaaaaaatgcttgaaaaaataaatcaactgagtaaaccagactcaaaaccagatggtgttctgtcagcctttacactggaggacattcccagccccacagcctgaaacaaactatctgaggaatccacttgagattgtctctcctgggaccctccaggtttatgcccaactccttyatacggctattagtcagcctaagaagtacatgtcagagactattcaggcaaccaggacagaaagggctttgggttacctgtcctcacttccacttctgggagatcatatggtaagttagcatctaccagaatacaaayggaaacttgaattagtccaagtctcctttggtttctctatcttttcactttctctcctagggggaagaagtgaaattgcctccatttgttgtatctttattkttgttcctgccatacttcatttccctccccagaggtccagagagagatccaggcactgccccagcctgcagctgagtggcttggcatccaggaacagagatgttcatagccatgttgagagaaagtgctactgtctctagagtatggcagtgctggagagctgtcaagtgtcaagtggccatctatgcttgtcactaccctgaaacaaaggatccgcagggccaccacttggcccaccccttctcttgtccctgagtrcagtgacccttcccctcctctgcccacagatgcaagagaatttagggacatctccttgcctggccagttgtctcatacttagaagcacaatacggtaaaatatcacgaaaacctctgctcttgaaagacatgtcctcggttgtccttcgggacattaacccatggataagaagtcatttaatgacccaggcagctgagagcctgccagagtggcagctgacttctctctgcatggcagacttcagcctcatctttgggaaaacatgctcaataaaacagcacttagcacagcatagatgatccatggccactggaaactggtgagaataattaagaaacgatcaggtcataagaaagaaagaggtgccttctttttttttcttttttatttgagacagagtctccctctgtcacccaggctggagtgcagtggcaccattttggctcaccgcaacctctgcctcccaggatcaagtgattctcctgcctcagcctcctgagtagctgggattacaggtgccygccaccacacccagctaatttttctatttttattggagacggggtttcaccatgttagtcaggctagtctcgatctcctgacctcaggagatccgcctgcctcggcctcccaaagtgcagggattataggtgtgagcyaccatgcccggtcagaagtgcttcattttttgttagtctgttgatttggcctggcttatggactatgaatttctttattcttttgctaaatattctttctaagargaagagaagggacagggtacttgtgttgcttctggctatttaaagcagaggaataacatctgcatgctgccccttcatgcccaccctctgcccttgggctgcgtcaggatcctgtatgctcttgaggcttccactctctccagatcagtcttttctgggytaagagataggaatcgtcaccatgcaaggagctaaggtggatcttctgatcagtttattgtcaccagcatcctctgtgtcctagtatcctactccttcattggcctaaccaaaacccaacctggatggctctgacaaaccagcctttacagttgctacactcaagtaactcagacctgctggagaaaattttactctgcgaattgggcacaccacctatctgtggtttttaacctcagctagatcctcttgttcattgctatcagtcctttaatttgttcttggattttttttttgtttttgatacagggtctcactctgtcacctaggctggagtgcaggggtgtgatcatggctcactgcagcctcagcctcccatgctcaagcgatcctcccacctcagccttctgagtagctgggaatataggtgcatgtcaccacacctggctaatttttgtattttttgtaaagatgggctttcaatgtgttgcccaggctgatcttgaactcctggctcaagcaatcttcccacttcagcctttcaaagtgttgggataacaggcatgagccactgtgccaggtagtggattttttcagatttttctgtttaggtcctttttacagcctttgattgccactgtctaaggcagataatcatgtcccattcttccccaagaaaagaccatcatgcacaattgtttttttctactcscatcttccaattgtacccctgatcttctgtacttcctgtctctacctcctgtccttcccaagaatttgatttctctccatctctctccaacttatgttaatttccccaagattttacccttgctttttctattttgtcacctttcattcatgtcgcaaagcaacattggctgcagcctccttcccttttattgttcttgtcaaggtcaccaagcccttctgcatttccagttgaatccgaaagactatttctatttcaacaattcattcaggtaatacacaaatacattctcaacatgaaagaaacagctcaggactatagagaatacaaagtgaagttatccttcatccctctctgcctctctggatcagcagccacagctcttgtgttaaccttgaactgtgctgttcctccccaatacagagcataggcaggagaggagcactgccaagcaaagctccctcagatttcagcccttggagaatgccccttaattcccatccatgtgtatatccttttatcctgcatttcatgcagtttcctyaaaaccctgctgacatttgctgcagtttcttatatttgtttttgtcctttcttcaagttctgtttccctctaaaccagatcccatctgctgtcttccagaaattcttccatcatttaaaaaacactaataaaatgacattttcttttcagtaattctgatttttttcttctaattcttttgtatcattaaatagaattttaggggtgaggcagtgtaaacttgtgctcagatactatcttgatccacaaaaacagaatcatatgtgtatacatacacatatatgcacatactcatctactgttactctttaatgcaattgtttgattctgtggactgatttcttcacatctgtcttcttcctcagctccttcccactccctagatcttcttcctctgtggcttttgcagactccttttctcctcttccttaaatggtaatattctccagagacccattctctaccttctcattttttattcttgcttctgctgggtccttttcttttcgtgggttcagctattagaacactgacaaactgcttaataatccacatcccagcatgaagtgcttcccagggcttcaacccccggcatccaagtaccctgtggctgcttatagccagaagtcccccacacttctcaggtgaaaagctctactcattgtctacctgtttctcctgaaggctgtcttagcatctgccatcaacatctactcagcccattagactcacagaattcctctcctcctcctaagctccacatgcaagcagttgagtggttcttttgtttttacttgctcactgtttcctagatcagttttctcctcccagtcagccctcatcatctctctctggtgctaatgcaaacatttccctgtccacagggttgttgctctcattctctaccttgccactgaagtgagccatatgaaacaggtttaactaaattgctctcctgactgaaactcttgagtgtctctcttgccccataaagtacggatccttaaatgaaaggcataaagtccccataaatatggacctggtccatacctctatttcatctcttactgtatattgcctcatcttttattctccagctgcaataaatttcccatcattctcatgtcatttcactcccacactttcaktttttaatcttctgcttgaaaagccttctcatcctcttgcctagctgccttctacttttctactttcctatgattttggcatcacctcttccaggaagccttcacatttccccttccctctataaatgaggtacttgccctgctttgattcttccaaaacccctccatatctctatattttcacatattcgattataatcattagtttattcccctactaggtcacaaattttcagagtgcaaggaatggaaagcaaarcagaaaatgtacttcatcttgagtacaaactatgtaatagaaaatgcctatccaggtacacctgcatataaaaattaatttctggagtctgactctgcaagcactttgaaaaaaatttgtttccttgtgcccttggtttcaaaagttttagattgctttccccatatagtactttaaatgaaagcctaacctttatataagaataaactacttttgtttgtctacttaatatcactgtgttgtaattatgaaggcctagttagtaaggtctgcttaaaaaaagagctgttgagctgttgagctgttgatttattttgaatttctccccaatcaagttggtgagctttcgtttcagattttgagatttctttggaaagcgtgcaagaatcgttctcatctaagccgagttctgccgtattggaatacacatatcatctcagggcagtttttttgttctttaaattggatgcttttggaaaatatatataagaargggtacagtatagcttctagaggcctcatgggtctcatcataacagctactcattagtggagtccccacattccacagtctaggcatcaacttgtaagtttagatatactatgttttccccttcatccagagatgattgcactctgggaagttggcttatatgactcaaattccaataagctcacttatttaaaatgaatgtaataggaacccattttcctggatccattcacctgcagggacacaccttcctgataagagaatcttctcagctggtcatattaaatggcaatgcaaagttagtaagggtccacagtggataagggactatacaagcatgtgggggacacagtgaggattcagtgaacataaagcatctagcaaaagagtttgacagatatattctcacgaacttttgttaaaaatatgaatcaaggacaggcacggtggctcacgcctgtaatcccagcactttgggaggccgaggcggatggatcacaaggtcaggagatcgagaccatcctggctaacacagtgaaacccagtctctactaaaaataaaaaaaaaagaaaattagtagggcgtggtggcaggcgcttgtagtcccagctactcaggaggctgaggcagaagaatggcgtgaacccgggaggcggagcttgcagtgagctgagattgcgccactgcactccagcctgtgcgacagagcaagactctgtctcaaaaaaaaaaaaaaaaaaaaawatatatatatatatatatatgaatcaaaatacaagcacacagcaaatgccttacaattgaatgaagaaactgctaattctgagaaagcagaatctgccattataawaaaaatgcagagaactctggcaaaaattggggatcagagatggttgtgtcaagagggagatgcttgagttgaaccttgaaggatgggcagaatttcaacagtagaaatggagaataggccagaactttcaaagaagatagaataatatggaagaaagatgttatgatatggctcgataagcaacagattgagatatatgaactaagatgttctttaaaggatatttttataactctataacattgatgaatcaccattttccactgtagggatatttgtgattagataagcaagatcagttttctaaaatcagaatgtcttctcccctggaaagaatgctgaagactttttagctgttgaactcatctttttcagtatctcttgtcaatcatcaaaattgtctgttataacatatattactattacagttccaaaattagcacctgctttctctagttgtgctgtgggtatttgttttggattacttttggagagccactttggagtcctggatgaacagggagctatgtttttaatcggaaacattttcaaaacctttcttctgaagagtcatttctaggaagatttctgtaggtgaacattttcatccattttatgatgatcctccttggctctcatttcataaggcagcatttttctgacctttcctcacactctagggccctgtttaagggtctataatagcttttgttttaaccaggaggagctgagaaacatgaagtatggtggcactttaaaaagtgatgtcttcaaagtcaattatctactgtcttttaaaattaattttaattattaataactgatttcatgagttagaaccattagctatggtgagatgtaaagatgaacaaaacctttttgctcaatttatattagcctgtgtcaataagaacctttagggtaacaatcatgaatgcttgccattctccactttttaaaaggtctttaaaaatgggaattgatttttctcctaccattccctattttatgtgggggtagattcatgattccttttcacatttgaaagtttttaaaatcccagatgaacaactataaaggtttacatgactgactacatttgtaggctatattcccataattaatacattgtgcaattaattcccactcgacatattattcaaggaaaccactcaggctatacatttaataaagaacttttggacatgacccagttgctacagaaatcaaaggtctgtctactcaggggtgttctttatttttctaatagrccaattaatccatctttctatgataagggtaattttgtattaaagttgtttcatttgagagaagatgttcaatcctgtctggaataaagagagttgatcctcatttattggctgtgcttcaagcactgtggttttaagtctactatttccaccttaggcacaggcttctgaattccccaaccacacacctgtggcttcttcactcaaaggaaacgaggttccttttgtgtttctcagctacactaactctccaacacatttcctataccagtcctcaacagttctactatggctccaaccattctgttcaggcatcaggattcctaatgtttatggagccattttgtgttagatgccagtgatggcaagacaccaaccttgcccttccattgtttgcatctgtttaaacagacatgcttcctagatacaatgcaagacagtatctgtctattggtttctctctgaaaaccatgcatcagtgttcctgacttacatgggagaamacaaatatgtgtacatatatttaaccataaataggaactcaattatattgggtgaaggaatgactgaataagtgagaagagaagggagggaaaaagaaacaaaagagggatagagaaatagaaggaagaaacatggtcccctaagaggcccttgtggtttttccctgatagcaaagtcatttttacactaggatgccagcctgtgttcgcctttttacactcgggaccttacttggcgaagtatagcaaatgagtttagatgatcatccccatagtagctttttcagtattttcagatttgatgtctgtttccatggaaatagttttggcaagaccgaagctaagaataagagacataccatgagaatttcacgttccaattgtcaggcaaaagctgaaagtcacacttttgtcttttcaataacttggtgctttaaactcagcaggagagagttttattaattccagcaagaaatattttcattatattaatgaggtttcatttctgactgtttacatttctcataaaagtgaaagcaattatgggaacagtgttaatagggaattttcctcaggggaatgaacttcttttagattctgattatggccttcagaactcctcccctctagccctttcctcactgaactgccttagccagcacttgctcacctgcctatttttgcggacatttgaatgaaagacaagaatatgactgaactgtgaaagtgaaatgtttctgaacatccagagtaaccattctcagacaagtttgaaagtaaattggaaatcatcattctcagtaaactatcgcaaggacaaaaaaccaaacaccgcatattctcactcataggtgggaattgaacaatgagaacacatggacacaggaaggggaacatcacactctggggactgttgtggggtagggggagggggtaggggaatagcattaggggatacaccctaatgtaaatgacgagttaatgggtgcagcacaccaacatggcacatgtatacatatgtaactaaccggcacattgtgcacatataccctaaaacttaaagtataataataataataataataataataataataataataataaattttatattacagttgggaataatgttttggatatactgtgttaaataaaatgtattatcacaattaaaaaaagaaatttgaaatttaaagattcgctttgaacctatttgatcagaaagtattaaatatcactaccacatgagttaaaacaaaaaatggaataaaaaacaaaagtggtgtctatgtaatcagtgaattacttgataggacattttaactattttacagttcttcttagcaccagaataaactggttccaaggttaaaaaaaaaaaagaaagtaaaatagatgcaaaaataatcactcataactgaagatcatttcacytttgaatgagaatttgtctctgaaggctaacttttctaggcaaagtcaggaaacaatggcagtggccrggtgcggtggctcacgcccagctactgaggcagaagaatcacttgaaccgggaggcggaggtttcagtgagctgagatcacgccattgcactccagcctgggcaacaagagcaaaactccatctcaaaataataataataataattactgggaaatacatattctcagggcccattcccagagaatctgagtaggaactaatgggaagtccaaaaattgggacactctgagaagcactgcctacactatcartttaggattggagcagacttttaacatctactcatgaattatactgcatgtacacttttttaaatttcrgggcttttgtatatagagatgcaaggtattaaactaacagagacacaaggtattaaaccaatgttttcatgtgtcctttttgcacgtacacttgttaatgttagcacttccattagtagtatacagagtggtcaaataaacagacataacaaatcataactaattgtagtccaatttagacrtaacaaatctatataataaaatagtatataattgatacaactctagaataaagagaagctagcctgaaactccaaagttattttgcataataattactaattgagatgcaaagtattaaactaatgttttcatatatcctttttgcacatacgcttgttaatattancacttccatttgtaatatacagagtggtcaaataaaccatgcaatacagcatgctagattttataacctctcaaggacaggggctatgtcttatttgtctttgagttcctcaccactagcaaaacaggtgcttaataagtgctagaactggccattgataaccaattctgatttccttaagctggtgcatatcactttgattcttataattttctctcacattatctttgatttaaagtctacatttaagtgtagttttcattccaaattggtcagagtaaaaaagtaccttctcatatttgaaagaacaccatggtattgtaaagatatcactgtccattaataagatatttgtcggaatttaaagaggaaaaataaaagatacgactaaagtaatttccctggcactcttctgaaatagttcagaaaatcatgtcttatgcaggatatgtctagaattaaattacattttgataattctttccagctctataattccatttyctactgttgggtttcaacacctaaaattgtcagcaagcctctgaacaaagatgcttttgttctgttggcagagattctacttctaagtttccacatgacccgcagagccatactcakccagttaggtgtcaaaaatgcagggaaagatactgaaacctcttactggcctgaccaatgcatgcagcgttatctgcaactcatgtctctgtgtgcctacctggagagtttactaacactttgtaattatttgaaattgggttggttcttggtgtaataaactaagtcatagaccctattgaaagagtaatgctaaataatgtattttctgaattgcttgtttattttctttttccactatggatgagtatagggtagaaaactgattagttagcagcctgatcagtggttcagcagcctgtaatagtttggcaataaaattagaccaaaagagaactgatggaccaaaagaggttgtttttcaatccagcctcttgcttcaagtagaattgaataatcataaaaggaggcaatattttcattactgatttcactttttcaggtcaaaactgacccactgaatttatggatttggaatagctttttcacaaggatggaataagaaatctgaatcaggttgcactgataagttgaagtaattctcacaatgtcaaagagataatgggttcagttaattcagtacaagtaaacagcaataagctagcatccttttgaagttatgtcttccagcaccaagctcatgcaggcacgtgtctatattacatggtaatgtggagtttgaggatagatgagaagttgctctggcataatggaatgagcagagtattaagacaggcaagcttggctactgtctggcttttgtcagcacatgggctgtatacctcagttttttcctttgttaaaagaacttggactactgaattcctaagctaatttcaaactatataatcttagttatatatatattgaatcttgaaatattggagttaaataagaatatttagtgagatcccaagcaaaactcattgtggaatttctttagcttttaacttcttcaaatccctggcttagctctaatgtcactaatcatagcccaatttagacataacaaatctgcatagtaaaacagtatatgatggatacaactctagagtaaagagaagctagcctgaatctccaaagttattttgcacaatagataattactaatagagatgcaaggtattaaaccaatgttttcatgtatccttttttctaaaaacctgaattaacaataaagcaacagtagtagaaatgttttaatcctagcacaactgttttcatattttgtctgccacatacaatgtatcttagcaaagttgcaataatgtaatatactgttttatattctgatcctttcacataacattgtattgtcaatttgtttttctacatgggctttataatgactttaatacctgcaagttattctctcatattggtataccacaatctgttaactattcttccaattctgtttctagtcttgaccattacaaataaagtagcatgttcaagacagtagtttagcatttgatctgatttattttattctatccctacagtagtctatatctgtccttttagtttcaattgcctgtaattatctcaggtatgtttacttagaccccaataatttcttcactttcttgttttaaaaaatccattatatatatttgaccagtttagaattcatatttttaaaagtcacaaaggcatgtactttatgcagtaaaatatataatagagaatttgccattttaaccatttctaagtgtaatgatttagtggcataaattacattcacaatcttgtgctaccatcaccactatctatttccaaattttttcgccttcacaaacaaattctgtaaccattaagcartaactccccactccttccaacccaactccctggtaacctctaatctgctgtctcttaattcatctgttccagatattttatacaagtgcaattatacaacatttattctctttctgtctggcttatttcacttagcatactgttttcagggtctgtagtatagyacatatcagaacttcattttytatggctgaataatatttcattatatatatatgtacctcattttattcattcatctgttgatggatatgtggatttctgcttttgactattctgaataatgttacaattcagagcattggcatattaataacctgtttttaattctttggggaatatacctaggagtggaattactgggtcatatgatagttctatctttaactttttgatgaactatcaaactgtcttctacagcatctgtgtgattttacacttccgccatcaacgtacaagggttctgatttctccaagtcctcaacaatattttccttgtgtttgttatagccatcatagtatgtgagaagtggttatctcattgtgattctgatttgcatttccctaatgactactgacgttgatcatttcatatgtttattggtcatttgtaatgtcttctttgaagaaatccctattcaaattctttgcccaatttttaattgggctgttttatctgtttgttgagttttagaaattctttatgttctggacattaaacccttatcaaatataggacttgcaaatattttttctcattctgtaggttgtcttttcactgtcttggtaacatactttgatgcacaaaggtttttaataatgacgaagtccggtttatctatttttctgtttttgtttgtgcttttggtgacgtatctacttcaatcactttgtatttctctaatataatttccctttttagtctcttcagattctgtaaagctactttatcaccataagtccagtcactgtttgcttgcttattatttaataatatatctgggaattttaaaagattttcatgaagttttatttttctaacacttcttaataagaatattttaatacatattgaatttgtgtgccaatagtggcagtaaataacttttttgttccacatttagaaataacattatataagcagctggtgaatatagaatatagtttatagagcacatttagatgcttcaaggatgaaaaactgccctagacttcctttgggaattgcccaaggacaaataatggaaatgctgcatacaggataaaatagaaactcagttgaacatagggaatttcatatatacccccgtgagtaggttctttcaaataactatatttaatagtaaaaatgatatatctgtaagagtgctaattccctaattttgaagaaaaaaaatttagcaatgatattttggggaaatattagacacaagtaatacacagttccttgagttggagttttcttttggtcgtatgaatgaccccctcaaatctatgaacttctgaatagttttacttgttcttggcaattgcctttatcctcaacaaccttgtgcaaatgttaaatctcaataccaagctgtcagagcttagctttccacttcatcttaagactgcatttccagccatatagctgccttcagtaattccattcagcttgactctctgacccagctctggcagctttgcacatccagggatgctgagctttcagattatttaaatgttatgtgcttcctgaagtctgacctttctagggaaaaggtattcctatcgcttcagaaagatggaaagaaaaatgtttaaaaatagagaacttccattagtggtcaattaaattcacaatattatctagatttccagttgcctaaggaaaccagctacttaactgtctctttgcagtggtgctgggacaattgatgaaccattctattttccactttacaatgtgggtactttgtgcttcactcaggacaaaaagttcacttagttctctttaaaaaaatctctatctcaaatcatagatgtcaagacttaaaggcaggttttggattttattctagttgcaggctaacacattatcttgctgcaagacatgagactcttggatcagagattcactacaatagccagagtatcgccactttcttgcagtagttgcacaagtcccagttttcacagggtgatgtaaagagggccatatggcaactacagacacagtggattgtatacaggaaagaaaaccgagcttaacaaacccaaatcttcataatgagcaggaaacaaacctgacctttgctccagatggagacactatctccatcttgaaagattattcactattcraaaatccttcaagagatgttctggagaaattagcaactcagattcccatgcagaattggctaacagttttatatattacatacacatatgyaccaagstatctcataatattgctacaaattcatagtaaacagtggaacaagacagattcaaattgaaaatgatccctttcctgagatgcttttaacttgtcaagktatttggataaccttcattttccatgatgaaggaaatcagtcagcgtcagcctttaaatgtaagtaagtatttggcacctagcacatagtaggcattttaagggtaacttatctctaggtgagggtcatcaaccagtttttattttcaggtttctctgtcttatgtctggacttaaacttggacggttcttcacagataggtacttgccttatttcctcaagcttttgcccaaatgtctatttctcagtgaggcttatcctgattcccccacaaaaaccatgttgtctcccatctattccccatccagtttaccaagctttatctatctccctcacttatcactttttgagacagagtttcactcttgtcacccaggctggagtgcagtggcgcaatctcgactcactgcaacctctgcctcccaggtcaagcgattctcctgcctcagctgcccaagtaactgggattacaggcgcccaccaccacacccagctaatctttgtatttttagtagagaatatgtttcaccaggttggccaggctggtctcgaactcctgacctcaggtgatccacccaccttggcctcccaaagttctgggattactggcatgagccaccgtacctggcctacttattaccttctgatgtgttatgtaaagcatttattatgtttattttcagttcctcttgctgaaaatgtaaattccatgagggtagaagtttttagtctagttcactgatgactccccagttcctaacacagtacctaactcaatatttgttaaatgaatgggaatgagaaaagtaagtttcaaagagactaagtacctagtcagaatttcataattaacaaggcaagtctgggactcaaagccaggtcttgtgacttcaagtgcattactgtttacactgtgcaccatttacattcctcagctgctctctcccctraggcctgagttgattgcacagcccctcaggcagtacaggatagctctgcagagtggctgacagaccctaggacaggaagcaggcagagaagggaggaaccacgaggccaggctgaggctgaagggcgagtcagctttctcggtaagcctatcaggaagctgattgcttaatctaactgagtctgtgtgggcctgcctcctgggctaatagcacagatgcattgctccgaaccctataaacaggaattgtcagaagtctaatctctccaagtcaggactgctgatagtaatagacattttaatagggaattttaatctacaaaacaatttatgaaactcacgaattaatcctcttatgattcccaggatgtgagcaagataaagatagtagaacttgaaaataatgaaatatgtgaaaaatacagcaagaagtctcatgagatggctggagagaacccagaaaagcttacctcgtctcaagcacccaaatsttcccatcactgccaacaacatctaggaccacttcaactctagtatctgtacatcttccaatcagtgataaatgctgatcagtatcctacacaggagatttctctccaaatagcgcaagccttgtaatatttaagtaaatgaccccaaaaatcatcttcccttgaatcatatagttctgtgttgtccaatagagtagccactagtcatatatattgccatttcatttttattttatcaacttaaatttaacattcaactgctctgtcacaccagccrcattttcagtggtcagtacacacatggctggtggctagtacattgggcagtagatatggaacccttccgtcacagaacgttccaatggacattgctgctccaagtacagtccaggtgacccaggactggtttaggtcagcatcttcacctagtagagccagaattgttttgtattgcaggctgttgctaggactgaaggctgaaatctcttatattacttcttttctgttgatgaactttgagtcattgcttcattttgtcctgcctttctaggcatgtaatattttattttttgtcatgtactcactgaccttaaatccctaacagctcagcctctttcctccctatcacttgcagtctttctcagctagctgacacatgacttttaagacaatctacttgctgttatcacattatttgagataycataaaattaatcctctaatttaaattaaagctgcagaccattatcagtgataataccaggaagtgagtgaggaagggtggcaaaacatgttctagggtgattcaccaagatccggaggaaggagaatcagtgttgacatgaatggttaacccataggcagtaaagctaatgttaacatctgctcgggttttagggacatagtttaagagcacgtgaaatatatctaaaatcaatatgaggttaggttgggtaaatttaaagacaaaatcatcttccarcctaaaaaaaacctctttacaaatatagtagagaaagaaagcagctttattattgaataaacgctaaactagaatatgatacacatagagggaatccactgagggattgcaaagacraatctcactcttttatacagccaaacagatgcatcctattacataggcattctctagataaactagctagtcctcacataaggacttgacagcaccatgtgcctcacatagttcatcctaaatatacctggtaattggggtgaacatctgtgttagctaattagtgtcttataaagggaaaaacaaacttctcatatcttaatgacaagaagtagttttgcaagttggaggargaggatcctcggaagtttaggctcctaccttcttaccgaagccgcaagatagaagtgttgtctcctttacgtcagagagatggctccttggtcctagaaaatgacactcctggcttgtaagacctgcgagggccttttaaaatatttttcatctcaaagagccraagaaagaatttataattacaaggrttttatgaacttttaagttcaggggtacctgtgcaggtttgtcacgtaggtaaacttgtgtcatggcacaagtttgttgtacagattatttcatcacccaggtattaagcatagtacccattatttatttttcctgatcgtctaacttcctcccaggccccaccctccaacaggccctagttgtgtgttgttcccctatgtgtccatgtgttctcatcatttagctcccacttatatgtgagaacatgtgtatagtttagttttgctaaggataatggcctccaggctccatccatgtccctgcaaaggacatgatctcatttttatgactgcatagtattctatggtatatatgtaccacattttctttatccagtctatcagtgatggatatttatgttgattccatgtctttgctattgtgaatagtgctgcaatgaatatatgtgtgcatgtgtctttataacagaataatttatattcctttgggtatatattcagtaatgggattgctgggtcaaatgatatttctgcctctagatctttgaggaaccaccacactgtcttccacaatggttgaactaatttacactcccaccgacagtatataagtgttcctttttctccacaaccttgccagcgtgttatttacttcctaataatcaccattctgactggcatgagatggtatctcattgtggttttgattttcaaatgatcagtgatgttgagcttttttcatatgactgtctttttytttttttttttcttttttttttttttttcattttgagggagtctcactctggtgcccaggctggagtgcagtggcagcttacttcatagctcacggcagccttgaactcctgggctcaagcaatcctcctgcctcagccccctaagtagctgggactacaggcacactccaccacgctcagctaatttttgtactttttgtagagatgaggcgctgctatgttgcccagagtggtcttgaactcctggrctcaagcaatccttccacctcagccttccaaagtgctgaaatttataggtatgagccaccacaccgggccaattacaagttgacaaaggaaaatgctctaagaaaagataacttttgttcttattccctttttattttttaagcatcagagctatcaaactgcattctcttatttttaaaagtgagagttaagccttttatttttcatgtataattgcccttatagtcttcataagaaattaagagttttgtataaccatttatactttcaccttatttgactaattttgactaattgttgagaaaataagtctgaattaaagagtcamaattgcagtttatttcagagaaatttttattctccratgcacatggtaactagtgttataccagaaagaatggtaactagtgttataccagaaagaatatcagcgagtggagctccttgaggtatcttgaggattaaattgaaatgttttacaattagtgatttaagtcatttacacagaaatgactgtcaagtgcctgaagagtctaagcattttaattatccccctataattttatacctttgtagaacaaataccattttataggtagtgcaaatatagtatctttctacatgttctgacaatagtggcattcaaataaggttttattatatgaaccagacatattacaagctatctattaccaactagagggcacttctagagttacctgacccaacataagttataagttgtctcaaatagttcacttagcggaagccactaacaaatgtgatctcccgagtggccagccagttttggttttcctgtttctcttttctatttctggagtttcttatgcggggcaaggggctctatgttccccaaagtcaccttttatctatcccaaaatggattatacaatacatttccccctggctaactttttctgtttttgttttattaaccttgatagcaaaatataacagattccctaatacattcatttccatagaacaggcccatatgttacacagttcttacctttgcactcctggattgtgatacctaccacacagtaggcccttagttatggatgtgatgcatataaaaacattttaaaaggaattacttgctttgagcctatctcctctaatgtacaatatacttaagctgattggttcaaaaccacatatgcatttcctatatgctgtgtactgactgttaggcttaagtacacttacagaagttacagtaacttaattataatagatctggcaaggaacttactcatatctcgttctctgttttacaaacttggacagtggttattgaggtccacagctaatttgttatgtaagaaattaacaggatcctggaccactgacccagaaagtaaaggacaggcaataatagcaagacagaatctatttctatcttatagacaaacaaggaggttatctccatgtgcatccaatattcctcattatctagggttcttttgccatatagagaggcatgaggaaaccaaaactgacttcagtttgggagtttttaatccatgaagttttggcaataaatactagttaagccacagaagggccctcctcttggaaattgtaagataggtaaaaatgatctcttccaactcttaggagtgcctttttccctctcccaaacactaattgctctgaaataatccactcctcaaaacttttgtcctgacagaatctctatttaggcaaaggtattagttgataagcctaacaggttctcagttattgcctcttcggaagtgtttgcattttaaacagaagccagtaagttcaaaatgcttgatagatccaaacagacaaatctttgatgggaaaaccaggaaggtgagggagacaatctaagaacaggcctttccaatgtctcccaaactgtatcccagaagcaactttactcctttgcccacagctggttccactcaaacgaaattgggttggtgtttcttgtagctgggtcatgtctgaaggtaatggaaattaataatggctctgaggataagggaagtaaaatgtttacaatctaaaattatgtgagaagaaagctgctaaccaatgaatttttaggaaaaaaaaagtaaatcacttcttttgcacgtcagcccaagtttacaaatatcaggaatgctaacacaatagaattgtcttatttcttctccttttcttgcctctgagcttttctcctcattcccctctgaatctagctgctttccgtttatgayttcagttcaatttcctaccagctattatgagataactaggaccttttaaagaataaatttgtattttcccacttagtcagctttccattcctgcctacaacaaaaacatctggtgagtctaattttaagtaatcaaccttttcagtttggtgattaagagatatatatctgaatttscatttcatttgtggaaattctgcctgggagccattcatttttcatcaagctccctgtgcttttcattactccctccctctcattttccctgtggtcagcctgcctgagtaagcagctctgtttcactggtctcaagctctgcaatgtaaaaccattagcaaatcttaataatagtaacccatcaaatttcattatttcagtaatggaatctgtcaaggtcagccactgatggctgttaatggccactttgttgataaatcgggggtaactgcaataatattcattttaagcaaataaaatatgttctgattamgaattcattctgcccagttggagtccaattaagccagcttctggatggagtctcacccargatctctccacttaaggaatatattcgcagttgaagtttgacttttttcaataaagctcttctctctccttgaaagagatgaaactttgtcttcaatccaaaagaacataaaggtgattgttctgcaatcctcccttgccacagacctccctaactcctaaccctgacacaaacacgttcacacagacctgcccatctgtttaccctatctgaggctatggttttgctttaatatgaatttaacttgttcatcattagcaatagggatcttttcctatgttactctatgtcattattatggaagtttctatgtattatatagcaacagaaagtagattctgggtttggattagaagtctaggcaggtatgaccttcaaaacatttaccaacctgtacagcacagacaccaaccaacacacacagtcctcagcaccagaactagggcacactgggccaggtattaggccttaagttgtgggttgaggagaattctgagaattcctcgaaaarggcaaatagaagaatgagtaagggctgggggacttccagggctctgagcagaggttattaagtacagaaggactttgaattttaacaaccgacatggccataaaaatgatactggctaaaaagagccttgagaacaggaatcgtgactgttctttagccgtgaacttaattagtatttataggatggtgatgataggccagggcataaagctgccactggctatactcaggtaaaagaagcaggcacaatctttaccttgtatcagtccactcttgcattgccgtaaagaaatacctgaggctgggtaatttataaagaaaagcggtttaatcggctcacggttctgcaggctgtacaggaagcatggtggcttctgsggaggcctcgggaaactttcaatcatggcagaaggggaagcaggcacaaattacatggcccagagcaggaggaaggtgagggaggtgctacacacttgcaaacaaccagatctcctgagaactctctcatgaaacagcactagggggatggtggtaaaccatcagaaaccacccccatgatccagtcacctcccaccagccccacctccacattggagattataatttcacaggagatttgagcagggacacagatccaaaccctatcaaccctgaaggaccttataatcatagtgggaagagagtaatatgtaaataaaaatatacttttaagctgatgaaatggyatggatgacaggacgtagagccatgatagtaataacaggacctgtttggagaaggtgttcagaaaatgcttttctgaccattttcatctcagctgaaacttgaagaatgagaggaatcagccatgtgatagcatcttgaaggcttgggcaaattataggtacttctcttcaacacaagattttagatatctgattatttgggaaagagagatccctgcaaataccaagttatattttggccatttttaacatgttgagtatctgtttctttcaaaagataaagtagttttgcaaacagaactgatttccaagccttaatattgacaaaaagggcaaagtgatgccaaattcttcactgcagatgaaagtaattaaaattgctgttccttgcagggatcaagaattcgaacgtcttagtgactcatgatttttcagtcaattgtgagatcagggtttatggcgcatctgccctgcttttctcagacctgtaccttgccattccacctctgagatgggtagtgcccatctcaccaaatggtccaccatcagccaagccagaactctgaatatcattcttgccatcttcctcacctcccacatttagtccatggctatagctgtcatttctgccacctcggtatccctaaaattcattccttcttcctcaccctctctgttcagccttagtttaggacttgatcttttgacaggcataaaactagattattttaactggtctgatttatttccatttccagttcacactcatgccagtgccagtctaattcctaaaacccaaatatgatcaggtttctcgcctgtctaaaatattatattagctctatctcattccttaggcataaaacatgacaggcaaaacccatcamgaattattccctgccttccatccacagccctctgtactacctgcaattcctcatggcatgtaagtctcatcatcattccccagcttccaagcatttcctgccacaccccctcccactactcttcatccttcaaggcagctcagtactccttcctggaatcccttgccctgagagctgcctgagtgaggggtcgtcagattcaggtacctgttttccaagcagctctgcttggctatactttatgtatatccaaatcagtatgtctaaaactgaatcgtccccttcccaccaaagctttcttctctccaagttctcaagctccacagagaggtaccactctacaaagctaaactcttaaccttcattttcttacttgcacctccacccaatcactaaatcctgctgatgctccctgccactgtcttaggagtcccccacttttgtccccagtggcamtgtttctcatttcccaccttgcttactgcagcagcctctttactggtctagtttccctctaatccacccaccaaacagccaggctgtcatctgaatatttccattctctgcttaaagtcatttagtagcttcttattgccctcagggtagaggtgaatcttctccatatggcttgcaaggcccttcgagatgtggcttctccccacctccccaggttcctctctctggaggatccttacctcatatcaaattactttcagctcttatatgctgtgctttcttgcctccagggcatttatttcatttgtctgaataagcccttcttgtttttgaggcctcactatcactttctacagaaagcctttttgatcagttctcaaattcaagtcaaatgcccctccctacttactatggtctgaatgcatctccccaaaattcacaggtagaaatgtaatcatcaatgtgattatgtatttggaggtgagtcctttgagaggtggttaaatcatgaaggcagagctctcaggaatgagattagagcccttatcaaaggggccctagagagctgccttggcccttccatcctgtgaggatgcagtgagcaggtgccatttatgaaatgggcaaaccgaccctcattagacactgaatctgctggtgctttcatcttggacattccagcyttgagatctgtgggcaatgattttttttttttttttttaagatggagtcttgctctgtcaccaggctggagtgcagtggtatgatctcagctcactgaaacctccgcytctcaggttcaagtgattcttctgcctagcctcctgagtagctgggactgcaggggagcacaatcacccccagctaatttttgtgtttttagtagagacaggatttcaccaagttggccaggatggtctctatctcttgacctcatgatccacccacctcagcctcccaaagtgctgagattacagtcgtgagccaccgcgcccagccagcaatgaatttctattgtttacaagccacctaggctgtggcagttsgttctagcagcctgaatggatgaagatgctagggctccccccagcaccttgcactgccctcatcctcacatggaattatagatgcctcctactcaactgagctgcacaacagggactgttatcgtgcccctgctatcatgtggctgttttggacaagtttgtttagcattctgcctggcacttagtagatattcactaagtatttgccagatgaatggatttgttgtgtaattagataacgataaccctcttaacctaatctgcaaatccttcattaaggactttcatcccaggatagaagtacatacataagagtcatcgtactacatgatacaaatggcccattcagcctagtgtttttttgtattttttttttttaactaagagagttaaagcctactggggaaggatttgctgactttcactgtcatcgtctttaaggtatacccaagacttacatccatttagaagacctgcatcccaagtgtagggatagccaagcctcacattcatttaaaaggctcttcttcaaaaccctgctgcattttctacctcttgaatttcataaacttgcagtgtatgaagaaacactttacatttttctccccacttgctttgttcagaaaaayaaaagtaattaggtttattgaagtgtcattaaaaagataaaacattgtacctaggtatttgcatttatttcaaatcttttctaagtggcatattagtttgattataaatctaygagggattgttttgctttgtattgtaatgaatttttagaaatttaaattgygtactcttacaaaagataggagagcatattgtcagcaasgaagatgtacttsaatcttctccacccactgtccagagcactcttcgttttctaagatcaacatataaccagggatgaagcagggtaagggattgctttattctacctgttctgtcccaaacccacactaggtctctaatcttactattttggaatgtcaaagaacacagcagtcaggaagaaggtgtaagtacaagacaatagtagccagaggagaaagaccatttgctccaacgcccagagctgtttcagacctttggcacccttacttttgcggaccccacccacatcatatgttatacacaatacaccacattaaacataactttatatgccctactatcagctgatctggctagtggacatgttatattttagatatttaagttaaatattaattttgagattgaatttttgggggagcagtacttacttttctcggtcctaaaatttttgtagcaaggtcctcacctgccctgctggccatcccaccttaggccttttttagggagggaaagcttttgggttctgtctccagtttacatgttccctggccacacagaatgaagaatgtcccggaagcataagggaaagccaatgagaaaagcagcctgtgtacccccccagttgagagcaccttccccatccacccacactgaactgggaaagtggaaattgagacagctacccagtgagattgatttatgtctcacacaaagctccacccaccagaaaatatatttgactacatcctgtgaaactgccccttctgaaggtcatagtggttacatatcagccttttcacatgtttcaaccgaaaaactgaaggrgttcccttgagtttgagcaatctatagtatcacttctcctggaaggcagagtgagagaaaagggggtgtactggtttcctagggctactgtaacaaagaacctcaaacttattggcttaaactgacagatttcttgtgtcacagttccggaggtcagaattctgggaatcaaggtattggcaggattggttccttctgacctgtgaaggagaggctgttccatggcctcttcttagctctggggggacattagtcaatttggtgttccctgacttatagttccgtctcccaatctctgccttcatcttcacataatgttatctcagcgtacacatgtccacgtccaaattttttctctttttataagttcagtcgtagtggattagggcccaccctaatgaccttacttaaccttaacttgatcatctacaaaagaatctatttccaaataagatcacattcacagctactggggatcatttgaggggacacagttccaccataacagggtgggtagggatctgtgatttcctggccaaaggcattattctgttgctgtttggaatgctatcaaaatattaattatggtatcacatctctgtgcctaggagtctctgctgacttctgttattggtcgtgtaagatcttacaaccccagggcaactttcagcctcaaaagaactgatgtcagagccagggctggggataatgatattttgttctgatataggctcaaagtcactatttgaagtcctggctataaaaattagttccagcagctttcacctaaagctggcccaagtctgaaatgaaccaaattgcatgagctctattrtgtgcccctcttgtaatataaaaatctaataaaagtaaatagcaaagtctaatagataatcctaacagaggagcaagcactaaggtgtggtagctgaggaacacctaagcttgtgctatttgtaatgctgcttattagakacatcgctgatcctcctgtcaactccagttaatgtttctgtcccattcaagttgaaaatgttcaaattcagctaatgtctatggcatctcctgaaagcccatcactgctgggcacttttccattttattgcatttaatcgtcacaactcagagaggaaacttgttttgttagctaagaatcaaatcctagacttgacactaagtccactgtgctggtcccccygctatttgataatattccaaagcaaaatacccatgctaccgatgactrggaccccccagctcagtcrcttgggctagtttttcctgtagtctttcaggattggaagtagagtggagttgtcaggtcctgttacaaaagtagactaactggaactgtagacttttttctttaaacctaacagaaggaaaagattggtgaatcaaaaactagcataaaaactgcaaaaaacctctgggaaaatagacggtcatgaagtccatatatgggaaagaaatgtagcccagaaatttctaggcatatgaaaagcacaactgtaaaactaagatgttttagatggaggagagctgagagtgacagctgagagtcgtagatgctgccttggaagagtgtccacgctaccctggacaggggcctgcctgcccacccagtgaccatggcagggcagagaaaaagcaaygtcagcccagtatcttctccagccagtggggtggcttcaggagagggctgggactggggatctcaaccttagcagcacattagaatcatctggggaggtttaaaacagcctgatrcacttggcctcacctggaatgcacaaaatcagaatctctatggattcaaytcactatcagtatttaaggctgccaggtgattccagtgtgctgccaacaaccactgagagcacacagcaagggaagagagcaacctgctggcttctgagctctttctcctcccmgcccaagggttaggggattgggagtcagagaagtggcccaggcagatgagtatggaggtgtccagcaagatgtggacagatggaggatctgggagcccacatttcaatgctagaggccatctgccctaaggtccaccttccccttcttcctaatcaagatcaccaggwggcgcacaggctgtaaccccttctcctggtgtacgatattaatcacggcatcttatatcccctgaaggggatataaagtcacaagaaaaaatttctaggcatatgagaagcacaaactctataagatactgacaacaagcagaccaacttttacctaacaattcagaataatgcactatattaaggagaaaaagaaaaatcagataagaattaccaggaactttataggaaaaaaaaaaaaccctagaactattataggacagacaagacctaagtagataaaaatataacatgttcaarttattgagataacttacctttgttaactgtagaactaaggtgttcrttttccaccagattatctacagtttcaacagttttaatccaaaagttaaaattttttgaggagcatgactaagtgattttaaaatgtttatgggaaaacaaaagttcattacacccatagcttgtatgtggacaggccaaggaaagaaatcagggcttctgtctcccagtctggtgctaatttcaccccacctgtctacagccgtgaactgcattttaacagcacataaagaaatatactgcatgcaatgccgctcctcatatcatagaacaattaycttaatcataggaaagcttagaagttaacacatcagtctgaatggcatcatagctcatcgtttgtccctttgacaaagaacttttgtagcgaatgccactccaaacacacaggggctaaggcaaggctgttaccgcagtgggaagagggtagcactctgtgtaagcagacgtggccagcccagccgagagagcccccctttgctgactacctccaagaacgtggacacctacagtgccgcccaagcgccagagcgagtcccggcaatgtgtgccagctccttagtgctgctgtagcaatgactacaaactgaaatgacacctctgctgttggcttaaaacaacacaaatttattacttacagttttggaagtgaaaagtccaaagttggtctcaccaggccaaaaccaaggtgtcagtagggctgcgttctttctggaggcactagggaaaaaataygtcactggcccctccagcttctagaaaccacctacactccttggcccacggtccttttcctgttatcttccaaggtagccagtacagattgaatcctgctcttattgaatcactttgacccaacacaccttcctccctcttccacttttaaggaaatctgtgattacattgggcccacctggataatccagggcactctaattatttccagctcagctgattgacatctttaattcccatctgcaactttagtttatccttgccatataacacaacatattcacagcatccaggagttaggcgtaggcatctttggggaccattattctgctgattacaaaatgcatcagattcaaacatttagcaggctagagctaacaccttccttattactatcacaaaatgtagaaaagcggtgaatatatcatcgggaagtttgcagcttatttggctggatccacaactgcctttcatgcccagaatgttgctaaaaggagagtctctctcccagttactctacatccatcctgcccttgtaaagccacctggaaaactgaagcaatttttcagaaatccctgtttccattatataaatattccgtgcgaaagtgttcttttggtctgacttattctaataaatgctcccatttaacatgcatatgtgtaatccagcaaattaacttctccacaggatattaaagttagtgtgttttgtgctgtatgtatctgtgcatgtactatgtttgaaccagaatatacaatgtatcaaggagctcattctttatctttttcctgcattttcttataaactatttggctgattagatttttactgtgacttttgtttcttatgtcttttaaaattagaaattactgccatattctctagaaaagtactatccagaagaaatagaactatgaagatatgaaactggttttactaggaaacacacatatacacagacacatacacacaagacatagtgtttgtacacccaggctcagtgattcagaatcttttttgtgttgcagagtattgggataattacctctttcctgaaaaatgtacgtagtcacatgaacatgaacttttgcactccttttcaaagggtttctgccccatcctcacccccaccccagaaatcatctataggttaatttggaggaaaaacattcaacatcagcacaggtacgggacaccaattagctgggaaccatggaaagaaaataagcattgtaagaaatagcagagaaaattgtaatttcaaaaaatgttgatcttggcattgtgcattaaagacttgcagtaaaacataactgstccttagcattaagttcttaaaagatggtttctatagccagtcttcccatagatagcatgtaaatggctctaaatgagaaacgtatagcccctgcaacacaagcacagataaaaggaggcctgtccccacaraaagatttcataggtaggacactgcatgaattccaggctccggatctaagagccagccttgagcagcaatgaagcagcaactcttcaagcagcaacttttctgaagtgaggaagtttgatccccaagcctgcatacctgatggcgaaagtgtgctgaggctacagagcatagaaaaatacagactacagagccaggctgtggctcaaaattctagtttcagcacttactgtgtgacatttggcaacttgcctaacttctctgtgcttccactttctcatcagcaaacagtgataataatagcacaaactcatagggtgactgtgaggagtaagtgagctcatctgtataaagcacttargatagtgcctggagcacagtaagcaccatgtaagtatttgattgtgttattttttatcattattattyactaccaccaccatgacatagtcctccctgatgcactgttagcatgtaaagatggatgattattattaactaggatattagagaaagggctstgtctagggaaagtcctcaaattaactagctttaccttcaacttctataaagccctactttgtcagaattgttagcccccaaatgatctatatttgggcaatttcttgcccttgccaagataactaaggtaataaggaagtctactaggtagtcataattgttctctcctcttctttttatgttgtatgtgttcccaaaggcctctgcatttgcttcttcatttattccagaaatctttatttcatgcttaatatttaaatactatgtgccatgcactgtcttaggaaaagtatctgcttttatggagctcacattcacgtaaacagagagatgacaagcaaataaatagaccaaacaagataatctcatacagtggcaactgctaaaggaaaaaaacaaatcagagaaatccgctacagagtgactcaggcagggtgaggaaggctgactggggagagggcatttacatggacaccaaataagaagaagccagccatggtaatatcagtagagagtggcgtgttcctggcagtgggaacagcaagtcccaaggccctgatgaagtaaccagcttacggggttgaaggagcagaaagcagccagtccagctcaagtgtagtaagaaaggaagggagtgagaagagagggggaaggagaggtcagcagagccacatctctgagggcctgcagccaaagtaargagtttggatggtattctcagtgcagwgcggggtctctgagggtcttaggctcagaggtacacaggtaaggatgggagccccttgagggcagtggggaaggtcttgtggtaattcaggcaggagtcctagtggcttagagtacagagatggcagtggagaaagagaagtaggcagattaggtcaaaaagtatattttgcaggtaaaattaggatagattattaggtagacttattagaatgctggtgagtcttttgcaaaggcaggataatggaaagagactcctaagtttttaagctgtrtatctggatagatggtaggaccatttactgggataaggaaaggtggggggtgagcgagtgcaacccagagtcctagtgtgacggtgtaaggttagggatgcccatcggagacatccaaattgagaggccaaggaggcagctaaatgtctcagttgttcattacttattatgacaatgcttagcccttggggtggaggttttgttrttttcagtttcctatctcctgtttctattcctgcttcccacgtataagtaatatcagatagcagtaatttccatatgcatctcaaagttctttacgagtaaacactcttaatccttaaaacccaaaaagtatgaactacaaaatgaaacaatgaaaaagctaactaaactcttctgatgtcatgaaaagaacactagattagggttcataaggtccagattctaacaaaaaatggaagtacagaagaaaacaaatcagatgtagatttgagtcttagcttgtgcatttattaagtataaggcctagaccaagttatagagtatattttcttcatctgtaaaatgggaataataattccttccttgtgagttcctcgtgaggatgaaatgtgctgacatctgtgaagacctacatagtgtctgttgcattgtggacacctgtaaatgtggggttttcccccactttttacctattaaacttacacagagagcttaacagttctaccttgactcattaactgtgaaagaaagctgcttccttagataatcgctaagctctatttcatctcttcaagaaaaatctgtacaagatcttgaaaacaaccagataaacttcttgattaaagctgcttttaacctgaactcagtgcatctttctgcaaactaaaggcatacttaagactggggaagacagggccttcacaagcagaaattaaaccatagaaatgactctacaatgttgcaaaacgaacaaaaaattctccctccaaatcactaatgtttcagggtatgtacaactttttaggagatggagtaaatgaaatctcagagagtagaggctttcatatcactcactgaaagacagtaaaaccaaaaggtcttcatcttgggctttcctgagctggatgggaagtttggaggtctcagccaaccagactgttgagtgataaaaagtgaaactgtgaagaagcttctagaatcctagaagctctaggaaacagtgggtaagacaagagggagatacagaagtttagcttgggttacaagaagaagttgctagttagggactttctgtgccccaaatagtgcccaggggcactaatctatctgcatgataacaatttttatccgaatcccagaggcgtgcatctgaaacccaaactaagaaagatcctgcctaatcttaggatttaggacccaaaacaaaaagttgtttgggcctcgtggtacaaatagtgtcagctgatcagracgagaacagtgaccacaagagcaaggccaagatgagaagtccataagagatggaaataaagaagaacccaaaagaaatttgtaaagctctaaacctgtgccaagctaattgaataatgaaaaatgtgtctagcccacagatctgttttgtttggcttgcacaatgtgttttgtttcttattatattgaacttgattgccctcaggcactatccagtttaccaagcaacacccttcctaccatcttatctgccaacaggtagctcaattacattacttcactggccctgtaagcatttgagatgatagctattggtatatagtttatgtttacagatggattcatttttaactgttaaacacttgaacttatgttgactgcagagatgccagaaaaagagaggaagatcataggggaaaaaagtgggaaattgaaaaagggtagaaatcctagcagaactatctttgaaagaggcacccccgctcactgccccaattacagcagctacaaatcatgccgtaggtcaagtgaagtgggtgcctgccatatttctttcaactagcctttcagtattttgggaaattcccaagaatcgaaactcaaattcccacccttctttgtagctaggacattggcttatagcctcagttccaccaaagagcagcatgctggcaaaactgcaatttggaaaagagcaaaatgaacaaacaggaggagtcagccacccccatttttgccagcacagctgaggtgtcaggtttccagggcttgcatgactgaattccctggacagaaatgacactagtgacactgtggcaggtccttctgttgtcttgggtgagaaactgattccgtattaacatagacctctgtgcaaagaactgattccttgtcaacacaacacctgtgaaaaaagtcccagatttcatatgaccacccttcttcccacagagaaaggacacagtggaagtctctcttttgtccttgttctgtgaatcccaatgtgtacttttaaggcaatatgacattgcacacccattactcagcacccttggcacttgacttcattgtcaccatccacagtcaagaggtcattcaattttcactgaggagaccattatcagccattctgggaaacattcttgctctgcaggacccctatcttgggtgatgaactggttccatattaacagagacctatgtgcaaagtggcaagcaatgtacagatttttaaactaaatataaagatgatattaaactggttttcatttctgttagcaccaaacaagagtggttggaggtttcagctacagcagagatttttaatgaagaactctgggcattaaggatggctgtagaacattcttctctataattgccagctgttagacaatactatatttactatatagtatttactttatatttactatataagggtagcaattctcatttatatttctcatgatcatctcttgaagggtacactgttaatccccattttatgggagaaaaaaaactccrattaaatgacttgcttaaaaccagaggggatccaaatttgggttttctcattgcaaactaatggctttttttctcctgtatcagtggctttccaaacatattctgcaggttccctacctaggctgtgtgggacagcctaatgctcctaggctacaaatctgtacagagtgttactgtactgaaccccatagacaattataacaatggtagttgtgtatttaaacatatcagaaaaggtatagtaaaaatacagtgttataatcttattctaatcttatgggaccactgttgtgtgcgcagtctgatgttgactgaaacattgttatgggtgcatgactatgataagatattattttcctttctcccattcacccttttaagagggtagagagttttccagaggatacatgctatgtaacttcacaacagactgaagcagaagcagatatatttccctgtaagatcctagttttctgcttatatctctgtatmctctgcctccctagtctttttttcttttttttttttttttttggagtgatgaattaatgaatggtagtgaaggtgttagattgtaaagtaactgattatagactcaaccaccttcccctcaaattcctcaagtacctagctcagtgtaggctcaattactacttgattgatggatgaaggaacaaaactgattgctatcatagatagaggacctgctcaatgcttctggtaagtgataagcaaygtgtgcacttgctcctgagttcacagttgcataccagacaacagactgcctcagccccagcaagtccaggctcacctgggcccagggtggagagatcactcctgtctccttgcctcatccctgtccagattctattcattcacaggcccagctcagctcctgtgcctttcccagggatgccaaccaacaatgagcctcgcactgtgacatcacataggaatttatctatgtcatctattttgcctctcgatctcattctgtcctgcactgctgccttcctaaatcaattgtgtatattttgttttccctataagatcttagacatcatgattatattgaacttgggtgatgtgtacatagggttcacagtactattttctgtagtttcgtgtgtttaaaattttccataataaaaagcttaaaaaaaaaagatcttagacatcatgaaatgtctcaaaggtcttttgctttacccagagtctcacatagtgctaagtaaattataatcactctcatctaaataaatcttaaaactttacaaaatgattcagactcatcatctcactgctttttcaccaaagccttgcatgaaaattagaggaggcctctttatattatctccaccttacagatggaagcttgaaagttaagcagcytaaggtcacccagctagtgattaacagagtctggaggcaaacctgtgtcttgtgattccaaattctgtgattttcccactatattcatgctccagtttgctgatacatacttgtttaatttacctgaaagacactttgtgaaaaataacgggcctagatccaggatatgagtcagaacagacaggaataaacgcaagtctcctgattctcactaggcaccatgttctacagcgatcttttcccttgtgattttagctgttaaggtggtcagctcatgtgctggttaatcctatatgtgcctcccttaaaagagtgtacgaattatgtagtatacaaattttgtatcatacaaatgtccattttcttttttccaccctatgtggctaattggcagcctcattactgtgttttcccaacaaaaatgaagggaagcattacgaaattattcagtaacttcaagctgtgtctataaagtgtattataattcccaactctctcttttattttcctctctctcatttgtttacccatcaatcccacaagcatttactaagctctaagtataagcagaagcacattcgatgctgggatgtcttacaatacacaaagaaaaagatatccctgctattaatgagattgtcatctcatgaatataatgacatgtctagagaaaaattctaagatattgaaagtgtgaactagcacagtataatttatttatggaggtgttgaaggaatattgagtaagaaaaatagttcttattatagagagaattaatttggggaaggtttcatatagcggatgtgccttgagatacgttttgaaaaaaattgtagggtgtggtttggaaacatgatctccatctgcagattcccaaagcactcccaaataattgtacagttaaagtacaataatgtgttttgtatgcaaatgtagcctcaagacaggttgcctcattcccccatgccctccagccgccactcctaagcccctgctacatagaaatcctggagcccctactcattggtgtagcatttcagggaaaggaaagtcatcaaaattggtccagggcaaaaatgaaaagtaagtctctgtacctcccagtagccgtttagattgccccttccccatggtgctctgggctttaacgaacagcccagcatggcacagccaccatacctccctcagacctgcatccctgagcaatcttgtatgtcttccctcctagggcaaccttcctttccaaggcctatgccctcaggagtcctccctactatgcgtctttgtgctgctgcaccatgaacttaggttaatagtcaaccctccagggtattataggtacacagaatggacctctcactctaacagagagacactgcagtacaatagtttccccttacccttggggctcacattccaagacccctagtggatgccagacactgtggattgtactgaaccctatatatactatgttttttctatgtgcacatacctgtgataaagttattttatagattagacacagtaagagactaacaatcattaataataaaatagaacaattataacaatatgccaacctcactactcttgcactttggggccattcttgggtaaaataagggtttcttgaacacaagcattgtgatcccacaatagttgatctgctgaaatggctactaagtgacttatgggcacagagcatctgcagcatggatccactgtaccaagggatggcttacatcccaggtggggtggagtaggacaacacaagattttatcacactactcagaacagttaacaatgtaaaacttacgaattgtttatttctggcattttccatttaatattttcggactgtggttgactgggtaaccgaagctatggaaagggaaagcaagcttaagggaggactactgtataccaagcaagctactgagagaagacatatatgagaggaggcaggacttgggggctccttaaatcacactctgtgactggttgaaaaatcttgctatgggtaatatcctcctgaatagttcaagacataacataaagaagagagcaacagagagagaacaccatatgactattgagaaagttgaataattatgttaaaatcagattacaaagaccctgtagggtgggctgagtagctggtaattgctcgagtgttagggacactataggctcttgtgtaatatgatggaaaaggtgctttaggatgctgcatacaagcgaggctggaggaaagagaactgactgttgtgggtctagattatgtgcgcacctgccgcaatctagctttccagacaccatggctgtttctccccacaccttctagaccagagtctctgaaatgagacatgtcacatgtaagactcattctccaagctttcagagagaatcactccaaaatctgcccccttgatagaaatgggagaaaggatacaatactttcaagatggggcccaataatgtaggacagagatgagttttttttctaaataaatctttactcatgagcacgttgctaaatatgcagcctagaaaagagcacctgctaggggtagatagtgtaatatccactcattaaaaaagaaggaggcaggtcttgattttgcccccaactttctgtggcattgaagagttttatttttattattaatattatttttcatttgtgaatcataattgtatcattgatgacgtacaaatgtgatattttggtcgatgcctacaatgtagaatgatgaaattaagctaactaacatagtgatcagcagaagttgccttattacttgtgattccaacaacaaaacaaggctctggttatttattcaaattatattatatggttcagattctctttgggttttgtaatatattgtctgggggctgaaatggtagatgaaagtcaatcttctctgagacaagagagatgtggatgggttcttaagtgttgcagtgacggctgacaagccccatctacaagccagaattcaatctcttcgcctttcagtgcaagatctttatattgaagcacaacctctaggctatgaaatggaaaagaaaaggaaggagggtcagaggagacagagaccactttataaggaatctatgatgggggcaattaggccaccagcttctgcagtgcacaactgcttacagagatccctggagtggttgttgttttcatgtttatgtagtgcctgggcatttatattttttaaagtactaacatcagaacccccgagaatgaggctcaggcaatgtaacttttaaaactccctcagtgattctaatgtgcagctacagttgagaataacttccctagtatttgaaagaaactaaatgttgattataaggattttatttttgaactatttttctggcctcaatgaatttaatgtctggctagaggaacttgtggctttgagatgaaagaatgcaaaaacaaaatcaaggtacagaaaatcactggtgggggtggtggagagagagagagagtttgtgctgtacatgcaacatcggcgtattagtctgttctcacactgctataaagaaatgcccaagactgggtaatttataaaggaaagaggtttaattgactcacagttccacatggctggggaggcctcaggaaacttacgatcatgccagaaagggaagcaggtgcatcttacatggtggcaggtgagagagagcgtgggaaggaggaactgtcaaacacataaaaccatcagatctcgtgagaactctcactatcacgagaacagcatgggagaaacctccccatgatccaatcacctcccaccaggtccctgtcccgacatgtggggattatgaggattacaattcaagatgagatttgggtggagacacagaatgaaaccatatcaattggtgtaattkagtgcttattagtcatattaggggctagaatttttctgcccatctaaggaaagatctatctccaaggaaatatacatatatacaaatttttcagattttaggattatcatagacttcctgaagccaatgttaaaaacctcagaggtagtcatagacttttgtaactaccttcaaaggaacaaataagcagtttttaaaaatccaccataagaattaagaaccctgagtagaggtcttgattttgcccccaactttctgtgtgattctaactaaattacttaagcttggtaggcccaagttttcatatctgtaaagtgagattttcatctgccccataagaaggtgtgggtaatgttttaacaattttgtaaaaatcaatttagagtgaataaacaaatatgtgtgataataccttgaaaagttgcaatttattatcagagctatttggaattaatctgagaaaaagaaacatacagcttttgggtaactgacatgtttgtgtagctctcatttttatgtacatctgccttgtcaacacaccatacatagattagaaggaatttagccactctgtatcaggatagtgagtcccattggcagttgccctatatattcaattcttctttccctgtaatatgaggattatcctgcagtgtttaccagtggtgtcttctgtcaaactactagtaaatttgttcttataacttgaaaaatacagcatgcattaaaattcaaagaaaaggtagcagtttggggaaacagaaacctatgaacccaaatttcaatctttttcacaagagccccgaaataacttctctgccctccacctcctttccagctgagggccctagggactgccactgtcctgttccctacaagagaatggttatctaggaaggcaatcttcttatttcccaagaaatgtacactgtctcagaaaaagtccaagattaagaataaagccagtccttcacagccagcggttcaaagtgaattattgatgcagcctgtggtaagatgttaactagaggtgcaaagtttatgtgcaggaagtaagcagagccatgctgaaagaaagacaccaaccaaagcttttgtgttcttaggtgtcaaggtttcccattcattttattgtctgagtttcaatggaaatgaataaaatgctacatagaggatctaatactgatagtgaattttgactgctgttttccactcttcagaaaaaatatattaaacaaaatgcagagtcatgtaattcaggttactgtctgttttgttcataaaggaaaatgctttatatgcagaaatttcaagtgagaggagatgtcaggtctccaaaagcagctattgtcaaacaaagcagccagataattaatgccctagagatggctgtgaccacgatattggatatcagcccatgtcttcatctctcttggtagaggcacatgcttttgagctgctgattgtacccacaaagcctatctatgtgttctaagttttttgacataaaatttcctctcctctttatagagtattactttaactttctggttattctttctacaacccttgctgaccagatactatgagtgaggcatggaaaaagaatggtatacgatagtattcaggatgtttttgttatatgtaaagatgaataggccatttaaataactgatcagcttgattctccacttccaaattaatatcccccttccagacagaacagctctgcgtgtaacctcttaccacatcctcttgtagagtggctttttatcccgggcatttaagagagggattctctatttcagtgcagatgactccatcacccctctcagaaactgggctattctgtaagggtgtgtgtgtgtgtgtgtgtgtgtgtgtgtgtatgtgtgtgtccaaccaaagacactattccaaataattaaagaatttggcattttaggtaagcccacattctggttaattgagaattgccacttatgtacattactaggttataagcaaatagggcaaaaggctctcaaggtagttacttcctttgtattaattagaaaaagaacactcaagagtttaataacaaaatcacacaccttttttggacggttgatatcttgtttctgtgtatcatgactaatagtaatgctgtaattcatcacattaggaaagtaatcaacagttctagctgcacaaaattaaaattgattaagacccggcgtcaccctggcagaagctaaaattacatcagtgttaactctacggccaatagccaaaagtctttttagtctcttttggtttaaaaagatctgctatataaaatctagtgtatacaaactaagcaaaatggattagaataaaataatgttgatatatttaatataaatagttctgcagagaaagctactctcatgtttattgaccactggtagaacatcactatggactgggtgctgtgctaggtgctctgcaaatttgatccattttatcctcaccaaatgcatgaaggtatgttggtgccagcctcccacgatagatgaagaagtggggactataggaatgaagtaaccaattcaggagcccagagccacagccaagactcaaatccagggatgtctcaaatggttgaacaaagcatcctttctaatcaatgagcaactgtgctgtctaagaagaccttgtacatgagtacaggaaatatctttcacagatctagattcaaacactgggagaaaaacactcttcttagaaatcatgcccttacttttacaatcaagagttttccgaaggataagcaaaactggtcaatatccagggtctcagaggatgttctccttggaggcacagctcatcaatctcttcttgaatgttgcaaacaatgggccaggaacagagagggatggaggaaatgaagagtcattagccacaataagtgtccttatgaacagctctgatgtcatttatctccaccttccaagaatcctggatgggcttgcataggcaagtgacaaatattgtyaattaagtctttgaagataatggcaaatgtcactaagaaagatttgtgttgaatattacatcaactcagcgttctttcctggccacgatggccaatgtgaggtgacatgaggttaggacagtcatgcctgtgcttggatgaagcggaactctgttctgagtatgcagaagttagattagagattctccaaaaacctttttccagatggatggcaagagtgaggcagtggcccccaattctggaataaaccggtgttcttggctggtgtgagaccatgtattagactctaaagacggtcagaagcagtaaccacaacactctttrttctacaattctgagtgtgctgataatatgggcaggagttagaagggaactatttttctgactttttctcccaggctgtccctgcaatatctaccatttcatgaaagaaacaatcttaaactaagttatacagagtacttgattcatgtttcctctcttttttatcatcctgattctacctttatggcagagagaataagccatctcatgattgccttggaccaaccatcccaggccagtagagaaagatacacctatttccccaggagcagagaggttgtccatggtgggggctgggtggtgaaactgcacaacatggccagttgaatcttcctttaaaaaggtcctatcatcaagtggggcacatagcatgattagaggccaggggttgcctttattcacttctgcttcctcctctgcctaatccctgtacctgagggagccttacagatcccccaaatctgggtgatggagcaatgaaccatataggcccatgttcccctgtattatctcatcctatacctactttttatatttgtcaataaaaagtctatggctgtcttgttttttgcaatccatccttatgaatgctctactactaaaaacatagaacaacctttatgggacaattggaaatttgaacactaactctacatttaatattaaggaaatattaaacttctatttaggagtgagaatggtattgtgaaaatattaggtttgtctaagagtgcatggcttttagatctacgtaataaatattttcagattgaatgacatgatgtctaggatttgcttcataataacatgggagggatggcagccagaggacatatggatgaaacaagattgggcttgagctgataatctttgaagctgggtgacgagttcactgtactgggtttggtttttggtttgttagttgtgtgtatgttaaaaatgtcccataataaaagcttttttaaaaagaattaaaattggttattttaaattaatattagaaaattgtatttctcaaaaatattttatgtgcaattatcatgatttataatgttaaatggaataggaagatctaaaacatataaggtacaaagtactgcatgtaaagtactgcatatacacatttgcttttatatgtacatgtaagtggaagaagaaatgatgcaaatgtaaattatggttgcccctgactggtgagaatacatattatttttctttattcattgttacatttttgtacctcccaaattttctagagagaaaataaactatatttaaaattttatagttatttttatatataagccatgcttgtgacatattattagattttttaaaaaagatacagaactatttgtgaaaaagaacctcaattctgttttaaaatgtgtgcacatggtaagtgtgtgaatgtatctaaaatgaacagcatcaaaaaaagaaacaaatctatattctagattttcatagacaaaaataaataaatatataaataaataaaatgaacagcatcagttgttaattgtggctatctctagatggtgacgttattggacaatttttagtttatttgcctctctgtgtgtttcttcaattaataagtataatattataatcagaaaaatgtggcataaaaaataaagctagatttattatacttctttataagggttagctatatagggcaatataacatacaagtaactacataatatatacttacaaaacacatatgtaagtccaaaggaattttaaattctcaaagtatgttaagcttttaaacgatgatataaaatcttttcaatagccaatattatgtgatgatgctcttgccttcatatacttaattccttaataatcatgtttcattttctgttcaactccaggtatatccatgccaataccagtctttgggctacaggacgattcraaggtctttaaggaggggagttgcttactcgccgatgataactttgtcctgatcggctcttttgtgtcatttttcattcccttaaccatcatggtgatcacctactttctaactatcaagtcactccagaaagaagctactttgtgtgtaagtgatcttggcacacgggccaaattagcttctttcagcttcctccctcagagttctttgtcttcagaaaagctcttccagcggtcgatccatagggagccagggtcctacacaggcaggaggactatgcagtccatcagcaatgagcaaaaggcatgcaaggtgctgggcatcgtcttcttcctgtttgtggtgatgtggtgccctttcttcatcacaaacatcatggccgtcatctgcaaagagtcctgcaatgaggatgtcattggggccctgctcaatgtgtttgtttggatcggttatctctcttcagcagtcaacccactagtctacacactgttcaacaagacctataggtcagccttttcacggtatattcagtgtcagtacaaggaaaacaaaaaaccattgcagttaattttagtgaacacwataccggctttggcctacaagtytagccaacttcaaatgggacaaaaaaagaattcaaagcaagatgccaagacaacagataatgactgctcaatggttgytctaggaaagcagyattctgaagaggcttctaaagacaatagcgacggagtgaatgaaaaggtgagctgtgtgtgataggctagttgccgtggcaactgtggaaggcacactgagcaagttttcacctatctggaaaaaaaaaaatatgagattggaaaaaattagacaagtctagtggaaccaacgatcatatctstatgcctcattttattctgtcaatgaaaagcggggttcaatgctacaaaatgtgtgcttggaaaatgttctgacagcatttcagctgtgagctttctgatacttatttataacattgtaaatgatatgtctttaaaatgattcacttttattgtataattatgaagccctaagtaaatctaaattaacttctattttcaagtggaaaccttgctgctatgctgttcattgatgacatgggattgagttggttacctattgctgtaaataaaaatagctatmaatagtgaaaattttattgaatataatggcctcttaaaaattatctttaaaacttactatggtatatattttgaaaggagaaaaaaaaagccactaaggtcagtgttataaaatctgtattgctaagataattaaatgaaatacttgacaacatttttcattcctgctttttcatagataccattttgaaatattcacaaggttgctggcatttgctgcatttcaagttaattctcagaagtgaaaaagacttcaaatgttattcaataactattgctgctttctcttctacttcttgtgctttactctgaatttccagtgtggtcttgtttaatatttgttcctctaggtaaactagcaaaaggatgatttaacattaccaaatgcctttctagcaattgcttctctaaaacagcactatcgaggtatttggtaacttgctgtgaaatgactgcatcatgcatgcactcttttgagcagtaaatgtatattgatgtaactgtgtcaggattgaggatgaactcaggtttccggctactgacagtggtagagtcctaggacatctctgtaaaaagcaggtgactttcctatgacactcatcaggtaaactgatgctttcagatccatcggtttatactatttattaaaaccattctgcttggttccacaatcatctattgagtgtacatttatgtgtgaagcaaatttctagatatgagaaatataaaaataattaaaacaaaatccttgccttcaaacgaaatggctcggccaggcacggaggctcgtgcatgtaatcctagcactttgggaggctgagatgggaggatcacttgaggccaagagtttgagaccaacctgggtaacaaagtgagacctccctgtctctacaaaaaaaatcaaaaaattatctgatccttgtggcacacaactgtggtcccagctacaggggaggctgagacgcaaggatcacttgagcccagaagctcaaggctgcagtgagccaagttcacaccactgccatttcctcctgggcaacagagtgagaccctatcacaaaaaaaaagaaagaaaaaaagaaaatgactaaactgaaatggtcttagtcaaaaaatatatacagacttatttttagaatcatttcaacttatttccttcttacctggttcagaaacaagtttgtttcaactgtgagagtagttttaaaaataagttttcctgattggttaccaataaacaccaaacaaataaaggagggggaaaatatcacttgaggcttaacattgcaattaatttagaaatacgcacctcaatctcaagccagtttataactaccatagttttgagcaaaatttttcttctatttctccaaaaactcactcatttcagtattactcattgacactgggctccctaatagaaaagcagatattataatatttcattgaaatggttactaaagagaaaaagagattaacaacagttaatccaccttgatattataacactcaaggttaaattgcatgttgttattagaatcaatgttatatatatgattacaatgctgaagcatttctattgaatgagaaatagtgtttgccctaaacctttgggaaaaaaatacagatttgaaaactaaagaatgtgggaagtgtcattgtgtaatttggaaatgcataaaattctcattatgtcctcatagatatgttgaaagatggttcactgtttcaaagatagaatgtataatatgctgctagtaccaaggctgcatttgaactgaactactccttatgatataccatactaactgatgaaaatataaatgttaaaatgtctccactctaatgtattttgccttcacttgtaactctgcacatttcattatatattagggaaaagattacagattctacccccatatactcaatcttgatcagaatgtacattaatgttgcctgatagatgtcttttgactacctatatattacaaatgtgtatgtgtttttttcttccataagtatctattcaagtgtatactgtataggcaaatgtgtagctgtatatatgtacagacatgttctcatgcactttattcaatatttatatatttatatggacgaaaagcaagtcaatgaaaacactcagtatatacacatgtgtgcatgtttgtatcatgtttatttaaatgtgaattcatgttctaatatttctatgaccttccattgctgcaaagcagattaaagtgtaacaaaaatatcagctctttaaataaactggaaattaatctaattttgtggaagaactttaagacaagtctatgaggatggcgaaaacaatggtccacatatatagtttcttgatcctaaataaaatggtacctttgggccctttgtttagtctggcaattttctgactactatggctttttaaacagactcacacctaagtgaaacacagttgtcaaatgatttatggatctgtgattaaaggattcacttttaatgaatactattaaaacggagtaacaaaccttgctctactttaagttgaatgatagattcctctatattcaaaaaaaagcaattaactgccataattagggaaaactgtttaaagcatactgcatttacttggccacagcgccatctcatggtaattttttwaagtgctaccgtagccaaattgaactaagtcactgtactgctttcagcaaagggtgctcctcccatttgtgcatcaatgagacatatttataaagtgctaaattattctgtgccatatgtaacaaatacagtgaagattattttatgaacttattttaatcaaggcgatgctaaaagttttcaagaaaggataaataactgtaaataaagtagactcaaaaatgaatgaattttgtgtgagtccatagctgtgtctactaaacggaattaccccaaatcttccaggtcatcagactcagaactccaggtatcatcctgatattcgagagcaaaaaagcctgtgcttctggaagtcagccatgtcacagagctaggatccatccagttggattagctttatcgccatgatccagtttctagttatctgcagtagaaatatgctccatgtttgatcactatgtctggttccacgaagcctaagaacatagagaacaacttcagtgccctaagagatgtgcacaggtgcgtgtggtgtacaccaggacatgcacacaggtgtgcacacgcacagatgcattaacatatgcacacacactctctctctttcacaggagatcatttcaggaattaaagtaaaccaaggaggcatggtgtcatttaacagttaccctcattcatcatttcatctttaactgcagggaaagtatattgagtgcctactgtgtgccaagcattaagctggttgctttccttgcttcaccaaatggaattttcacaacaatctgacaaggtagaattatttttcttttttacagatgaagaaacagagattcagagtagttagtaacatatttaaagtcacactgctggcaagaaaattggcaagtttaagcctgggtcatctgactccaaagcataaaatattttcccaacctcatgcagtgcaggggaaagatcacctgtcaaaaccacaataggagagttcccatgttggcttctccattcactgcttatgtgagttggaaccagtctcttaacaactctgggccttgatttcactgtctgtaaaatggagctgctggtacccatcctggctaactgacagagtaatttagataagatcatgcctatggctgtgcttgataacttgtaaaacaccatgtaaatgtaatcagtgtgttagtaaaaaggaacaactccaaagcctctgtaaattattagccatcagagcaaattctagccaaaactgtgggataggcaatattataattcagcagcttctgctactctcttggtgtttctctttttcaaaaaatttacttctgctttgtccccaccttaatgcagatctcccttctttggtgctctctcttatgacttacataaaaactttccatcccatatgccattcccttgggtgtcaactctctggaagactactactaagtaactgaagctgatatgccattgtgtatcattgacatctcttcagcagcccaccatgatgaaaacccaaaaggcagaaatcaaaggaaaaatgttaggcatcaaggagacaagtgagaagaaaatttggggacaagaaatgttttcttggtatccctgaaatgaccaacaacaacaacaaaaaaacaagtatcttcaaacacttcataacttatataaagttttakaacttaatattgaatttaatccacaataataatgatgattttgaaagaaacattcaagactttgaagatttcattctaaactaagaacattaatgatgcatttgtcccagcaaatatgcaatgagacaagacttctttgtgaatttctgattattttggcatgcggcttgctaaaacaaaatttttaaaaattttttccttaatggtttacacaccagtcttaactctttctttttttttttttttcttttgaggtggagtcctgctgtatcacccaggctggagtgcaatggtgtgatctcagctcactgtgacctccgcctcccagggttcaagcaattctcctgcctcagcctccttagtagcagggattacaggtgcgcaccaccacgcctggctaattttttgtatttttagtagaggtggggtttcaccatgttggtcaggctggtcttgaactcctgaccttgtgatcccctcgcctcggcctcccaaagtgctgggattacaggcgtgagccaccatgcccggcccaactctgaccttcttttttgatattaacaccagtatgtccatctgagccagcgttttatgggaagtcttcatacccaattggaaccttttttcatgtggcccagtcacagcagaagacagacaggaaaccgaggtccagcctgctgctgttgtctgaccttggacgaatctgagtttttcctccttgaagcatataataagggacttagggtcaattatctcagcaaggagtctcttctatgtctatgcttatctgaacactagagagtccagacaaggccttgttgaaccaaggcactgcttcaggtgccaaggataatctggaatgcagaaccctcatgttttcttaaattctctagatggatttcaaataaatgacaactttatcttttatatgggatgagataaatcaaattgctaagtatctaagaagtttctaagatatgagcccaggaggcaaatatcaacataaatgtttgtacattggcattttcctcacagttgggctctcttctgcagtttcatagctactacaatattttggattggcctttttaataaccctcaggcttcctgaagaacaagtgctcctactatttgagttcaatttccctgaagggttaaaattaaaaagcccagatagatttagaattcatggcgcagagaagatctcttttttaaaagctagatttacattgacagtatgccaaggtcacttaagttttcatttataattgagattatgagaccttaaaaaagtatttattctgtcttctagaaaaacagcacaatttgtacttcctgtcctacacttatttcagatattgaaaagtaatatgccattattcagataatcttgtcttagttagggtgaccctaagagcagagttaagactcaggtgcaggttatttatgcaggagatgctctgagggagccaacagcattagagagggaagaagtaaaagtttatttaactgtgtgttcagtgtgtgacataagcaaaaactatactcaaattgggttgagcaactagtgctgcaaactcatttattctcttaataggtttgctagtgagggtctgctatgtgtatgttttatgtaagaccactaagtgtgggaagtctagggatggaattactcttttaaaaaacttgaataagatactgggtggggagattattctacctctttacaaaatgtttgtttatttcattgagcctaccaactttgtcacaaattagcctaagtaatataggataacttaacacgcctacccagagatgccatgctgcatatgataagatatccctcaaggcattgccaccacccgatgctgatgtttcagccactttagacactggtgaaaagcaaagttgtgtgggccaatggcaaaagtgttaagaatatagaattttaaaattagttttatgaggaaaaaatgaaaattagatagaatgttcaatatcactatctccaggctccattgttaaagttctgcattctaagacctaggatcacaatggggtgtataaagaagaatatctaaaagatgggaattagtcaacatagataagcaatccaagaagaatttttaagaagacgaaaaaggaaatgaaaaaaataaacaatagtaaatataaaaacaaatgtgttcagcatgtacacatgtaatgatgtatctctctgatactctgaaaaggggatacatttattagtctttaatttctagagacaagatggtggggttttttccaaattagcagaaaaataggaaatgttattcacaagtgattacaagtatgacaaaattaaaacaactaaacatttccaagactgaagaacaagaagattgatttgcatgaaaatgtaacactacatttattcctctaatataatcaccagagaacttgactatgattaattattcctacacttctctaaaatagaatgtggaagctatgacacactttttgtccagctcctctccaccagatagacctaagtctgaaaacctattggaaccactcataaagaaaaaaaatcttctctaacttagaattattatcactgtcatgatgcaaatatcaacttacttcaatctatatgaagcataataaataaaatattgaaactattagtacatttatataacattctgctttgagaaatttgctttaataactttgaaagacaaaataactatttctgccttaaatgagcatattttttatttgacttaaataccagcttcttttgctaatagctttgagtggtcctacttggttctaagaatttgagcaaagtacagctagccacttgtagtaggcaataatgtatatataaagcataaaccagcaatgttttcacattttttgaaacagcgagattaaatccagaaacatccaacctatttctcttactacaacaaggaaaccagaaggaatgtcaaaggaagacactgaagttgatacttattgagcaacaattttgtgctaatttcacacatttaatcacaataatgtgtctatgtctcatagtaaccatagaggaaactgagtctcaaaggtaaatttgaccaattc

SEQ ID NO: 17740 - DNA, 23572 bp, Homo sapiens
tccagcctgggcgataagagcaagactccatctcaaaaaaaaaaaaaaaaaagccaggtgtggtgacacatgcctatagttccaggtactgggagcagggagcgggcactgagatgagagaatccctttagcccaggaagtcaaggctgcagtgagccatgactgcaccactgcactccagcctgggcaacagagtgagaacctgtctcaaaaaaaaaaaaaaacagaaagaaagaaagaaaagaaaaagacgcagctgggcacggtagctcacgcttgtaatcccagcaccttcagaggccgaggtgggtggatcacctgaggtcaggagttcgagaccagcctggcgaacagggttgaaaccccgtctttactaaaaatacaaaaattagttgggagcggtggcatgtgcttgtaacccagctactcgggaggctgaggtaggagaattgcttgaacccaggaggcggaggttgcagtgagccgagattacaccactgccctccagcctgggagacagagtgaggctccatctcaaaaaaaaaaaaaagaaaagaaagaaaaagaggcagggcaccctggatgggaggaaggagcaccaccaagacaagcctaaatgtggatattttcattccaaaagcacaagaacttcaacctggctgaccccacaagcccatatatctcctccctgccttgaactcaccaagccccctgcttggaataccagtaggcagtctgagggaatgggacaatgtggtgcaggcagggtcgggacgacaccaggagtgtgaggacaggcccggcagagtgctctgagatcagactgaaggcgggagaaatgagagaagcaagacttcccggtcagaggagagaaagctgactagatgggctttgcaggtccttggggagagcagagccacgtgtggcttttagatgccactgttctccagatctttgcagaatccactaaactaggaaccttggcctgcagccagtgggagaagggtagtcactgggaagaaactcccaaaagtctgaccgaggcaatgctaggctggtgagagggtgggagtgggactatcttccctggagctgattaaggcataaggagactgcacagcctcaggactatatgctgaaatgcaggcatcacgtcagtgtagtggctgagagatacaaggaggaagaggtggaaatccaggaaaacagacagagatgaaaggactataacacacacagcaggtttctatgtaaatatgtgcttgtgatagggaccagatgactaacgacaaccttttttttctttttcttttttttttttttgaatcggagtcttgctctgtcgcccagcctggcatgcagtggcacgatctcggctcactgcaacctccacctcccgggttcaagtgattctcctgcctcagcctcccaagtagctgggattacaggcacctgccaccacgcccagctaatttttgcagttttggtagagatggtgtttccctcatgttggccaggctggtctcgaactcctgacctcaggtgatccacccacttctgcctcccaaagtgctggaattacagccgtgaaccaccgcacccagcctaacgacaaccttcccacacactcaagcccccacctctgcctctcctaaggagaagggacatttgattgctggaatggctggagctgtggaaggaggatgaagtattgggtggctgcagtgagccatgatcaagccactgcgctccagcctgggtgacagagcgaggccccgtctcaaaaaggtgtagggtggatgggaaagtatgtaaagaaaaagagagtgagcagggaccagagaggcagaggcaaggcttggctttgttctgtttcaagacatagagaagagatatttgggagcatctgtcatattgaatgagactttggggacacaagtggagtaatgactattttagggagttttcctaagtgtggaatggtctagtctcattcaccatcagcccctcaaggaaacgttcagtaaagatggaattggccgggcgcagtggctcatcctgtaatcccagcactttgggaggccgaggcgggcggatcatgaggtcaggagatcaagaccctcctggccaacatggcgaaaccccgtctctaataaaaatacaaaactagccaggcatggtggtgcatgcctgtaatcccagctactcgggaggctgaggcagagaactgtttgaacccgggaggtggaagttgcagtgagctgagattgcaccgctgcactccagcctggaggacagagcgagactccttctcaaaaaaaaaaaagatggaatttactcttcacagcattcagggttgcgtttctttttccatgagtggtactaagaagagcctcaaggtgggagcaggaaggctctgctgtgtcaggttatacctgcacatatgcatggccacatggcccaacactgtaagggccttgcttgtaagtcccttattctgtcctctagcaatgtgaccatgtaggcaacatttgaaattcctttaaaattccttctaggcagagatttaagctaagaggaggacctgagtgacctctggtgcaacatctgaaagcccacgacaagcctcctgggcttttccatgaatatcgccgtgcccctgcctacggatatgctgatgtgtgtatacaatattctgtgagaagcagagacgctgaacactaaacaacacaaacccatttggtctaactccatctctgcctactcagacatctgcttctagcggtatcagagttatgtctatgtagctaaaacaaatggagtaaggcagcaatacacacaggctgacaagcccaggatggagggcggcactgcagatgctctgctctctactggaatgtgtggacatacaggaatccctatcccaggacacccgcagacccccaccatgaatccgagatgctccccaatgacggtgatgatgacagaacagagatgccatccctggtcacacacacacacacacacacacacacactcccactgcctccctctgcacccctcccaaaggcacctgccttcctctcctctcaatccacaagccaacctccagctgccacctctctatcagccttggctacccccacccacgctggcacctgcctggcagctccctatccaccccctcagccctcaggaggccagggcacacgtggaacaggttgatgttgttctccaggaagtggagtgggaggggggtggggtcactagggcaggcggggtccccggaagcctctgtccctgcataaagcagcctgtcctggcaagggatggtcatcctctcaacctacagacccagtgagccctaggccctcaccccagacccagctgctggataggacccagccccgctcccaggtaagaacttgatgacagcagggaaggcaggggtgctctgaggacacaggaagatgggtggaccaagaagggaatggaactcccctagagtccagtgggataagtatcccgataggccttggggagggaagggagaggcaggcctgtggacatctctctggtgaagaggaggctgctgttgcccaagcccttcccaggtgcacccaggtagcaccaggaggttgtcctgccccatcctggccctcccaggaatgagggtgaaaaaaaaaaaagcaccttgaagctggcagaacagccccacgcatctgtgccgtgcttcctgccccccctgctgctgtgaagtgcctgtggtggatgtgggatgcttccaagccagctggtgtggcctcttccacccacggggataactggggtgtgccgatcggccacccagccagagcacctggactcaaacttcaaagacagagacttaagatgttgaccctcaggtcaggtgcggtggctcacacctgtaatcccagcactttgggagggtgagatgggcggatcacctgaggtcaggagttcaagaccagcctggccaacatggtgaaacaccgtctctactaaaaacacaaaaattagctgggcatggtggcaggcgcctgtaatcccagctacctgggagactgaggcaggagaatcacttgaacccaggagatggaggttgcagtgagccgagatcatgccattgcactccagcctgggcaacaagaatgaaactccatctcaaaaagaaaaaaaaaatgttgcctctcaggttcccatgggccccacattctccagggccctctcatcctagcgcacatctctcagggccacattcattggttctttccacacacatttgccaagctcgaactctgtgccaggtgtggtacttgctgctgcagaggtgactaagacccatttcctgccctctgggaagtcacagacgagttgctgatagggtcaggtgaacagatcataacaaaggaaggtgcatcagaagagcgctttggaaacacagatacagtcaccagctgcctggaggactgagggaagaggttccaggaggtgacctgaattgagcattagcggaggactagggagtcttcagatccggaagcgggtattgtaagcagagggggcaaaggtgaagagcatcaaaatgcctggatcctggctgggcacagaggctcacacctgtaatcacagtactttgggaggtcaaggagggcggatcatttgaggtcaggagttcgagaccagcctgaccaacatggtgaaaccctgtctccattaaaaatacaaaaattagccaggcgtggtggcacacacctgcagtcccagctactcgggaggctgaggcaggagaatcgcttgaatctgagaggtggagactgcagggagccgagatggcaccactgcactccaccctgggcaacagagtaagactccatctcaaaaagaaaaaaaaaagtctggatccaggcatcccccaggggctgtgagaggggagtgggtgtactcatacctgtggcacgcatgagggaaggacagggtgcagggaagtgtaacccacacatggaaagggcaactggggcaggtgaacagcttggccacccaggctcttgttgccagcagcatctccttccctcccctggtgtcctccgactctggctattgctagtctctggtgtgagagaaagctttacttccattgctaaataaatgctctagaccaggcgcagtggctcacacctgtaatcccagcacttcgggaggctgaggtgggaggatcacttgagccaggagtttgagaccagcctgggaaacatagtgagactctgtctctacaaaaaaaatttaaaaattagccaagtgcatgactgcagtcccagctactcaggaggctgaagtgggaggatcaattaagccttggcggtcaaggctgcagtgagctgtgatcacgccactgcactccaacctgggcaacagagtaagaccctgtctcggaagaaaagagaagaaagcaaagcaaggaaaggcgaggtggagggaaggaaggaagggaaggaaggaaggaagggagagggggaagaaagaaagaggaaagaaagaaagaaggaaggaaggaagaaagggagggagggagagaaagaaagaaggaaggaaggaaggaaagaaagaaagaaagagaaataaataaagaaagaaagaaagaaagaaaaagaaaagaaagaaaagaagtgctccagctgggctccgtggcagtgaagaaaatgagcgtggagtgagaaaaatgcccttgacaaagaaaagggaggtgtggctttgctggccatctrtgggactttggggcaactctttcaactctccagccctaggttcctcatcataaaatgcagactcccttgattctttccagctgtgacatgagacaatccaggcatctctaagagctcctcctgcctcagagccgggtaaactctctctgcaggggcccagcctatatcccgggctccttggcagccttggcagccaccttgacactctcctgtctccccacctccacagagacaatgaccatgtttgaaaatgtcacccgggccctggccagacagctaaaccctcraggggacctgacaccacttgacagcctcatcgacttcaagcgcttccatcccttctgcctggtgctgaggaagaggaagagcacgctcttctggggggcccggtaygtccgcaccgactacacrctgctggatgtgcttgagcccggcagctcaccttcaggtcagcctcaagyggggctgggaactgagggatactgagggacagrggctgggcacctggcctgcaaggaggacctcaaagctccctctggccagaggtgattagatgtcatctagcccaaagtcatcatcaggagctgaggaggctggtggtcggggggatacctctcagctcagcctcttttatttatttacttgtttgtttttgtagagatgggttcttgctttgttgcccaggctggtttcaaactcctgggctcaagcaatccttccaccttggcctcccaaaatgctgggattacaggcatgagttactgcacccagccagcccagccccttttgtcttttccctcctgcagacccaacagacactgggaattttggctttaagaatatgctggacacccgagtggagggagatgtggatgtaccaaagacggtgaaggtgaagggaacrgcagggctctcgcagaacagcactctggaggtccagacactcagtgtggctcccaaggccctggagaccktgcagragaggtgagagtgggcgggacygagggtctcccgggatgtgggtggggcagtgcatggaaatggtgcttggggccttgagctgaaaggtaggacccttgcactgacctttgccaatgtggtcatgacaggggagctcttggaggcaacccttctggcccatggctgcatccaggccatttcctagtcacacctcccgctgctgccaccgtctccaggaccacctccccactgtcacgcatgcacagggaagatgatgtccacactagcttgctgtgtgatcttggaaaagtcacttctcttgggacctcagttttcttttctgcaaaatgacaggattgaatgatcatctctaaggctccttctaactctaagactatgcaatacactagaaaaaggagggatgtgtcttaactgcccccagctgagacctgagcactgtgttctgctcccataaatgaagcctcctgcctgaccccaatacacactaagcacgccctcgggaatgctgccccacagcacaaagggtgtggcaggtgccacattgatgctgggcaccaccggatgtttggcttgacacgggaactgacttttaagtagttaagtagtggttgaaagaaggaggtaaggactgtgaaggccagaaggaaaggctggggtagtcatccagcaagcatgtatatagtaaagcactctactacgggctggggtgcgcctagaacatctttgtccaagaaccttgcagtctaggaaggtgaaaattttaaaaacctgtgcaacagtaattataatcaaagccaagaagtgctaagtgctgtagggatggtttgactgagtcttgtggcaggtcaaagggacttctggctggggaaataagggaagatctcacagacatggcagcctctgttttgggccttgaaagatgagcagaaattgggcatgcagggctgggagaagggtattatgaaggcacacaggtgagcaatctcaaaaccaccaagggccaggaacagccagcatagcaggggcggaagaggtgcgagtagaacgagcaggaaatgcaggtgaacccaaaccatggaagaggcaagtggcagctccaggagactgaattgtaggcaccaggaagatcctgaaaatgttctgatgtgtcccatgactaatccagccagatggaggaagtgtgtcagataggggaagaggaacaggggtttgaagcagtcagacaaggcaagacacttttcttctttttttgtttgaaacagtttttcgctcttgttgcccaggctggagtgcagtggtgcaatcttggctcaccgcaacctccgcctcccaggttcaagcaattctcctgcctcagcctcacgagtagctgggtttacaggtgcccgccactacgcccggataattttttatttatttattttatttatttatttattttgagatggagtctcgctctgtcgcccaggctggagtgcagtggcacgatctcagctcactgcaaactccgcctcctgggttcaagcaattatccagcctcagcctctcaagtagctgggactacaggtgtctgtcaccacacccagctaattttttatatttttagtagagacggagtttcaccatattggctaggctgatctcgaactcctgactttgtgatctgtccgcctcggcctcccaaagttctgggattacagggaagtaatcccagttaagtagtggttgaaagaaggaggtaaggtggctcgtgagccaccacacccggctaatttttgtattattagtagagatggggtttcaccatgttagtcaggctggtcttgtactcctgacctgaggtgatccgcctgcctcagcccccaaaagtgctgggattacaggcgtgagccactgagcccggtcttttttttttttttttttttttttttgagacggagtctctctctgttgcacaggctggagtgcagtgacacgataccaggtcactgcaacctccgcttcccaggttcaagcagtcctcctgcctcagcctcctgagtagctgggattgcaggcgcacgccactacatccagctaatttttgtatttttggaagagatggggttttaccatgttggccaggctggtctcgaactcctgacctcaggtgatccgcctacctcggcctcccaaagtgctgggattacaggcgtgagccaccacccccagccaagacactgttcttctatcccatgagcaacgaaaactgaggacccgagctggggaagggcaagaggagtgaagagggaggaatggatgcaatgcccattgccaacggtgatagaatggcctgggcttggtagctgattgcaggatgagggaaagggttttgtcaaaggtgactgcgagattttacccaggttgtgacattataggacattaaagctaccattacaggtgacaaacaggaagacacaggttagaggtagatttggagattgtgagttccttttggatgttttgagtttctggttctgctgagacatcagctgagcatgttgaacaggtgattggaaataagggcctggagctcaggaaagaggtcaaagtgaagatacacacaaggtaatcagcactataaagattaaaactgtaggagccaggggaggagtctcastcccgtaagcccagcactttgggaagccaaggcaggattgcttgagcccaggagttcaaaccagcctgggcaagagagtgaaacccccatctccacaaaaaacgcaatattagccgggcatggtggtgcgcctagagtcccagctactcaggaggttgaggcaaggggatcacttaagcccaagagctcaagtctgcagtgagttatgatcgagccactgcacttcagcctgggcaacagagtgggaccttaaaaaaaaaaaaaaagaaaaaactataggagtgagttgggtgtggggagcttttagagggagttgagaaaacaggactgagaacagaatcttacagaacataaaattttagagaaccaaagaaactggaaaatgaggtgcagacagaatggataagatttaggaactagaagtactggagttgagccagggtggtacattgtgactggaagccaagagaagccagcgttgcacggagggtttccacagcaggatcgagwattgcacagagttaggcgaggtcrttgagactgataggtaagagatcattgtaatttcagctgagtagtggaaatacaaggcaaattataaagaatttaggtggaccgggcatggtggctcacatctgtaatcccagctattcaggaggctgagggagaagaatcgcttgaacccgggaggcagaggttgtagtgagccaagatcgtgccactgcactccagcctgggtgacagagtgagtgagactccgtctcaaaaaaaaaaagaatttttttgatatatttgccaatgaaatgaaggaaaaaaatagggtagtaatttgagggagtggcatgatcaaagcaaacaaatttgttaggattagggacacgtttatatatggaagcagacagaaggagcaagtggagaggaggaactggtgttaacagcaagagagagcataagatgtggagagaaaggatcccagagagatgaatggggaggaaagagsgggggagcatctacccccrggatcccagagagatgaatggggaggaaagagrgggggagcatctacccccgaactggaggaaaagggggtaagaagcacccaagaggccctgttccyggccaggtgctggcccarttaccgagtttatctctgagcaacccaggaggtcagcatcattatactcatttcatagatgaggcaattaagactcagagaagctgccctgccagtaagcatgagatctgggtttcaacctcagccctagtccagagtcctcactccttccctgccaccacaatgtctagttcctgggaatgacagaaggaaagaggagggtgtgktacaggcaggaaggagctctgaacggttcccttatgtttctcctgcaacaggaagctggcagcagaccacccattcctgaaggagatgcaagatcaaggggagaacctgtatgtggtgatggaggtggtggagacggtgcaggaggtcacactggagcgagccggcaaggcagaggcctgcttctccctccccttcttcgccccattggggctacaggtttgattcaaacacacacacacacacacacwctcacactcacactcacacatacacatttacattcagcccctccttggaggcttcattagctttgcctgatcagcgcccaccgaggatgctgaaaagggccactccttcccccggctcttaaagatccaaaccccagacatatgccccctccctggtcagtggcacccagtgagggcagatccctgcgccagatgccacagggaactactggggaaggggaaagtcacattcctgggttttccctcgtggtgctcccattccaaagaggagacatctttactctcggaaagtcatcaggttcatagaggagacacagaggctaaagcccagagaacacaggcttggaaaagccaatggaaataaggaatggtctccatacctctatctattgcatctaaatattcaagggatgatttgggatttggagccaggagtaggggttagtcatggaaggcgtcctgaaagaggtaagcatgggacagatggtgaagaggaagaaggagccagggcttggatggaagctctagggtgatgtacaggcaggagatggagcaggtctgcccagttcccttcatgcatctgaaccaggaactagaactgacctgactagactctactgacctgaaccaggtcactagagggaaaatcagcagaaatgagcacaaggactttgaagtccttcctcagagtccagaccagggacaccactgaaggcttccagcttcttatctccctgaaggctctcagccctgaccctgcacctcccccaactcrcgctcccaatatctcatacttaagatgtccagagattcacaaattctcattgtctaattctagggatccataaatcacaaggaggctgtaaccatccccaaggrctgcgtcctggcctttcgagtgagacagctgatggtcaaaggcaaagatgagtggggtgagcagagacccgcatgttctccccacaagatgagaattacctgcaccagtactgaggcaccctggtcccctcttgcggaaatgtcagagaatgagtaggggggtgtattgtactgtgatccgactgcagccatggagcctgctctggagagaagggtgaagaggctcctggattctgagcatcttctgggtgctgggcactgtggttattgggggagggggtacaaatatgaacatgcactgcctctgctctcaagaagtctgtggccaaaggaggaaacagacagagactggaatggatgatagaaagtagtgttctcatagtagagaatttatcaaggaagaaaagattgcttccagcaatggaggttgaagctgggaattaaatgaagcatttggggtgcaaggtcctagcccttagcagagccctttggcttgagactgaagaagggaatgtggggcagctgctaagtgtcctcccaccctccctcccttgcccttcacagatattccacatatctgcaatgataacatgcaaaccttccctcctggaggtaagtgaaattgcttacgggcttcccacatcttccgccctacccctgacattatctgccaaaatcctccaccctctcctagcttatactataatcccccaaggagcctctgcttttgtttcccaagtccctaagaatacctagcctcaactttaggaaagacagatagaggcatataaatactgtcccagagagatatagaaactgacagacagagacyggaaggcacagtcagaagcagaagtaagacttggagactgagtgtgttcccgaatcatgggggtgratgagctagcataatctccctgtgtttttataatgatcactgatgaaactsccttgaagactgttttagatgaaaaggcaaaaatgggttttgtgctgacagatgtgcattttttctgtcttcagaaaagtcaggagaggagaaggtcatccgtaagtgtttcctttcattccactgaaactttcttgactccaaattttaaaactccagtctttttctttccttctgacaggactgacagggaaatagcagagcgaatctcagcaaataattgtccccgaaacatggcagaaattccaatagcttgggaaaaagcagtggaaaggggggagtctttgcccaggtggtctgacgcctgagacctttgtcctcaacagccttastagcagccaggcacagtgattcacacctataatcccagcactttgggaggctgaggcaggaggatcccttgagctcaggagttcaagaccagcctgggcaacatagtgagacaatgtctctatttaaaaaaaaaawtttttttttggatggagtttcactcttgttgcccaggctggagtgtagtggcgcaatctcagtccactgcaacctccacctccccggttcaagtgattctcctgcctcagcctccggagtagctgggattacaggcacccgccaccatgccctgctaattttttgtatttttagtagagatggggtttcaccatgttggtcaggcaggtcttgaactcctgacctcaggtgatccacccacctcagcctcccaaagtattgggattacaggcrtgagccacggcgcctggccttttttttttttcttgagacagagtctcattctgttgcccagactggagtgcaaaggtgagatctccactcactgcaaactctgcctcccaggttcaagcaattcttgtgcctcagcctcctgagtagctaggataacaggcgcgggccaccacactcggcgaatttttagtatagatggggtttcaccatgttggccaggctggtctcaaactcctgacctcaggtgatcctcccaccttggcctcccaaagtgctgggatcacaggtgtgagccactgagcctggcctagaaaaaaaaaaaaaaaattaagagwcttagtagctataacctgctacacacacatctgcaactcggccgcccagcaactggggccagagccactgagtcacagtaatgccaggaacaaggtagctgggctctcccaggagacaggcaggatgtatttcctcatcttccttagtgtctcaacccctgggtatggctgccattctgaaggattgcattcttatcttttttttttcctttttttctcagttatccaggcatctgatgttggtaaggaactttgtgagtttctcccaagactttggcatggaggtagcattaggggcagagagaggagaaggcgaagtcattctttgtcagctaactcatgggaagggaaaacagactttctttctccactttttgctggagtctcaaagaaaagtcaagtgtgtactgatatgggataaggcctgggatctcaggaagattaactgttgggttagatgatacatgcatcctggcccaccttctcgccccaaccctcaggttagggttggtggatagttctgtcacygcattccttggtaaagaaaaatggggccaggctcaaactggggggtagagcatgggtacctaaagggggctgagtgtaggagccctgcagggggaatgctgactggagaggaaggtgcccgayggagggctgtgtgtcccattattgtccccmyaggggacgtacacgaaggcttcaggacactaaaagaagaagttcagagagagacccaacaagtggagaagctgagccgagtagggcaaagctccctgctcagctccctcagcaaacttctagggaagaaaaaggagctacaagaccttgagctygcagtgaggacctagtggaagtggggaagggtgggagaaggcatgttttggtgaagatttggtgggggcgggtattgcagcaggtagggagatctgacgggggcaggaggtgggtggccaggggagtccaccttagataccttccccaaggctggccacgtgccccaaggctgccaggccactgctcctccctttgtcccctggaaaagggyaaacagtgggttcccccaaggcacatgctccctctgatggccagaagggacttctgctggaggggctggaaccttctctttccagagtccaaaactcaggaaacaaggaacccaggagtccagtactcttcaggacatgaggcctcgaaaaagaaatcaggaartggagagagtttccgcatgtcaaggggttattatgtgctgggccctgggttgggccctttcctatgttatcttcaatagtcgcccaccttcccccacagcttgaaggggctctagacaagggacatgaagtgamcctggaggcactcccaaaagatgtcctgctatcaaaggaggccgtgggcgccatcctctatttcgttggagccctaacaggtaagtggggaataaggtcttcatttatagaccttttcagtaataggaatgaatcacttgaatcaattcccaaatggatgaataaatgaatgaatgacaaattataccacagttaagtagtttatatctacatttttataaattggtttcatggctggctgcagtggctcatgcctgtaatcccagcactttgggaggccaaggtggatggatcacccgtgatcaagagttcgagatcagcctggccaacatggtgaaaccccgcctcttccaaaaatagaaaaattagccgggcgtggtggcaggtgcctgtaatcccagctactctgaaggctaaggcaggagaatcgcttgaacccaggagggggagggtgcagtgagccgagatcactccattgcactccagcctgggcaacagagcgagactccatcaaaaaaaaaaaaaattggtttcattcctaaggatttgcttggtcacattgggtagtctgagaagacagcctagtcttgctaatagaggttgaataaccctagttttatcagcaacatatttaaaatttctgcatatagctaagctcatcacttctatcctgatacctgttagctttaacttcagggagtaacattttcttatcttgcccctaagagctcttcttccctccacattttctagttttccacttagaaaaactctgtggtccttcaggtgtaagccaaaacgtttgttcccttaggaagcctgccctccgactccaagaccaaagtggacccctcagctatggctcccttaacacctgcgttgtaattacatccaatgaatgaaggctgaaattctggaagtgcgctatttggaggctgtagtcccctctgcaccagcaacacacatctttctctgctttttytctccagagctaagtgaagcccaacagaagctgctggtgaaatccatggagaaaaagatcctacccgtgcagctaaagctggtgagggaaaaacagcagatgctggggagagtctgggagtagctgcagccagtggagatgcagatttcgcctaaggatggagccattctggaggatccctgtcttatcccaggggcttatgcccactcctcctttctctctctatttctcattttttgttatttcacaagaggtagaagactgaatttctgggcaataatctgggtttattagcctgatcttgggagaagagacagaaactgtggctttgcttattcctagccaaatattgtaagcaaatttttttttttttttttttgagatagagtttcactctttttgcccaggctggagtgcaatggtgcgatcttggctcaccacaacctccgcctcccgggttcaagcgattctcctgcctcagcctcccgagtagctgggattacaggcgcccaccaccacaccctgctaattttgtatttttagtagagacagggtttcaccatgttggccaggctggtctcaaactcctgacctcaggtgatctgcccacctcagcctcccaaagtgctgggattacaggtgtgagccacctcgcctggcctgtgagcaaattttttactgtgtctgagtctgtctcaatttattcctctgtaaaatggggctaaaaatcaatgtgctgcccactgtatagggctgttcaaagacccagatggggttgtaatgtaaggtaaagtaaggaattctaataaggggaatgtaaccttcttgtgatttttgtgagttaggagaggagagaggtttccagttctttcttttcatgctgttttgattccctccaggtggagagcacgatggaacagaacttcctgctggataaagagggtgttttccccctgcaacctgagctgctctcctcccttggggacgaggagctgaccctcacggaggctctagtcgggctgagtggcctggaagtgcagagatcgggcccccaatatatgtgggacccagacaccctccctcgcctctgtgctctttatgcaggcctctctctccttcagcagcttaccaaggcctcctaatttgccttttacgtctgcttcatgactccctaatgccttcccaacctcgtggtgctgtgtccttaccacctaagggcatttcagagccatcagctgaagacatctgaaatctcagctggtcacccatgataaccaacttccacctgcccaaccatatatcaccccctacccctccagctccgcaacccactaagcccatctgctgatgcttaaattttctttacttttcttttctttttttttttttttttgagatggaggctcactctgtcacccaggctggagtgcagtggcttgatcttggctcactgcaacctccgcctcccaggttcaagcaattctcctgcctcagcctctcgagcagctggaattacaggcacgtgccacgacacccagctaatttttgtatttttagtagagacggggtttcaccatgttgcccaggttggtctcgaactcctggcctcaagtgatctgcccgcctcggcctcccaaagtgctgggattacaggcgtgagccaccgtgcccggcctgtgcttaaatattctaggagtagaagcactcagacttttaaaactatgagccgtttcagcaaaactgagaaaaaaagaagattaattaatttcctatcctaatccctcctacttatacttccccaaaaaacaagctttactggaattaatggaaaatattatgtcaatcttaggaatgatatgtcttttggtgtttttctttaaagaatttatcatacagaaattcttaatttgtgccagaaaaagaaattgttatcatactgcatataaatcatatgtacatgaatatgatgctgtactgtcctcaggcaaactggaaaatgctcagagggtatagaatgtggaatccagatttttttttctgttcaattagttttctttaatggaatctagagtctcaagtgagaagatatcaaagcagtttgtcttcaaagaagagcatttgggagtcccctagctctgggttgagggaaagaccgagagatatatagtagaagcccgaaacaaaaataagacagatttcaaatttattgaacagaaaatgcagatgggcctttaaaaaaaagggggacccaagaataagactaacccaaaactttaaaaactaaattgtgatattatttcacctttctctgttctgccctgaaatttagggttcttgtaggaggaagtagtgtgggtaggcttggcatattactactaatatggatattacaatctcatcaaaccgctgggtttatatcatcctcctctgcctaaaagctgggtttgaacatctttcaccaacctcttttaaagcagtatcaggaccggacaccgtagctcacgcctgtaatcccagcactttgggaggctaatgtgggcagatcgcttgaatccaggagttcaagaccagcctgggcaacagggcgaaaccctatctctacaaaatataccaaaaattagccaggcatggtggcatgtgtctgtggtcccagctactcgggaggctgaggttagaggatcacttgagcctgggaggctgaggctgcagttagccaagatagcaccactgcactccagcttgggtgatggagcgagatcctgtctcaaaaaataaaaataatttttaaaaaagtagttctatgagtgcagtacatgtctgtaatcccagcactttgcaaggccgaggcaggaggatcacctgaggtcaggagttcaagaccagcctaatcaacatagtgaagccctgtctctactaaaaattaaaaaaaaaaaaattaaaaattagctggacatggtggctcgcacctgtagtcccagctactcaggagaaggaggcaggagaatcgcttgaaccccagagggggaggttgcagtgagccaagatcacgacactgtactccctagcctggccaacagaacgagattccgtttaaaaaaaaaaaaaagttttatgagtggaagaatttctctaaggattttggtccgtggagtcagactctcccccagtgtcttagtcaccccctgcccagcctggttccctcatccaccaagaattcatgaccaactgccagaagctttgtgttatgccgccagcctccctgatcctgagcaccttccaaagcctcactctattgctcatggatatactgggttgttatctgctgacttggttgttttctccttgtgatgtaaacttaatagagagatgagctaacaccctaactatctagaagagtaactcctttgattgttaaggatgaacataactcatctgttttcttccttaccattctcgcccaccttcagttgcagatatggtgttatgaagaggttctaatgagtttattccaatgatgattcaaaagtcctgttatccaccccccagccctggagggtgagaggacagttgaggaggaactggtcaaggcatgttccctaaaactagagcacatatctttccagttagcgagtggctgtttaacgcaaggaacatcctgcaatcctatgaaagaggatgcaaaagatatgcaggataccctttatatatgcaaaggaggaggtcaaaacatatttcctgccttctaggtccttacaacagggctagattgtcttgtagggtccgtgaaaggtctaaaactcaggacttccacttatgggagagagaaaagtttcaaggtagggagagagtttttgttttgtgttctaagaaattgggagctatatccttcaccttgtttcaccttccctgcagaaccagtggggcagtcctttgaaaaataagtgggtagggtttcttgtccaatttgcttccccttaggtacaccactaagtaaaccatcattctctccttaggcacaccattattctgttccccatttcacaatgtctgtctggatgtataaaagccctctcaatgggctccctaaagcgtctgccagtaggggctcccaccctctttcctcaacactcccaatccaccgcagcccagagcacagtgtctgcttatctaaccatctgactcccccgtatactacattcttgagctgtttttcacccccctatttgctaaccgtgggccgtacatagggtggacccctatattttgttaaactggagtgattctacgcaaatgcacgctcctacctatcggcactcccagcctgcagaaattgtatgccttatgttcagcactaaactcaaatctaaccaaggaagtccggatcccatagggktcttcctactctccagttcggtttattttaaggccaacagccctagcttcacgtccctccttcacagccttctttccttccctcctgccggatgcgcccggcagccgttgagcacaagcccagcggatctggaaggagaccccgccgcgaccggggaaaattgagcgaacttgggcgcaaaacccgcccggcaactcgtgacgtcatctcgtcccgcgctcggataggctgtacccactccacgctggttgaggcgctcttaaagtcctttgtaacccagattggagcctgaggggacctctcgtggacgcccacagaaatgcactcgagaggaacataaaagcatcacacttaagcgctcgaaagaaagccccacgaacccataaaggctcctccccgctccttcctcgaagctcctccttcatcctgcacctcggctgtggatttatttcccctttgttgactcggccrtcggcctgccgggcctggcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggagggtacggcagcccaggccgggaacgtgccgcgatcgcgggtgacagcgacccctgtgatttggcttcttgctgggaagccacagcagcctccaccaccctcagttctttgggatcacccccagatacctgcttccactggccgacactccgattcaggcccaatgactgaaccttctctccaggctgggaaacactcccctcccatcccctccatccccatatctggggttgcatctatatctaggtcccagtgggcctggggactccctcttttaagtcctcccctctgacctattccgtttatatcccacccgactgattttagcgcctccaatatatgactgattgttcccgctggaaaccagtgtttgtgtctgtgtgtaaacagggccaggatgacctagaatattgactcctgagttttaaaactgtacagcagatttttgttgtcctagctgcctttagcacactcccccgaatgaaccatttcgacctagtatcttgtttcctacttctctaactgaagtgtcccaacagtccccttgctgtctcctcccttcaggtccttactgcccctctgtttctaaagggtttaagtacatacacacttaaaacttttcgggtgtcatctttgtttggttttgtaatactcaacctttggcctaaactcctatataccggtgtctcctatttcttttctccgaggttcctgtttcgagtgtctgtagtcctcttgttcctccaagttcatgttttacttttcccacttacagcgtcctgtttccatttgaagtgggcaaagtgagagcttcccactgtgatcctggtgccattttcctggttctggatcaagtgggaccagactacttactaggttttcttttcactaaaatgcgtgagaaactagctcaaaaacattgagataagcaaagttatcctcctaggtggtgcttttgaggatgtgatggtgttgactacatcagctcttactgtaaagttgagcaacaggatcgatatttaatagagatccttttacctaaagtagtggcagcaatgtcaaaggtgccactcagcattgcctactgggtgtgtttattacaggcacttcattttcttcttgtaaagtaattcatattcattgcagaaattgtggaatgtatgagaagttaaaagcaggggataaaaaacatggttaacattttttcttgtgaatttttgagctgttctcctataattgagagcaagttatgtatacagtttgtatcaaggcataactaaatataaattttgaattttatgtgttttcattaacattcgtaaacataatcagcattcaatttattccagaaacatttattgaatacccaatataatggttaagagtacaagttctggaattagttccctcatctgtataaatacaagtaatagtacagtactttattgggttgttgtgaacattaaaatgcttaaaactgtgcctagcacataaatatcagctgttattatttatatcattagtgtggcccagataccctgtgctaatcgctgaatatacagaagtgcctaagaaactactcattgattgcattcccttattgctttgcatttaaactgtttctagtttcttgctatcataaatagctttgaagcaatcatctttgtgcccaacttaaaaaatctacttttctaattatttcttcagtacagattcccaccaaaacctatatgcctgagtttaaaaggctgaacattttaaaggtttttgatagttattgtccagaaaaactgtgctgatttacattataccaggagaaatgtagttttcactgtactctataatttttttttttttttgagacggagtctcgctctgttgcccaggctggagtgcaatggcgcgatctcggctcactgcaacctctgcctcccaagttcaagcgattctcctgcctcagcttcccgagtagctgggattacggtcacccaccaccacgcccggctaatttttttatttttagtagagactgggtttcaccatgttggccag

SEQ ID NO: 17741 - DNA, 23073 bp, Homo sapiens
gtctcattatgttgctcagattgatcccaaactcctcggctcaagtgatcctcccacctcggcttcccaaaatgttgggattataggtgtgagctactgtgccaggacttaaattttttttttttttttttttttttgagatggagtctcacactatcacccaagctggagtgcagtggtgccatcttagctcactgcaacctctgcctcccgagttcaagcgattctcgtgcctcaacctcccaaggaagctgggagtacaggtgtgcaccaccacacctggctaatttttgtatttttagtagagatggggtttcatcatgttggccaggctggtctcgaactcctgacctcaggtgatctgcccacctaagcctcccaaagtgctgggattatagaagtgagccacagcgcccagtgtttttatttttatttttttttgagacagagtctcgctctgtcacccaggctggagtgcaatcatgcaatctcagctcactgcagcctctacctcccagattcaaatgattttcccacctcagccccatgagtagctggaactacaggcatgcaccatcatgcccggctaatttttgtattttttgtagagacggggtttcaccatgttggccaggctggtcttgaactcctgacctcaggtgatctgcccgccttggcctcccaaagtgctggggttacaggcatgagccactgcatctggccttaaaaattgtaaatgaacaaaacctgtggtccacttcttcatttttaccatggggaacacttgtgtgtatgtacaacaaggcctctcaaggcattgtttttttttttgtttgtttgtttgtttggtttgttttttttttttgagatggagtttcgctctttgttgcccaggctggagtgcagtggcagtggtgtgatctcagctcactgcaacctccgcctcctgggttcaagcgattctcctgtctcagcctcccaagtagctgggattacaggtgcccaccaccatgcctggctaatttttttatttttagtagagactgggtttcaccatgttggccaggctggtctccaactcctgaactcaggcgatttgcccgtcttggcctcccaaagcgttgggattacaggcatgagccaccgtgcctggctgagggattgtttttaatagtgaaaaacaatgttaaaatgtcagcttccattaatagaggaatggtcacaaaatggagagacaggccaactaaggaatatcatgtaagttaaaaaagtgtgatactactcaggaggctgagtcaggaggatggcttgagtccaagagttccaggctgcagtgtgccactgcactccagcctgggcagcagagtgaggccctgtctctaaaaaataccaaaaaccaaaaaacttaaaaaaaaaaaaaaaaaaggtgagatcacgctctaagtgatacatgatagatctaaagatgcactgagtaaaagaaacacattgcagaacaatatgtataatggaatatcatttatggagaaaaaccagggaacagaatatttctcacagatccataaatatgaatgaatgtaaagtattactaaaagatttggaaggtcaaatacaaaaatgtcaacagtgtttgcatctgaagagtggaggaaggggactggaactgaggatgatgcaataacctaatctaaaaggagctttagcttggtctgtaattttaaatttttttccaaatatatccaggtattacctatagaattcaaaattaattaaaacagttgtaaagagagataaaacaagatctatgggctgagtaaaactggtttgtctaagcagccgctgcctctgccatctccccagcttccatagccttctgggggtgcctctttctctccaaccacacacaggaaatcaggctgaaatcccaactgaattatttcttaaacagcattaagaaacaacatgctgttttgcaagcagtagcagagagggcccgttatcccaccagcagctgggcttcaccctgggggtggggatatttgggaactctaagtgggcagaagagacggcagtggggtgtgagtgtgttggaggcggggagctctctcaaatgactatagtcttgagatgtagcagtcccagcagtgccctccagagcctacccccaggaaggggactggcgggtaactcacatgggacaaagcttatttgaaatccctcccactcccttgagctgcattcccctggttactctgcatgctgagaagagctttgagcctcaaacacacctggcccgacaaatagggcctagatgagggaacgacagaggtgcagacaggagaggctgaccaccttgggataacctcaggtgggtcattattaattggttgaaaacatgtcaagtcatagaacatctctagccctggcacacacatgtgcatccccagacccacccccgggccaaagacaggggctttggggaatccacatcttgggagtgctctcacctctatgtgggtggagcactcagggagtttaaacgtcgttcttggagaagtattttcaaacactcctggcctgattgctgcctgtgaggaagcagagcaagcctcttaacaggtgaatcgctgacatgctgcctgccaggtctctgtgtctgggcctgcctttccagcgcactgtccacactgcaaccagagcaggtgagctctccaaagtaacttggaccatgcacttccgcttcacagacctcatgactccctggggcttcgggacaataatttctcagtaggtctgcgagaatgttgcatcctgggcctctgcttggcccaccagcctcaccctgtccaccctctccctgtgttggaactgagtgaagccgacagtgtcattctctgggcccagaatgctcttcctctgtgtctacttggtcagctttgagacattcttcaagacagtctccagaatcaattcctcaagaaagccttcactgacctcccccagttgatccaagtgctgctcttcgctgctccctaaggtccctgcattggttctgggggtgccatttgtttgcctttctgctcccctctgtgagctccttgaggataaggctcatgctttgctcagtggagaatgctcaatgcccagcgcagcacctgacaagggctcagtaaatacttgttgaaggaatcattgaatgacaagggctcagtaaatacttgttgaagaaatcattgaatgaaaggtcaggaacaggtgtccagaggctactgggtaaagagcactggtttggaagtcaggagactgggcatggagattattctgaactgtgtcacactgctgaccttggtcaagtcgtttccttccctgggctccttctttctcagctctacaataaggggcttgcattaaatatctctcccctgttgagccttgacaattcccttaaaagagcaaaaggacactcaagcatactcaaggttgacaagggtgacaggggacaggtgctctcatgcatggctgatgggaggatgaggtaaaatcttcagcaggccatttgactatcaatattaaaaagccctaaaacacgcatacccaaatacgcaggaattttacttcttgcctaaggaaataattgacgatgtggcgagagatttaactccatggatgcttatcctagtactacttataataatgaaaatcagaaacaactctaagtatctaatgagatagaattagttaataaatcatataaaatagttatatgaaatattatacagacataaaaatgaagtaaacctgtatttattgacacagggagatgctcagactaaaattgttaagtaccgaaagtagatggtaaaacaatatttaaagttcttcttatcaatatttaaaaatatatattatgtttacatataggatatcaaattcttaaatgaggtattggtgagtggtgggattatgggcaattattttccttcctaktgtttatttatgtgaagacaatgataaaccttgaaagaaaaaagtacccacaatctcacttgatgatgagtaattttgatttatttttatttttgcatactcgtgttctcaaacttttcatcagtgaaaattatattacttaaaggattgaaaaatcatttccaaaagcctctaaaattctagagcttgattcacaaagagccactcgaccaacttcacacacagcaagtcactggcagggcaaaagcttggttccccttctcagcaggggacagaatccctggacacactgggaagatattctgggtgttgctgtcccttgtcccttggccaagaggtggtctgggcatagaagacaagagtgggccgggcgcggtggctcacgcctgtaatcccaacagtgggtggatcaggaggaggtcaggagtttgagaccagcctggccaacatgttgaaaccccatctctactaaaaatacaaaatattagccgggcatggtggcgggcgcctgtaatcccagctacttgggaggctgaggcaggagaattgcttgaacccaggaggcagaggttgcagtgagccgagattgcaccactgtactccagctccgccaacagtgagagaccctgtctcaaaaaaaaaaaaaaaaaaaaagagtgggtggcgggaaggtggctgaaggtaggagggggaacctaaatgggacatgggaggcatggttggcacgagctcagcctgaccagggcccagagaggtagactgattcagtcaaaagtcgtagtacttttcctgctgagattggtggcccttttgctgggctttctcaagcaagaaatatcctcttctgtttcagaattattctgaatcattaacccaagtcctcccaactgcactgatcctgtcccagagaggccctgggctgcatcacctaactgatcactaaccacaaccagttctgctctctcctggttcctgaaatccaggagcagatggtggtggggaggaggagtttggagacagccctctaccagaagccaagaagaaaggggagtgaggagggatagaggaagttatcttggtcctgcgcccacagtccccagggtcctccttcctgtgaagcccaacggtctccagccagatttcctgtccccttagccccaccaagaaccagaggctgcccattgggtggctgttggatgcaggttactgttggagtgggggatggccacctgaggccaattgggtcatctttactccaggtctccctttcatcctcctgtcttccctgggggcactctattccctgcaattccttgggctaccagttcctgacttttgttcctttcaaaggaaccctggataaacagtgtaaccagaatttcagaggggttagttgtgtgtatcccctggggacaagcaccggtataggcacacaatggtgagctgagaaatcttgggctggtagtgctaaattcaaaggctggggacaggctggggccagtggctcatgcctgtaatcccagcactttgggaggctgaggcaggtggatcacttgaggtcaggagttcaagaccagcctggccaacatggtgaaaccctgtatctactaaaaatacaaaaattagcttcttgcctaaggaaaaatacaaaaattacttcttgcctaaggaaataattgatgatgtggctagaggctagggcgtggtggcgggcacctgtaatcccagctactcgggaggctgaggcagaagaatcgcttgaaccattgcacatcagcctgggcaacagagcaagataacgtctcaaaaaaaaaaaaaaaaaaaaaaaggctggggacaatgctggcccctcctttcctgccccttccccccatttcaggggcccctctgtgtgtaccttccaaccccagtgggggaggagaaagagttcagtctccaggatcagaccttcctctacctcaccccacccccagcttagaggacataaaagcgcagattgagctaagaggagctgacaatatcaggtgagctgtggaggtggggtccttggaagctggatgacagcagctggcaaggggataagagagcagtgagcccctccctcaaggaggtctggctttatccayagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcaggsstcctggccattctggccacgccccagccctctgaaggtgctgctccaggtaacagttcccaaggtgggagaagatggtgtgttggggtggttgtgttccagagaccccttttctcagagcrggccttcctagctctggggcctgatagggggttggggcccattcctgactttgtgatccytgctctgggcagctktcctgggggaggtggacacctcgttggtgctgagctccatggaggaggccaagcagctggtggacaaggcctacaaggagcggcgggaaaggtggggcacgaggcactgcccagctctgggcaaggatgtcccaggcctttcasagaagcagcaggcagcagggagcttgaaggtgggagagggggactatggggacccatgtggactccctttctgtctgtctgtccctgtgtttctggatgggagaacagcttaaaagccatccttcccaaagccttgcctctgtctggacacccaggtccatatcctttttataaaaggaagccttcctcccacccgtgggcctgcctgcatggtcctgcatgtctgcccctgggctggggctctgctgggtgggtctgtrtcccttctctggccctcactcctcctttctccaagcagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactggtactgttgcccatcacaccccaggtccctgctccactagtgactcctcctagggaccccagccgtctctcagtgatcccctcaacttcttcctccagggagtctcaggagtctccagggctcctcagcctcaggttgcctgggataggaagtgaggcggctcrgctcccccattgttctttcccccggcagatgtgctgacgcccgcccagctgaatgtgttgtccaagtcaagcggctgcgcctaccaggacgtgggggtgacttgcccggagcaggacaaataccgcaccatcaccgggatgtgcaacaacaggtgcggctggctgggggtggctgcaggaaccgggctcagagaggcgtcccggacgccacaagcctcccggtgtcagcgccctgtcctcccctgcagacgcagccccacgctgggggcctccaaccgtgcctttgtgcgctggctgccggcggagtatgaggacggcttctctcttccctacggctggacgcccggggtcaagcgcaacggcttcccggtggctctggtgagcgccggcgggcagagggggcgaggcccggccrcgcggtgcgcggacccaggcgccasstgatctccgtgtcccgcaggctcgcgcggtctccaacgagatcgtgcgcttccccactgatcagctgactccggaccaggagcgctcactcaygttcatgcaatggggccagctgttggaccacgacctcgacttcacccctgagccggccgcccgggcctccttcgtcactggcgtcaactgcgagaccagctgcgttcagcagccgccctgcttcccgctcaaggtggccctgcttcccgcccactgcctgggttgggagaggggagattgtttctggaaggggccatctcccttctgtgcccaggtttcctttcccagacgctgaggaaggctggccctgcctcccttgtgtccacagcactggctgctcagctatgacctgtctccttcctgcgcctgggctcagccagctggcagccagggccgtccatttgctcactgcctctggcaggccaagggagagagggttgttcctccttggctgacaggagtcctgttggtggaatcactggctctttgttaggttgggagagggttctgggaggagaccttctcagtgccccccaagcctccatgctcagtcctgtttccgccccactgagagggcagccccaacccccatcacacagaaagagagagcctgggggtctggtgggtgccgtgggacagggctgggagtgggcagggtggtcgaggcactgctgagtagggaaggaggaggagagaaaggagagagcgcctgagagagggagagacagacaggagaatgtcagggccagagggagagcaggcacagcagagagaaggggagagagacgggcgacgctttagtgaggagggatccgaggcctggcggtgcccagacccaggggttgcccaggttcccagttcagtgttctgctcattaaccctgcacctcagaggctgttgctgatggcgccctaggcagcgatccctttcgggcctccggaggcctctctgcaggttgagggtaccagaggtcctgagggcagggggagatccagttctgcctgggcaccttccttgccctcggtgagccagtctagcctctctctgtgcctcagatcccgcccaatgacccccgcatcaagaaccaagccgactgcatcccgttcttccgctcctgcccggcttgccccgggagcaacatcaccatccgcaaccagatcaacgygctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggtcagctttggggtggggaccagaggtggcataggagatgttccctgttggagccacagtgagtctgtttgtgagcagcttgtgggtttgtacttagagagactgtcctcaccagccattactatcaacttcatgatattaatccagttgccttggtaacaagtcagatggagccagaaaagcagaaaagcaaacaacctctccaaccctaagatggagacccaggcatggctgaggagcctctgtccatcagtccattgctttctctgtcccttttttcccttctggactctggaagacaagagagtcaaatccctcaggggcagggaactaaaggacagagaacgctgtggtgccctcaccctctagagcgacactatccaatgtggtagccactagctgcatgtggcwattttaattttagttattttaaattaaataaacccagtttctcagcggtgctaaccacatttcaaatgctcaattgccttacagtctagtggctccccctattgggtggcacagatgtaaaatattttcatcatctcggaaggttgagttggaccacactgctccaaaatatcccctcctgcgcatcttaattacccataataagagatgatgggattttaaatgtaaacaattggcagttttggagacacaattggggcagtgatggcagccatgaccagacattttccagtgttttttttttttctaagacggaatctcactctgtcacccaggcttgagtacagtggcacagtctcggctcactgcaacctctgccaactgggtttaagtgattcttctgcctcagcctcctgagtagctgggactacaggcgcctgccaccacacttggctaattttttgtatttttagtagagatggtgttttaccatgttggccaggctggtctcaaactcctgacctcatgatctgcccaccttaacctcccaaagtgctgggattacaggtgtgagccaccgcacgcagccattttccagtgtttttaaatgtaaacccaatagtggacctcaggccctttcctctggcctccctctgcctcctcctgatggttcctgctggtctctccctggctgggaccctgggaggaggatccwggwcggactttctgcaagagatgcccgacctcttctgggctagttaggcaagggcagccctccttagccagactcagctgcccacagcctggctttgatgagccccatgtcccaagcctgggtcattatgacctctagctgttcatggatggagatgctgctctcagagaatttcctttccaccagcttctagagctggcaaggactgaccctagtgtcctgaccctagccctctggcccctgcagagaagggttctgggaggactaggggaaccaggggggatctgcttagttttcttgaacagtctcaggtgtggactccacatatctcatgtcctagccctctcccctggggcaggctgcaccattggcatgtagtaaagggcagggctgacaactctgttcaaatggtagtggctttctggagtcctgtgttgagaaggattctgaggttgcatccaattttagcaggaaagagtgctgtgatcgttagctgcatcagacatgggcatggatgtaggctgtgccaacacgcatgcttcttcccagacactccttggaatcaagagaatcaatgaaccaagcagtgttcataagtctcatactttgtaccaggcactctgttaagccccatgtatccatatgtgtgctaggagggwgggtaaaatataaaaaggcacaagccttggtcctgtgctcaaggagctcccagtttcaggtacaggaaagtggcatgtcatgtgttggaagtgatacctattgaatgagcatccccaaccagcagcggccctgagctgaggcagaagctatcattgtggactggggcatcagggaaggcctcctagaggagtgtaaattggggatagtttgaaaagatggatggggaggaggggtgagtaggaggcatttcaggccttggctggggagggggtttcagtggagcaaatcttttctgggatggaggccttaagaatgacagtggcttttgcctccccaaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccaggtaggccgtcttgaacaccrggcacacgggatccagatgtgtccctgcaacatcctagctgtgtgaccttgggcaagttcctaacgctcctgagccttgccttcttcatccatgaggctgtaaggattataatacatatatgaaaacacctttcagatagtaagtgcttgacaaagcctccttcccttccctctccttcttcgcaggtttgctccctgcagtcttctttcctgtgggtctgttattggtgttgggagggttgaatgtttggtttagcgcccaagtagctgttcagtaaattcttcttccctccatctcactgtcactcttagctcctttacccactcacctcttctttttaaaattaaaaaaattatagggctgggcgcggtggctcatgcctgtaatcccagcactttgggaggcggaggcgggtggatcacgaggtcaggagatcaagaccatgctggctaacacggtgaaaccccatctctactaaaaatacaaaaattagccgggcgtggtggcgggcacctgtagtcccagctacttgggaggctgaggcaggagaatggcgtgaacctgggaggcagagcttgcagtgagctgagatggcgctgctgcactccagcctgggtgacagagcgagactccatctcaaaataaataaataaataaaataaaatttaaaaattattattattattttatttttattttttgatacagggtcttaccctgttgcccaggctggagtgcagtggtgcgatcttggctcactgcaacctccacctttcaggctcaagccattctcccatctcagccttctgagtagctgggatttcaagcacgggccaccacgcccggctaatttttgtattttttgtagagacggggtttcgccacgttacccagtgtggtctcaaactcctgggctcaagtaatccgccctcctcgacctcccaaatccctgggattacaggcacgagtcactgtgttcagcccactcacctcttctttttggctctgtcataatccacccaatgtccttagcctcatttacccctggggcaatgttcctggttccgtctctcaacatctggtgcttcawtgcccccaccctctccctcagaggcagaggcagacatacacacactcacacacacacacacacacacacacacactcctagattytggaggagagagttttcggtgctaagggtgagtttttgatttgcactaagaactcaagtgaaattcatttacactccaaaataacttctagactctagaatgtagagtgagactattccatgtcttcacttttcacagggaaaatcatgccagaatgssccttcgttccttcctgcctccctgctttccacaaacctaaactgagccttactgtgggcaggcacttggtgggcactgtgaagaatttcaacaacttcaatttcccttgctctcaaggactttataagatagttgcagaaatgagacattaataacttgaggacaaggaagttatcacaatgactaaaaaagtgatttgctatttagtcctctaaggcagagggcaatataattatccttaatgtacatttgaggaactcaggctcasagaggttaataattggtccaaggtcacccagccagcaagcagtagaactctatttatgcctctcagtgccactctgttaggcccaggtccggtattgtgggaggctattccctgaccatagagggatggaaggggtccccgaagccaagagcaggcagagactctggccctcctgtgctgccaggcggcatttgctgtggaggagtgggtggagaggccattccaaatgacttgtctttagatcatcacttaycgggactacctgcccctggtgctggggccaacrgccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtaagcaggacctaggccaggagcgagtgggctgacagctaaaggtggggtagggatcaccttggctctagggagctagggtggggagcagtytgctttcctcccatcttggagatctggtctgactctctagcctcagttcctctgactctgcttccatatctgataataaacagtggggtggggatggccctcagagggaactggctacttcctatgtgttgtggctcgctgtgacccaggaagccagggcctgggagcatcccaatcttgcaagtctgaatggcataatctcctgagacctatatgtccctggggtcatgtagtgaccggtgaggacctgctcactggggccaccaccttggcaccaggcactgcttgtgcccagccctcttctcgaatcctcctgaccctacctggacttgtccctgactccaatctgagctctgatactgagccagatacttcccctgacctggctcctctggtccccaggtggcattgaccccatcctccggggcctcatggccacccctgccaagctgaatcgtcagaaccaaattgcagtggatgagatcygggagcgattgtttgagcaggtcatgaggattgggctggacctgcctgctctgaacatgcagcgcagcagggaccacggcctcccaggtgaggggctgcaggagtctcccctgatgctcacctcccctgagctgcctcctaggtagcccatcaccccccttcccactctagggtccctgccctctccaaagcatattagaggcactttgctctcaggaagtagcctgaggccaggcccctgccttttcccggacccacctgataaatttccagctcctctcaacctcctttgcatgctgtaattctcatattaggggcatcgtcatcataatgataacccacagtctgaaaatctgtctctgtcatcattccattttgcttcattgtacgttaactctgggggaagagattattattgccttcattttactgatgaggaaactgaggcttgatgagattcagaacctggccaggttctctagccaagtcagtggcaaagctgaaatttgaagccagattagcctaacctcaaagcctgtgcctatgttatggggtagcccatgtggctgaggcttctagacacatttcacctctcatgggtcagagacagacacatcgggctgctctggagggggacaaggagatgtccctattcttggacccagcaggaactgtggcagtttagggtttgccttatggtaggagggcaagagaaagacagagagggtcccagagaggcccagttgtgccccttggtctaagccaaaggtacagggttccttgaggtgaggtccttccctccctctatgaccttggttgtgttgggaaggtgggttttctgggctgctggcgatatgtgaatcttccctgctgtctccagtgacctccccaccttgaagcagagagacctgcccatagccacctgtcccctcccccatgcaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggtgaggaggggcaggcgtygtgggccgctgggtggctgtgggcccatccttgactctcttggagcccaaatttcctcctgtcagttgaaggactggagggagtcagtaattttccagtgtgttccaggaatcctccagatgccctggagtgcccctaatgtgccctgaacctgttgggggtgcagcaaggaaagacctggacccctggttgtaaagggtggaagatagaaaagtgccacccttagctacttcttcccatgggtttcactgtgccaccatgtgggtgtcagtcaccagtgggcagtcccctcccagctttcccacagctccccttagtgtcatttcctcgtggtcctgatgtcttcatgtctagttcttgcttagcctgtactgcacctttgggaaaattagaaaaaggtgcccctctctgggtgggcgaattataaaccacccccaagattctcttccactcctgtggatgcagctcctggccagggcacagggcttcaggagtgtgtgtgggcccgggtccccctccagcatggtgccctggaggccgccgggctaggggtaagggaaaggccactgggcagctgtgctttactctgcacgatgagtggagcatcacttgtgtgaaagcccctgggctgcccaagggcctggggccyycctgtgcttccaggtggcatttgttgtggctttgttatatcctgggagcagcacaagcccatcgatgccctgccagcccagaatatccttgggcacagtgtccatgggtgttccccmtgcaggttttggtgggagaacgagggtgtgttcagcatgcagcagcgacaggccctggcccagatctcattgccccggatcatctgcgacaacacaggcatcaccacygtgtctaagaacaacrtcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtctgaggaggaactggcgcttttgcagaggcttactctgggctctgagcttgaaccagtgtggtctgtgctcagggccctgtgtttctgaaccgagggtgaggatgttggggagttttcctttgagatccgtacgtggagggcagccatctcttggaagcctgggggccggggcatgcggtgcagaccctcctccctcaccttccacccctgccaccctgcagggaactgtggtcaccaagccctcatgtttgttcattgctctagcaaacgtttgctatgtgttcactctgtgtcaggcctgtgccaggggctaggaagtggaggggacaaaatgctgtgtggtaggagagaaagtacagagacctggtgaggaggcaggcccttccccaacaagaggggcctctgcatcctgcatcccagcagcctggcacaggggttcagaggccctcaagacagtggactccttctcattcatgttgcacatggctcctggagaagggagagcagatggctgggcccagaggacagggccagcactgagggaggggaaggagtgtatttccctagtagtcttgcctggagcttgaaccctgcgtctgactggtggactccctccctctcctcttccttctcaaatatggggagggggctggaagtggtgtaggacggtggggtctaatgtactcatggggcccctggtaacgttaggacctcaccatggtaagaagcagcaaaaatactgcttgtcctcatttctgtgatgaggagagggctgctcagaggggtgaagcgactcgtctgaggccttaaagaagtgggtggcagtgccaggctgcagccgaggtcatctggctcctgggctcttcccacaggatgactgggtgtctcccactcccaccccaccagttgggggatctggaggccctggttgggctaatctttcccagggggtcattttaaaagaagaacatatgaatatgtattgggcagaaactcaaggaatgttctggaagtgccccttcagaggcatcacaggatctaaggaccactctagaagagggtatttctcagaagggccactggaaggggtattagcttcagctgcgggagacccaggcttggtttcccttcctgttttatcccttggcaccaccgcctaccgtcccccccgtgtcctctctcttgctactccacggccagtgcttgttttccccaggagccccctgcccctcccctttctctgagaactcttagaaatcccaccaaaccatccccttccacctcaagacccacgcacgcgccatctcagtggtaagacatgtatggcctgtaaacgtctagttacttatttggcagtgattccgaggtctgcttttggagggaacggtgtcacgcctagcatctttagtcagtcatcagatgtttttgagcacttctaatgtgctgtgcaccatgctaggtgccacaggggaccctcggaggcaggctgaagtcctggcccagggagcttacaatctaggtgagaggacaggaagaaagataaaggttaagggccaagacttgtggagggaagaggacaggtaacatccagcaagctggagcagaagggcatctcagcggggctaagtcttgacagaaaggagaagccactggagctgagtgtaagagctgggagggccgaggcagccaccctggggcctgagcaagctgttcatccaggggtatagagaggcccagctgcaaagaagggctgggactgggatatggagctctaagggaccaggtcattgaacttgcttgaaatggccctgtggaccaaagggaactttcctgtgcagcgcgggcccctaattcttcactgaggcccagggtgacaggtccagcttgtcgatggctgagcaatccacgaagtcataggggtagctgttggcccaraatgggtcccgtgggaccttggtgatgcgggtgttgtcacagacaaggcgtgagaaggacattttctgtagagagtccttctgctcgttcgtgaagaccccagggttttcccaccagaacctgcagagacagaagtagagtcactccacagtctggccgctggcccctccccactctgtcacaggggaaggaaagggtcacagggaccatgaaaagccctactcacactgagatccggagtcagcgctcacgcaggaccttgggacacccctcttggagaagggccctgcccttccctccctggctgaggacgcacttgcctgtctccatcacggatctgctggaactgcttgcccaagaggcaggccaggagaggccccacccgacccctttccaccagyggctcagcaatggcccctatccagatgtcgatgttgtcaggggtcccgtagagacccagtaacttcttggccagcatcttgctcttcagcactgtgttcaactcctctagtgtctgcggctgtgagaggtcacagaaggctctccaggaattgtaccctagggtggagagactgaggctgtctcatcccggggacttcctgttcacagcctcctttggggccatgtccactccagctctatcagccctagaaagtctgggcttacagcctttgggatggggaaggagggaatccattgttttttatctgcacttcaatcttaagggggctagttggttaagtcctatgtaaccactaagcaatcatgaaagttatgtggtatgtactatgagtccaggcactattctaagcactgtgcaaataagtaaatgaagaatagaaatgttaagtaatttgcccaaagtcttataactagtaaatggcataggcgggatttgaactcaggcagtctggttcttaattaaattgcctttcatggggacaaaagaaaggtccaacagtcattggtttctctctattgttttcttaatgttttcagggcttttaaactgtttttaaagttagttggtgacctctttttcatttaaggaatgccaagatagtaccagatatatgctcttttctctgcattaggggaaatgggacattctgtttcatagatgaacaaagtgggttttaagaatggcctggggctggacatggtggcttgcacctgtaatgccagtgctttgggaggccaaggtgggagattgcttgagcccaggagttcgagaccagcctgggcaacatagcaagactatgtctatatttaaaaaaaaaaataagctgggcatgtggcacacctgtagtcccacctacttggtaggcttaagcaggaggattacttgaagctaggagtttgaggctgctgtgagctgtgatcgcaccgctgtactctagcctgggcaacagagcaagaccctgtctcaaaaaaaaaacctcaaacaaaaaaaactggcctgacttttgtttcagaattgatcagatgatcagatcctcagggttatagaagagagtctccaggagccctagaaagttagctaaaatttccccagtgcaggccagacttcagacactcaccaggttgcccatggtcccggcaacgctgtgtgttgatggcagccaggtcaaagccatggatcctgtgagttggctggaaaagcttgttgcgcagctctccagtcatcattttattctgtttcatcagcttggatttcttggccagcaggccccgcaccagaggatcaattccacctgccaagggagacccagaagccatgcttaggttgggggaagagtgggaacatcattcatggcttgcctctgcctccaccagacattttctcttagttgaatgtgggtcacctggacatcccaggctggaaggagggagagaagagcacagtgcagcctgaagggtgtgctcagggagacaggggcatccagattgtctgctctgggggtgggcagaaaggggcagtcatgggatgatggcatgaatataaacattgagatattttttggccatgcatggtggctcatgcctgtaatcctaacactttgggaggccaaggtgggaagactgcttgagcccaggagtttgggaccagcctggacaacatggcaaaaccccgcctctgaaaaaaaggcaaaaaaattagccaggtatgggggtgtgtgccttgtaatcccagctacaagggaggctgaggtaggaggatcatgtgagcccaggaggtcaaggccgcagtgagctgagattgcgcccttgcactccagcctgggtgacagagtaagaccctgtctcaaaaaaaaaaaaaaaaaaaaaaaaaaggtatttttaaagctctagttcatggagtcagctttttcttccatatgttctgctgaggaacgttgcataatgggaagaggttgcataaatctcaaggaaatgtccttgacttgctaggctttaagtaaagttaatttcaacacaacatagcctagggataaaggaaagttgggtccaacctctggcacctctatgaagtgaaaaactctagaagagatcagaaaagagcaatttatttaccaaaccctgtagaagtcagagaagcctagggcggggaaaggaggtagggaaatcccagtcatcttagaagccaagaggaaagaaagaatagcttatatttattgatcacctcctgtgtgtcaggaaccattgtagggtgctccacatgtatatctcatttaatgttttggatagcctcgtgagatgggtactattattgtccccattttataaatgaggaaactgaggctcagtgaggtgaattcatttgcccaaggtcatgtaaaagtgcttggaatctgacttccaacccaagtttccctacaataggctgcggagtgggagacccaggtgacagcacttccctgaaagggcataccatctttgaccatcctccaagtgttgaagaagagggtgtggagggggagttctggttctggcccccatggctgataaytctcatccaggcggaacatactagaggggacctccaagtggccaaagcggaaggcgaaggtgaagacattggaaattctgggatccacagattcactgtagccttgatatgggggtatccacttctgcatgtggtcacctarcaaaatgggtaggtagtccctaaaggtgataatctggagggagaataaaatcaagaggaaagggtgtaagaaggtttaaacctctgcagagggaggctgtgaaagagctgcagccaagagtgatgagctgttgaaaaccaaggatggcaaatggatagcatatgtgcccagttcccattcctatgagcatagcagacattgctaatcaatcatgacatttttttctgctgatctcttacgatttgtctcaacataggctctactaatcagtcatttgaatttggcatatgaaacgtactatctttgtcatctttgtgctaagtttatgaccttgatgctaaagtgacagtctttgtgtgtcactttaatgtaacaatgtcagggcaagaggaatgataaaccacaggaatgattcaggggcaactgaggaaagttcatccaatctccagttctgaaagaaatacagaagaatggaaagactggtttctggttttcttttacataaaaacacaatgaactaacacaaataaaaaattttcagaaaagaaaaatgcctccacataacctaataattatattaatttttattcttgtagtctttgtctatatgttaccgacttttacatagttataatcctacagaatgcatacctgtgcattctgcttttttgcttcacattttccacatttctatctagctttcacagtgaggctctgtgtctctttgctcttaacccagtgccataaggagctcaggtgcagtggttcctgttcccctagaaggttgctcagcaacagcaggcagccagggaagtactttcctgccttgcagacagcaccagcagggattgagtgggaagcccccaaacaccagaagagtgaagtagaccagaatagcas

SEQ ID NO: 17742 - DNA, 59110 bp, Homo sapiens
  misc_feature (1)...(59110): n = A,T,C or G, or insertion/deletion polymorphism (see Tables 1-2)
tatagcttaagttaaatgaataaatctcacagggagtaaaataaacttagatgtttaaagaaggtagataatgagaaacaaagggtatgctcatgatctcccaaggcgcaatagttgtaagtatggatgggctgtgaaactgagccaacatctggtgaggtagtcataggctctggtaagttgaaaataaatgaacatggaaagaaaaatacagtaaacatgacaaagttgtcaatgcaaacatgtaatcaataaatggtcatatttaaaaatataacagcccctagaaaagagagttgatgtcttttataatattttttatttgtaaaagtaatactttcttggtttgaaaaaaattatagaaatatatgaagcaaaaagtacatgttctcatccctctgcctctgtgcctcaatcatttccccaaggtaggtatttttttggtgtgtacccttctagatattttctgcaaaattttctattatgcatgtatgtctccatgtatctcttctctatatctatatctatatctcaaagaaatatagaaaatactatctttttttttagtcagtgtgtcactctgtcacccagggtggaatgctgtggtgcaatcatagctcactgcagcctcagcctcctggcatcaagcaatcctcctgcctcagcctcctaaactgctgggattacaggcatgagccaccatacctggccaggaaatatttttgaacagctgatgttcttaggcgatgaaggtatgtgtggaagacacctgatgaaaggccttggtaacaagtactttaaggaagaaaattaaacatctattgaatccttattaccaccatcaccattttacactttatagagcacttccatgagatgatctcatctgagtctcgtaacagtccttaaggtaggtaagaattattattttcattgacaaatgatgaagctgctgcctgaaatgattaaaagataatgctcaaggacattccaaatccttattttcaccaaatcaaggaaaagacaatggaaaagttagtgttgtattggcctgggcatccctttgattacagtcatttaaaacagatttttttttttttaatcatggaaactttcaaacacgtaaaagtagagagaatagtcaaatgaatctttaagtaccactgttcaacttccacagttattttttttaatttttttaaaattatactttaagttctaggtttaatgtgcaggtttgttacatatgtatatatgtgccatgttggtgtgctgtacccattaactcgtcatttacattaggtatatcccctactgctatccctcccccctccccccaccccacaacaggcccaggagtgtgatgttccccttcctgtgtccatgtgttctcattgttcagttcccacctatgagtgagaacatgtggtgtttggttttttgtccttgcgatagtttgctgagaatgatggtttccagcttcatccatgtccctacaaaagacatgaactcatccttttttatggctgcatagtattccatggtgtatatgtgccacattttcttaatccagtctatcattgatggatatttgggttggttccaagtctttgctattgtgaatagtgccgcaataaacatacatgtgcatgtgtctttatagcagcatgatttataatcctttgggtatatacccagtaatgggatggctgggtcaaatggtatttctagtttagatccttgaggaattgccacactgtcttccacaatggttgaactagtttacagtcccaccaacagtgtgaaagtgttcctatttctccacatgctctctagcacctgttgtttcctgactttttaatgattgccattctaactggtgtgagatggtatctcattgtggttttgatttgcatttctctgatgaccagtgatgatgagcattttctcatgtgtctgttggctgcataaatgtcttcttttgagaagtgtctgttcatgtcctttgcccactttttgatgcgattgtttgtttttttcttgtaaatttgtttgagttctttgcagattctggatattagccctttgtcagatgagtagattgcaaaaattttctcccattctgtaggttgtctgttcactctgatggtagtttcttttgctgtgcagaagctctttagtttaatgagatcccatttgtcaattttggcttttgttgccattgcttttggtgttttagtcatgaagtccttgcccatgcctatgtcctgaatggtattgcctaggttttcttctagggtttttatggttttaggtctgacatttaagtctttaatccatcttgaattaatttttgtataaggtgtaaggaagggatccagtttcagctttctacatatggctagccagttttcccagcaccatttattaaatagggaatcctttccccattgcttgtttctgtcaggtttgttgaagatcagatggttgtagatgtgtggtattatttctgcatgttctgttctgttccattggtctatatctctgttttggtaccagtaccatgctgttttggttactgtagccttgtagtatagtttgaagtcaggtagcatgatgcctccagctttgttcttttggcttagatttgtcttggcaattcaggctcttttttggttccatatgaactttaaagtagttttttccaattctgtgaagaaagtcattggtagcttgatggggatggtattgaatctacaaattaccttgggcagtatggccattttcacgatattgattcttcctatccatgaacatggaatgttcttccatttgtttgtgtcctcttttatttcattgagcaatggtttgtagttcttcttgaagaggtccttcacatcccctgtaagttggattcctgggtattttattctctttgaagcaattgaacttccacagttattaacctttgacaaatcttcatataacttgttaagacatggagtccaaaatactgttggtaatgtaaccaaatttggagatcatggagagtaatttatgcagtgtgctttgagtatgaacaatgtatattctgtatgtacaagcccagaaaagtagctggagacaagaagtgcttaaagattaaattaaatttgtcttgggtgaggctattacaatgattcctcatttaagctcatcttgacattattttcaccatcgtaaccccagttcctggttcaatgcctagcatatagtaggtgctcaaaaactgttgaatgaatgagcctgcttagcagtttagatctcagcagcatgaagaagcccatgcattgtagtataagcaacctttgcagaatgtttcttaatgtgtatctggtgctttctatgtccaagatctttactagctgtgttggggcctactccaagtgccttacatgcagtaactcctttaattcttgtaagaaccctatgaagaaggtactattataattttttttgtgtttcatagataagttacttgtaagttggtaaagatcacacagatcataagcggtagatctgggaataaaatccagagtctgtgcacttagctactactctgctgtggcatctgaatagcatctatggaacactcaacacatttggggcactttgctaggtgccttactgttgggttaactcacaaaagtcactcctttgcaatgccagataacgagagggtgctgcacatggaacagcctttctttctttcttttctatcttttttttttttaacagactttgccattttttttgtgaacctaaggcacttctaagtgctgtgtgggagggaatgtggtagactgatttcattgagactctgccaaattctggtcttgcggccatcaaagacgcatcatttcctccaagacttctaaagggggctattaccacgggcctgcaggttctggtttgcattcagaggagacactatcttcttaaatgagacatggaagaggaagtgtcatgaactgtaaataaggctgatagggaattgtttggtgatggggatggagaaaaactgccctctccaaaccaggttccatctcccacccctttatccaactttgccagagtccatcctattttatttgctgagtttactagcaggaagagaggagtttctttaaagattctctcccctccccaaataaatacctcccagataaatatgagtacatctatatagtagagcactatgccaacattgaaaagatggaaggatggagctttgttcgcagccagcttaggcaacatagtgagaccctgcctctatataaaaataaataaataaataaataaataaataaataaataaataaataaaagatggagctttaaaggttgatgtagaacgaatctccagtgtatattataaagtgaaggctgggcagggtggctcgtgcttgtaatcccagcactttgggagactgaggcaggaggatggactgagtccaggcattggagaccagcctgggcaacatagtgagaccttgtctcaaataaataaatcaaatttaaagggaaaaaagccaaggctcaaatagcatttataccaagcaattgtgggaagagaagggtgacatgtctacatacttgtgtttaagaatctgcttggaaaaaaaaggaaacataaaaatgcctctgccaaaagaaaagtcttttcactctaagcctttttgtgtttttccaaaatttttttttgccatatacattcattatatttcagcattaaaatatttcacctgtcaacttggaaaagtaaaagcgtgaatacagtaaatatttaaaaacagatgaagataagtaacaggttacattaattgtatacaatcaatctagtttgaattaggtgtagatataataattctgtgtgtttatcttggtgaagaatggtcctttaggttgtcattaaaaagcacctctgggaggtaaaagacataggcatctggaagattcatatttaatgaagttaggggacatttgatgtcactccccaggtgtggggagatatggacagaaaaccagaaggaacgaatgtggtcaggaaggaattggagttcccctccaaacagctgccacaagaagtccacacacgtggagacagttgtgcaatttggtcacagagtgtcctaggtgcttttgcttcattgctcctccactgaagcacgctggcagctggcctccttcccctgggcctaaggatatcttggctggaagctctgctctgaaaaggggcatggccaaactttcactagggctcttcgttggggagcacgatggacaaaagccttcttggggctaggcaggtcacttcaaacttggagccgccaaatattttgggaaatagcgggaatgttggcgaactgggcaagtgcgttttctgattaagagcaaccagattcagctttttaaactacaattatactggccaaacaaaatacccttatacaaaaaccaaaactactggcaggagtcgctgccagcttgcgacccggcatacttggctgagtatccgcttctcccttgtggctccaaactgctgcagattctcggccacttcagacgcgcgcgatggcgaagagggtcctgcactttgacgcgcctggtgagggagcgctgctcttcgcagcgctcctggtgatgctccccaaatttcggggaccggcaagcgattaaatcttggagttgctcagcgcccgttaccgagtactttttatttacaccagaaacaaagttgttgctctgggatgttctctcctgggcgacttggggcccagcgcagtccagttgtgtggggaaatggggagatgtaaatgggcttggggagctggagatcgccgccgggtacccgggtgaggggcggggctggccgcacgggagagcccctcctccgctccggccccgccccgcatggccccgcctccgcgctctagagtttcggctccagctcccaccctgcactgagtcccgggaccccgggagagcggtcagtgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtaaggagcccactctggaggaggaaggcagacaggtcgggtgagggcggagaggacctgaaagccagatctaactcggaatcgtagagctggagagttggacaggacttgacattttgcgatctttcatttaccagtggggaaactgaggctcagagactggcccaagattacccagcgagtctgtggtcgcctgtgctctagcccagttccttttctaggactctggtttgcgacagggacctcggctggagcgtgtcctgagatgccgacacaccctcaggctcttgggaggctggggtgggaaggcgcctggggttggcaggcaggaggtgcctccgcaggcgagaaaaggcggtgaaaagttgtctggctgcgcgcaacatcctagtccgggcccggggaagaaaaccttgccggaatctcaggccgggtctcccggatcggacggtacactcggttctgcctctttgcgggacccggcccgttgttgtcttcatgctcgaacacacttgcacacccactgtgtgaagtggggtctggagcggagagaaactttttttccttccttggtgcaggacgccgctctccttgcagagcgaagaagggggggaatagggacttgtcctgggggctttgacagcttccccaagggtctccaagtaacagccaactgtcctgcgtaaagcattgcacatctttcaaagcgctgtggtccttggtgtaagcgcatagtcagaagttcaagctccgaaaacctttcctgtgggccttggtacctagctttagtgccattccttcctctccctgccgcctaaaatttccgtctccttcaattaggaacacacacgttcttcatgcaatagctgtctgtcttttcttcctcactttcctttctctctcaaccccttagataatatttctttcctgcagccagtttgctgatatccagatttccaccctttgcagggtgagaaaggggaaagggtcagagaaagaaaaaaaaaaagtcgaataattcagggaaaaaaatttcttactycctaagacaagaatcacatgtcttagaagacactcacacccacatacagtaccaggatcatctgtccatggttactgaattttctttataatgacttggttcaacgggtccagtccaccatggacactcatttgtcccagacaagccctctctctccccctttctgggcagagaatgaaggtctggaacatgtggttgctctgtattccacaaagaagtgagttgcttttaagcctggggtgtttcctagcgtagtagtaacggcaggccggtcgccctgaatataatggtgaacttgcccttttggagtgcattacttgcttaattggattgggctgtaattggtgccatcaaattctagagacagaggcactgttgtttttccttcccgtctttgagctggaagggtaacagtgcacaaattaattaatattggttatgggatttgaacatagaagggctttttattgagtagtagcatrtgtacctcttacagttatttctttagaactttctgaagagtccagctcaagcttgccaatgaaaacgaatgacatttaatggagcaaaaacaaaaaacaaaaaactatgttggtctacaaatatgaatttgaagttattgagagccttgttgaatagatttttgttgtaaacgtgtctctagaatagtatggcatwgtctcagcttcctatgaatgaaggacataccttttcttttttaaaatatttgttacacaggaaagtgtgtctagaatgtgatctgtggcaataaattatgagagaccttcaagagtttctgattttggtagccgagtgggcacagtttattgagaatcatttttactgccatttgttttctcacaagaatgtgcccaaataatggtttttttctcatttggatggcagtgtgaattgtacatcatgttttcagcatctttctcaacctagtgttccccagtcaagtttgaaatctgtgttatccaaatgaattgttttcattttccttttcttagacaaagtgggactccaggtttcattttgcttttaaacattttggttttttgtttgcctgttttgggggcagttatttctttcatattaaaaagtactgtgcaggctgggtgcagtggctcattcctgtaatcccagcacttagggaagcagaggcaggaggatcgcttgagtccaggagttcaagaagtgcctgggcaacatagcgagaccccattctctatttaaaacataaatgtaacccccgttccacgcacaaagtactgtgcaaattaattaaacatgaccacccagaccagcaactgtccaagagtggcccatagaccatctgtggtaggataatttgaaatgcttgttaaaatgcagatttgtagacccagggatattctgacagagtctaaagtcttaagaacaaaactgttctaaacataagtcagtaccaatgccagttaatttctgagatatattgatataacttagtttccagttttttaaaaaccatattattgacttaaaaaccatgatattgaccagttatgtcagtaacttattttgcacatctgtgtggtgtgtgagaacatgtgcagtcacttattcattttgcctgcatttgttcatattgggatcctcagattcaatgcactggatgtttgcactgggtatttacttatactctctctatttattccgtctcatacttcgtcctatttgttcatactctcttatttgcccagcaaggtcaatgccagtttaggcytagggagtcattttttcttagttgatatgacttagaaagcttgggwgcctgcccaacatcaattacttttttaaagctggtattttctaggtcttgatatttattaagaccctagcatagtggacaatttttctttctctcatgctttttcaacacctcatagctcttcacatttagttgacagagaattcagttatcttgctgtagagtgacccatggtgaggaatctatgccatggtacttttctggttcttatcccttataggtaaagacaagtttcttatgtctgaagcttgatgtcaggatgagttcagggctttgatgaataagttcagatctcccaattgtaattcattagcattgcacttaaaaaaatttatatacgtttttaaaaaagggtaatgctaatgaattacaatagagagaaaagtacattagtttgcatgtatgtgtgaaactgggaaaatttttcacgaaaatattcatatactttttaaaaaaagggtaatgctaatgaattacagtagacagaaaagtatattaatttgcacatatgtgtaaaattgggaaaattccacacatacataaaagtatattaatatgcatgtatgtgtggaattggggaatgttttctcttcctcagtttctctcccttgcttttaatgtacagtctttatgagccattatttcagctgtggcagtttggttaccaggggaagcgcactagaaaattgataaaggaaaatgagacaaggtcatagattctctcactcccttcagggtacgtagatgaactatataaaaatccgtctaagtgggattcgttaatcagcaatttagtcaaatgtgtacatcctatgttctataagaaatgtcagtgggtcctttcccaagggagtgagatcatcagatgaaggttcatttggtttcaatgtcccgtatccttttgtaagaccttgaagttggcaatgcaggaaaacaggaactccaccctagctccatgaattgcagaactgttgtgttggtttatgaccatctgcccattcttcctgttatgacacagcttgtgaacttttactgagaatggtgaaaagtaaattcccagttttatacaatgaattgctgaagaggccttttaaagtatagagtatgcattgtttatggaaggtgtttcctattaggtctaactcagtggcaactacattcatttatttaatttgtttctaggtttgcctagtgtttctcttgatctgcccaggctcagcatacaaaaagacatacttacaattaaggctaatacaactcttcaaattacttgcaggtaaggattcattctagatctagatttcttgtgttaagtamctgattgtttattgagtggaaataatttccagtagagcagaattataatagagcttgtagtaattgttcataagtggtgaggtttctaagaactgatgtaataatggaaaatgagaagaattttctctcaaaaattctgtacaattttgctggtgtttttatactattctctgccaacatgcatacacacacacacacacacacaygcacacaaatacacacmcacacccacattccaataaccagtacagccacctggcgtatagtagacatacgctcaataaatatgaatgaataaatgaagttgagggcatacatttaaggaatagagttgaaaaaatttgggactatatttattatgcttggtatgattcttgaacacttattatccctttccaaaaactttgctttataagaaatttattactataattacttaggcagtaatatttaatagcaatttaatatttrgtgggtaatattactgagcgcatgatctacataaataatggacttcgggccctgccttgatattctggaatgcatctttccccacttgctagcaagaagtcatgctattgatttttgataactggagaagtagacttctttgtcaagaagaagaggcctttaaattttgcctttcaacccttaccccaggaygaaagatagaagacccttgggtttaacatagtgatcacacacgaaaggcatggagccttcttaggacctgtgtgtttttggtagagactgtgacaagtggaggtgatgttaccctcctggaagagtgctgggggtccacaaaggaccttgggtaggttattgccattgcttcatacttgttgaatactaagcattaaaccgaatgacatacatctattttagactgcagtataaagaataccctagccccttaccaatacccagcccttgggaaaaaacacagtagcaggtgctgtttctctagctttayttgtttaagacacatttcccattagattttccttttaccgaccctcgataacaaggttatttgaaatccccaaggatcccatgctccctttttaaaactctgcataaacatttcttatgttctgaaaaaaaccatggagtgtgttaaaagtaacttcattgatttagctgcaacttcctggaaattttaagttctttgaatgaagggccaataatgttacattcttcttgatgttgactatcttcttatcttccttggggccttgtagagaaatgctgcagtacaagccatctatgttttaatgcgaggtccttacaaggtcctgagggactcttacttgcacctccttccttcctaacctcacttcttactcccctttgctcactcttacctggctgctctggtttcctggctgttcccttaatactccagatatgcacctgctccagggcctttccatgtgctgtttttgctcctgtaatactgctcttcatgatgttcctatggctagctttatcaagaccacctcctgcaaaattctttactcttttctttgtatcttctatatttttctccatagtactaaacactatcttttatacaataaactttccttactttttaattgcctgttttctccagttagactgaggttccataaaggcattgatttttgtctgatttgttcactgctctttctctagtccttaacaagtttggcacatagtagatgcttaatagatatttgttgaaagaaagaatgcattaattaatggaaaactcaggaatctttataagtgacttctgaagctgagtttataacttttcatcatatgtcaatctgacttgttggtagaagactttgtttttttttttttgaggcagggttgccctcttgcccaggctgaagtgcagtggtgtgattttggctcactgcaacctccacctcccgggttcaagcaattctcatgcctcagcctcctgagtagctgggattacaggcatgcgccaccacacctggctcatttttgtatttttagtasagacagggttttaccatgttgcccagcctggtctcgaactcctggcctcaggtgatccayccgcctcggcctcccaaagtgctgggattataggcatgagccaccatgcctggccggtagaagactgactgtgtctgttgaagagtttatttaagtttcaaaaccaaattttctcttttcttagaaatagcctcacagtctggcacttcatattaatacctccctgaaattaatttttcaggggacagagggacttggactggctttggcccaataawcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaaggtaagtggtgaaataaaattcatttcccacgtctctttaccagttataaaagacaataggctcaaagaagaattgagtacaacaaagggcttgctctaaaggctgtttgccaagaggaatacacacarttcttctctcctgaggctttctctgagaaataagactcattgattctggagcttgggccgtgttacctcttttttgcccagttagtttgggtctgatctttgtttccaaggtaaatctgtgttcactgttggccaytgagacttataaaaagtcttcctatgtttgagaagaaaacctaaaattcttgaaatcgaggaagatttgggggtgaattatggagaaatttctgtggagagataagttatctacagcagagtaggagattttcccaagaatgcataggaaagcattttttgccaagggctctggagttttttgcacataggaacctttttttcttactagtatttcataaaaaacaattcccatactcatgtgcaaataaagacattgcttcagactcttttcaggacaatgtttctttcctttgcttgtttggtctgagatcttggatgatatgctgtatctttctaggatgtgcagtttgggattgatattatgaaggctgacttaacatccatatagtataaaataaatgtcacacatattctgcatttataatgagttatgcattcttttgtgtttcaaaaatcttacactatcttatcttttctgtgaaaacctaacttaactaatgagatccctatgatataaatttaaggaatgtaagggctgcatcatagtttggttggatgtaccaaatatttttcttttcagtgaagataaacagacattttatgtatttacgtatatgcctttttacatcccagagtatttgagacaggtgaagatgacttagacttttttcccagaagcagcttttacagggcaagaatttcatcagctttgggaaacacacttgcatatctctgcttacatttcagtagtgtaatatggtcagtgcaatgaaaaagtggagaccacatcaaaataacctatgccactggattcacaatgtttgagaaatatctttgcccagagtaagcactgtcaaagatagaattctgtgccctcctccttccctccacaagatttgaaagagacaaggctcacatcttggagaatttctggctccttttgacctggcagtcttgagagatgcagctcggtcagaagattgcaaggatttcctgctttcagcctgtctagaaatactacaagatgaacatcccccatatctcattatttacttcttcctaagtcaggaaacttggagacatgtgaaaattcatttcatgagtttcagtaaatattttattttgagaggctgggtggtggtttgggtttcttttgtttatttcctttttttgagataccgaaatagaattgatttactaaataggtttagtcttacgtcaaagggttaatttagcttccaaaggcttgctctgtaagcaagttatgtaatatttcataacatgtggatgaaaggtaggcaatattaagaagtggcaatccctagcactgtttattggtacactgcctgtctttgggtataccattaaattctgcttcctgtctaagcttaaagttctaggagttgggctgtccaagattttggccatgaagttaaacaatgggaaaggaaacactgaagtattctctatggataggtgtttaatgtcccctctggtcgccaccttacttccctagtcttctgaccccattctcttcagcaatggatggagccaggaagtgagccctggcctcataagataatggctatggcatgtggtgggctagattggctgcttttctgtgctttccagctgggaaggaaatcaaacttctgctgttgcagggaattagctgcctttgtcccctgtggtttaattaactctttcttcactttgactgrctattatgaagcactctgagaatgcttgatgrgatgtgttgggcatagcaatgtgaaatgttatctctctgagatttcaagcatgactccacaccacatcatctctatctctgaggaatggactaggtttccagcagcatgttaacattgtatgagtaatgtttgattggccttgaaatctttttttttttttttttttgagacggagttttgctcttgttgcccaggctaaagtgcagtggtgctatctcagctcactgcaacttctgccccccggttcaaatgattctcctgcctcagcctctgaaatagctgggactacaggtgcgtgccatcatgcctggctaattttttgtatttttcgtagagatggggttttgccacgttggtcaggctggtctcaaactcctgacctcaagtgatccacctgcctcagcctcccaaagtgctgggattacaggcgtgagccaagaacccagtcagaatctcttcagttttcttctcagtctttggagtggtgacttttcaaatgtttgtcattgaagatatcaatgactgctaaatgttaaactaaatgcaaaaacaattaaacatggttttagaaagaatcatatccctagtcttcagaatcttaaaatgctcacatgaatggtcctcttgaataaccaaattcaaaagtgttagctgtttcctgttaatctaaagatcctttgggatccattcatttattttcatggaatttacattatttacctaaagagagagcacatgagtattttaaatattagtaaaacttgtcggtaaagtgtatagatttaactttaaattttaaagtaaatattatccttcattttgaaaaaattataatgattaatcttttaaaatgtgaaatctataaaaatatattctgcttgtcaataaaccttgtgaaaggagtcaatctcaattgggagttttttttcaaaatttttatacacacagatatatacacatgcatgtgcatgcacaaacacacacacacacatacacacacaccctcatgtagcacagatatctatcagcagaataatctgtggatgcctttggttgtgtgaggtgtcccttccagtcattcacttgtctggttagagtttaggaacctgaaaaatgaccaacttttctagtaaatactattaactcattaataaaactaaattttcttctagattacagatctccatttattgcttctgttagtgaccaacatggagtcgtgtacattactgagaacaaaaacaaaactgtggtgattccatgtctcgggtccatttcaaatctcaacgtgtcactttgtgcagtaagttgcatctcctccaatcgtctcttaagtttttataattttaagctaatattaagatgggtaacctgtttataatattcacaatgagttttaaggatcctttaggaagggtcaaatgcaatgaataaaactaattagtattcttaaaaataagatgaattcttcagtgatcattgtacatggctctcatttttggtactggattaaatatttgatatgtctttttattacccagagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtaggtaagaggacatttcctttccatatcattaataacatatccttgtattaagatcttggagataacaacatagagtgaagaaggatattgaaaagtataggaactcaggatatggtgttgggcaattcatctgctcttctctaccaaataaacccatgtgcaattgaggttgtctcttttcttgccaagattaaggaagaaaaagaaaactttttaaaaaaaggatgaaagcgaatggtattactcgagcacattttatgaagaattcaatgttcagagcattgcttgctatcaattatttcaattatgactattttatggaaacttcagcaatttgctaaagctggccctactggcctagggctactgaccactgaaagtttactacttttctgtccactgggttacaacatctttgagatctgtgaaggtagtgctttgtaaacctctgttggccattttcctgggagctaccaagtattggtgaggcctgcagggaaaaacaatgtggcatrttttaaagttgcattactttaaaaaataaatctgtgcaaagttataggcttatttgctctctcatgttctrttttttcaatttacttgctctagggtataggatttatgatgtggttctgagtccgtctcatggaattgaactatctgttggagaaaagcttgtcttaaattgtacagcaagaactgaactaaatgtggggattgacttcaactgggaatacccttcttcgaaggtaacgctaatgattcaaagccagacctccaaatacttagataataagccccartgaagtttgcttgagagataggggcctctttggccagataaaatgtaagagccttaaacacacacacatacacacccactcacacacacatacacacacacacaatttaagggaattgcagaacagatagcacccaccaaaaggtgaaataccaggaattttgtcctattctgcaatagccaggctatgaatattagttttctctaggtgattacatctttccacattatgtcatttctctgttctccaaagtttttgatctacattccttttaagggaatttctctttaagaggtggcatgagatacactgctccttaaacagtggtcacatttacttgtgtttctgcagtttatatccatctcactttcaccacgtgaggttttaaaaatcctaattcagttggttccatttatttctcctgaaacaaaatatatttgttgtctgcatgaggttaaaagttctggtgyccctgtttttagcattaaataatgtttaccaaagcccagatttaattctgtgtgttactagaagttattgggtaatgttatatgctgtgctttggaagttcagtcaactctttttttcagcatcagcataagaaacttgtaaaccgagacctaaaaacccagtctgggagtgagatgaagaaatttttgagcaccttaactatagatggtrtaacccggagtgaccaaggattgtacacctgtgcagcatccagtgggctgatgaccaagaagaacagcacatttgtcagggtccatggtaagctatggtcttggaaattattctgtgccttgacaagtgagataatttaaataaatttaggtcacttagtgattcctattttgttcattcagaagatagtttctagtttttcttgttagggaggccacatgacctagaggtcaagagcatagctttgtagtcaggaacttgggttcaaacctcaactttaaagatgagatgtgctgatatacagtaagagttcatttagtattacttattatagttattgctgctattaggattgttactatgataaatagtattagctaaggtagtttttaaattttcattttattgcaaggctgagaggcctacttgaataagcatgagctttgcaaactggggaaacatttagcaatatacagttgacctgtgarcaactcagggattgggggaactcaggggagttcccctaactttccctcctctgcagtcaaaaatccatgtataggccgggcgcggtggctcacgcctgtaatcccaacactttgggagtctgaggtgggtggatcacctgagatcaggagttcgaaaccagcctggtcaacatggtggaaccccatctctactaaaaatccaaaaaattagcctggtgtggtggtgggagcttgtaatcccagctactcaggaggctgaggcaggagaattgcttgaacccaggaggtggaggttgcagtgagccaagatcgtgccattgtaccccagcctgggcaacaagagtgaaactccttctcaaaaaaaaaaaaaaaaaaatcaaggtataacttttgacttccacaaaacataactaatggcctactgttgactggaagccctactgataacataaacagtcaattaacacatattttatatgttatatgtattatatactgtattcttccaataaagctagagaaaagaaaatgttattaagaaaattgtaaggaagagaaaatatatttactattcattaagtgtaagtggatcatcataaaggtcttcatccttgtcttcacgttgagtaggctgaggaaaagggggaagaggagggggtggttttgctgtctcaggggtggcagaggtggaagaaaatctgcttataagtggactcatgtagttcaagtttgtgttatttaagggtcaactgtaattgaactggaattaaattgaactggccttgagaaaatcaccttaattttttgtttattctctttcatttacataaatgtctgagtttacatggtaatttgtrtggcatcctacttataagccttggaaaggattttggagtttatattatgagaatgcatcaatacagtgaaattttaaaaataccttagataatgctatttattagagttgtaatcataaaagtggcaacaactataacaagtatgatttagtgagcacttactttattagctcatctcatctttgaagctgagattggaactcaagttcctgactacaaagctatgctcttgacctctaggtcacgtgrcatccctagcaagaacttgaaaatttcttctgaatgaacaaaatagaaatcactaagtgtcctaaatttatttaaattatttcacttgccaagawgcacttgtcaaaatacacagagagagatgtgctctggcttatgtttttatagaattacttttgttytccagaatacttcagggaaataggggcagaaataaggaggwcagttgggaggctaattgcagttatccaagtgagagttgaggggtggcttagacaagggtagttgaggtggaggtagtgagaggtgatctgcttctggatatattttgaaggtagagtcaacagggtccgctgatcaattcattggttgtggagtataagagaaaaagagtggaagatgactcgagcgttagcatgagcaactgagtaaatgatggtgttatttactgagatggcaaagatcgagaaggcagtgagatttagggaaacagtgttagatatgtttatctggagatgcctgttaaacatccaagtggagatatttaacatatcaacccggaacccagaggagtcagggcagaagataacacatttaggaggtacgtgaatgatactttaaacctgaggctagaggaaggtgtaaataaagaggaggtctgaggactgagtcctggggcctcatggtggaagaggtgtgtggaggctgtcatgggagcagaggagaaggagcacccaagcatccctgggggacttagagaaagctgcacagaggagcaagtgtttgagttgagacttgagcaatcactaggcttgtgggagtgcactagcggggagagaaaagcaaatgcaaacacaggaggtgtgggagaaacacgggaggtgtgggagaagctgaaaagtgacccactgaaagatagtacaggaaatcttggaactgcagctactcagaccctcaaggtctttgacgtttcacttgaaatgaaaaactaaatcaaatgaccatttacagtaagttgaccttttttttttttttattttcttccagaaaaaccttttgttgcttttggaagtggcatggaatctctggtggaagccacggtgggggagcgtgtcaraatccctgcgaagtaccttggttacccacccccagaaataaaatggtaactactggaaataaatgcaaagcatcatttcgtgtgagagcaaatcctttgactatactaattcctgagaattttttttcataggtataaaaatggaataccccttgagtccaatcacacaattaaagcggggcatgtactgacgattatggaagtgagtgaaagaracacaggaaattacactgtcatccttaccaatcccatttcaaaggagaagcagagccatgtggtctctctggttgtgtatggtgagtccattcaattttcctctctgcccaagatttattatgatacattgtcttccaaatcagccaaaccaccgttcctctgcctcctgctgcttcactcatatcatggctgggcctgygtacaaaagtcatctggcgtggtgaagctgaagtgaaacgtaggaccatgtgctctggccatgtttgtttaagaggccgtgtaaatgagctttgtggtggacaaatgcaagattaaagtagtgataccctcgatagctaaatgttgtgaaataagaatgcccacagggacagttgtcaagctaagttatactaccatgttcccctctcatggaattgcccacctggtacacagatgtgtaagacccttctccttagattttgtgcaaagcttctagtttgatrttgtagttgatgtatcagagatgtgcaggcacgttccaactctgaaggcttttgaagttgacactgttggcttggttgggagcttttcttttttcctttttgacaggagttcaggatctgattttgagtctgtaaaggaaagatagtaagtttttgatgtaaagataatttgaactttgttttctgaaactgaaaggtacaaataagtgtttggaatggagtggggagaagggtgccatggtcaagtgagtgtgagaggtgctaaggtgatgtgtagatgtgtaacaggtttctttattgcaggacttcgcagaaccttttatatgctaatgtatattggtattctccaggaggagagacatagagtattcaaggtttaacaaacctatttgaccagagcaccttttttcccctgagcaaattcattaatctctcactccaaacagttcgagaaatgcttctctgttgtaattctttgttcccccttctggtacggcatattaaaacttcaggatattttcccatgacattaaggtgcttccctacgtgtcctgatactcttctgtaggccgctgaacttggctttattattttttttcagggaatattttaaagataggctgggtgccgtggtttgcatctgtaatcccagcactttgggaggccgaggcggatggatcacctgaggtcaggagttcgagaccagcctggccaacatgatgaaaacccgtctctactaaaaatataaaaattagccaggcatggtggtgggcacctgtaatcccagctacttgggaggctgaggcaggagaatcacttgaacccaggaggtggaggttgcagatagccgagatcgcaccattgtactccagcctggtgacaagagcaaaactccgtctcaaaaaaaaagttaacaggttccaaaaaggttgtttagaagcagcataggtgtaggggactggggagaggagaaactggaaagtgtataagtaggatgggaggaggaaatgaacaggaaataaaaacaaaacacggacagcaaatagcccatttcatcagttcatgaagccactaaatattttattcactttagcaaattctctgctatatgaaataaacataaaaaagaagtcaagtcttcaaagcataatctgaggctttaggttgacagtaataaggaaatagttttgactttggagtcaaaaaagaaagaaaggaaaaagggagagaagaaagaaggaagtgagagaagggagaaggaagaaaggggaagagggaaagggagtggaragggagggaggaagagggagagagaatgaaaaactcagatgatggtggcaggaatgcattctctaaagatttacaccttcctttaacatgaggtggtttacgtgtttgggttcagaagtcagagtgtctaggtttgttccaggttttgccgttcgttaactgagtgaccttgggcgagtcatttttttctgtttcatttttttctcacgtataaagctgtggacagtaatagtggttgtgaggattaagtgaatgaattcatgcaaagcacttcaaacaatgcttggcacataataaatgtatttactgtgctatttcagctgttttctgtagccttyccctgatctcctaaacttgagaggacagagagaactatctctgtaatacagatgagaggcacaggatttcaacacttccataaagtcattcagcttgttagtttattattattattagcttattgtcatttttattttatttcgttactttattccttttttttttttttggtagagatggggtctcaccatgtggcccaggctggtcttgatctcctgggcttaagcgatccacctaccttggcgtcccaaaatactgagattacaggcataagcccccatgcctggctagttgttatttttatgagtatcactagaactcaggtctcttgtttccacatctaggtgttcttcgaaaaagaaagtggaagcaaaatcatatgcttaaagaaagtcagctttagttgctaaaatcctctatttcccattcttcaaagctgactgacaattcaaaagttgtttttcccatcttcagtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccaggtgagtaaggccacatgctctttgctttcctgccatcttgcatttcttacagctgagctatgatatgactccatcctaaatggagaagcctaaaccaaaaaaagttttctctcaagaggtagcctgaatctccatccatctttctctgtgtcttacattttaggggatgtctttgcttggagtatcctcctttggggttagctaagctcagccttgttaggttagccgtgaggtacacttctccaaacacaggctatttgctcagtttgctaattgccagtctttggtttttctcccgataccaatcggctggtgaataccacatccctccttcttgtgtgtgtgaagatccatctctcagaggaaatgctgatagatgagaggcagtgatagacccagccccagtcctcagggtctcaggcccagcttatcatgctctgacacaagtccagacatccttagggaaaaacacaacaacagcagccaacccaccaccaccctaagcagtccacttcctgttgttgtttttgaaatggccactatgagcttcttcctcagctgctgatcatttccttcacagagaccatggtcccagagaaattactttaaggagcccagtggcttctaagtttccttgccttcctttgaactaaattaacttgaattgtcttgtcgatccaatttatgaatgaaggtttattcccagaatagctgcttccctcctgtatcctgaatgaatctacctagaaccttttccttcattgtcaatgcctatttttaattggcgccaagtcttgtaccatggtaggctgcgttggaagttatttctaagaacagaataaccaaagtctgaatcttttccttactcttgactctaattaaagaaaaattaaatcataatatgcgckgttatctctttcttatagccawgctgtctcagtgacaaacccataccctygtgaagaatggagaagtgtggaggacttccagggaggaaataaaattgaagttaataaaaatcaatttgctctaattgaaggaaaaaacaaagtgagtttgaagttttaaaatttgaaaatctctctctctttaatggaaggatggtacaataatatgtgaggcatattggagattaataatcaaatagtctggatgattaaatagagcgtattaagtcactttgaaaataccattgacttttagcagtaccattaacttattaatagcttatcagagaaaaataaaaacatctatgacattaaatctatgcatctgtgtagggtgattctgattttataaacatgagaatgaaaaaatgtgtatcatatcatattaaaacacatcattagtttcatggcttccaaagccctttttatataatgtgtgagctccacagcagcataattatacaaattgagtaaatatcccaaacctaaaaaccccaaatccaaaatgctccagattctgaacctttttgagtgccgacatggtgctcaaaggaaacgctcgttggagcattttggattttcagattagggatgctcaactggtaagtatacaatgcaaatattccaaaatccaaaaaaaaaaatccaaaatccaaaccacttttggtcccaagcgttttgagtaagggatactcaacctgcaattgcataaatttgagcgtgtccaaccgctgcagaagtgggaatggcataggcaggttggagtgattgtggagactgctggactgagtgcttgtgcacaaacagccgcgttgtttatggcctgggatttgttttttccccgcacagactgtaagtacccttgttatccaagcggcaaatgtgtcagctttgtacaaatgtgaagcggtcaacaaagtcgggagaggagagagggtgatctccttccacgtgaccagtaagtactcttctctggaggtttgggttggatcactcacacagtgggtactaagctatgtaattccctgttgtttttgccattcatgtgagtggcatggcatttaggaaagaggacttggattgatcattgatgctttcattcataaattamaacttctcaggtatctcctgggcttatgtgaagtcagtgcgtctaactacactggagagagaatggtttcacagatgctttaaaccacaagctctgtgtggtatttacatctcagtcttcagagtctggcacagtgcctggcttattgagcttcagtacatattggtgggcttgctgtggaacagttgatgagggtgggctttatggaggcaatcagaaggacataggagcagtgccctcccaatgctgccgattttgcctgtgcatcttagttttatggataagctttagctgattgtgctgaatggaatattatagccagggctaattcattggcataaatgtagctttcatatcattgagtgttagtgttaatgaagacctaattttaaaattctgttagaattagagattttgctttggatttttaatatattaaacattgygtagagctcatagtggagatgtggtaaatatctgaggaattcgtttacattttcaagtaatgtgtttggccaaataagatattttgggacctgaattgtctagtttgtttgtcaagttgtagtacatcacctggaacggatagagcttcatttcttttggtactttgtagtagtctgaaagcagcaagatgatagtgagctgtaccaagttaaatcaccattcaataactatggcctcttcattttagggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctaggtagggagacaattctggatcattgtgcagaggcagttggaatgccttaaatgtagtgcaattcaggtgctatgcaaagattactgtcctctaggagattatgttgtaaactggtgcacacttcttcacygaaagtccttgaggaagaaagaagctaataataatgaaatgatatatcgaaaggagaaaataacaaaacctgatgatggagtaattcactagtatatgcaagggatattagcttgaaccagggaaacttctgccttatcttgggcatccatttatttaaatagacaaatatttgtggaatgcctgctatgagctaggagagtgtcagaaattcacagtggtaaacatgaaggaaaggaggagaacataggcaaccactgggaagtcacagcacagtgaggtctctgtgtccatgagaacaggaattgttctctgttttgctccctgctatagctctagtcatagagcatagcagcatatactaactgctcaataaggcacctgctgcatgaagagtgggatgatgggctgcgtttaagacctagaagactccatgggaaggaagctacattcactgtctgtacctctgggtcatcccacatgatccagcgtagcccaaggtcaatgggacgatcacttcagtgagcagatagctctgtaaattcctccatagaggcactgtctaccccttgtctaacctcatgccttgtgcaaaagctgggcagccatggctttgtctgtgggaaaatcaggcaaatttggggagcgtctctttgtgccacttctctccattttctcctcttgtggtgtccctttccaattcctaggatatatgtgccctctgttttttttttactgttaggaaggaaattgcccaagtaaattcatctataccacagttttagagggtaacgtcttcatcagaggccttggcgtatttgaagaggcaccttctgacagacactagcataaagttcgctagttttaagactcaggtgtcataataagagatactttggggtcaagtcatccccagcatccttcaagtcacaccacatagatcacatggattttctgttggcttgtctggcttcaaggttatggcagaattgagaaagagatgtgaagtaggctcctggcctagctgtgcccagaaaatatgtgctcgcagttagctgctttgcttccctaaggactcctaacttgttttcctaaaacctattcttagaaataggctagaatccagtacatttgcttagacttcaatgtagtacgmtgttgaggtaatctcattttgctaagtgttgacgtggattttttcagcatgattccttttgatgttcagttggttgggacaagatatttccacagcactttgatgatctgaagaaagaataaatctaaagtgttcttgtacacttaaacaaatactcatgggcttcattttctttaaatccaagacttcccttagggtattgttgttttgtttgtgttttagtggaaatagcactgaactggtcttttagcctcaccagattctgtaaacagttcaactgtttacttagttgcagggacatggacaagtggtttaatgtcgctgaacatcatttatttcatctgtgagataacgctaacagtcctattctgctcattacataagatcactagtgaggaacacaaattgtgtaaacaagttttataagaattgccaaataaatgtaaggcattattggttgaatgatactaaaatttggcacttccaagagaaatttgaagggattctagggtattattkactagaatcttcatgggagggaagttttcacctggggaggctgtgtctaattagaggaaaaatccataaaggtgaccctgaacctttcttttgtgatgggattaccagctagtatcactaatatgaatgttaaaagccattaatctgtttgcagtgtcctgactgacttgtttcatttaactttayccagtgaccagtgtattttcccagaagttaatatatcaacaagttcctttttactaaatttaaactgtttaaaactttgctgataccagaaccatttcaaaagttataattccatgttctgtgattttctttttgtgtgtctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggtaaatagaatttggctatcactcttgggttgcagaactttcccagggatgttatctaaaaagccatattatttcttgatgtaatgtagaaaaaaagcagtattggtgtccatgacctggctcatttcacagacttagaattggagtatggggccctgttgaattttcatgaaagccatataggagattagtcagcagtagatcccatgtgactctacagagttagataatagaacaagatgaagggcagcatttatattttctaaatttccctgaaaaacttcacagactacatcatcataaatgagaatgatcgttttcttcctctgttaggcattgtattgaaggatgggaaccggaacctcactatccgcagagtgaggaaggaggacgaaggcctctacacctgccaggcatgcagtgttcttggctgtgcaaaagtggaggcatttttcataatagaaggtcagtgggakaaaaaaaaatgtggtacatatacaccatggaatgctatgcagccgtaaaaaggaatctgatcatgtcctttgcagctgcatggatggagctggaagccattatcctcagcaaactaacacaggaacagaaaaccaaacgccacacattctcacttataagtgggagctgaacaatgtgaacacatagacacagggaagggaacaacacacactggggcctactgtgggttggggagaaggagagcaycaggaaaaatagctaatgcatgctgggcttaatacctaggagatggattaataggtgcagcaaatcaccatggcacatgtttacctgtgtaacaaacctgagcattctgcacatgtatcccrgaacttaaaagaaaaaaagaaggtcagtgggaagtcatagatacatcctgtggtttttgaagattagtttgtatcttatagacacacattcactttgaatagggcaacgacagatgatttttaatattctttgtactttgtaaattttctcagtgagtatgtattcttttaaccagcaaacataattaatgttgttataaktctgcttgcatcacatttcctattcctgcagttcttattgtggaaaaattcttaatcaggcaggatgaatagcctcttctccctgattctgtctttgtttgaatggcttgattaacttatagaaatgatgcctttatatttatttggaaaaacattagaattgctgcctaatcatggcagtcaatgctatccagatagtcacaaggattccgagttttaattggactagagataattaagattcacttgtgaacaatagaccattgctcttctgacatggaaaatttttggtttttatctcaatwcgtgtgtatgcagaagtgatgtgaaatctgtcattttcttagctaggaaaagtaatttgtggcagaatattttatcttaagaagtatattcctatggcttttttttttatagcccaccagggaaagaataaaactgtgttgtggggtaaaagaatggtatgcaagggtaagaaagaagtatggtgatagaagggatcgatggatttctatgaactcatcctaacttgtctctcaaagtctagattttggtccctttactctgccaaatctatgatgccargtattgcatcgagatatgttgacatattttcaaatgtataagcttattagcatttcataaactacacttgcaaataaagatttcaaagaccatggcrgttttgtcatttccaaagtgattcatgttttagggcaaatccgcagaatgacgtctagattgtctctgatgctctgcattacctcttgttggtggcctgcagctggttacagatgcctaactaggtaacactggcacagagattatagttacttcttacctggagtgaatgctaagaaaggcagagctagatatttaatactcctgctgggttcccaaatgttatgcgagaatattaatatacaaacacatagaaaacagactctttgaactttttatcctctatgttcaactggacttttaaatctgtgtgtataaatagagaattacttccctaggaccaccagaraaacaaaatttactccaagcataattgtgcttgtctctcaatggttaagttaacttttattttgcaaaccaatttgttacttattttgcaaaccagtttcttacttgtcttcttctctcttgaggccgtagtgggccatccgcacagcktgtggcccggtttgattctccttgcactcttctgatgggaggccccaagtgatgactgcttccttatcatctctttgctaatcactcttagtggaaagcctgtttctgtattttgtttcttccactcagagctgtcctctgaagccctgagcatctgcagctttgcttgctgacttctagtttcctcttctctttcctttcatgagtgatttgaaactcccattaccaggccatgcgtgatgtgctcatcttggctcttcctcttctcctcactcagactcctgccacaagggatggggtagtgtatgtaatggttagttcatgttggacaggcctctttatctcttgactgaaccactgactagctgtgtgccctcagtcaagtagcttaagctctctggtcttctgtttcttcatctgaaaactgagagttgttgaggagattaagtggaatggcatatttaaagtgatgagtgcatagtagatacatggtcattagtaactctcaggtcaaaaaattttgtttatttccctacttggtttcttatgtgatccttttgcaaactctgcacagatcaaaatatygactatcagtttaaaagaagacttttgttttcctcaaatagaaatatttttttttctctgtagagaatgatctgttttctttccatcaaagactgctcttcctctaaacactttctatgtttggcttttaagacattactacttctatgcttaattacttaagaattttattgttgtaagtttacatgagcaatgttttgcaagctttaaattttccattaacaattctgtaggccaggtgtggtggcttatgcctgtaatccctgcactttgggaggccaaggcaggggggatggctagaggccaggagttcgagactagcctgggcaatgtagtgagaccctgtctctacagaaaataaaagaaaaattagctgggcttggtggtatgcacctgtagtcccagctactcgggaggctgaggggggagaatcgcttgagcctaggaattggaggctgcaataagctatgattgtgtcatggtactccagcctggaacatagaaagaaaccctgtctctaaaaawaaataaataaataaataaataaataaatmaataaataaataaattaaattcaaaaaaagaattctgtagactccattcaagttacgggtgtgtaactgttgtcctctaggatttttccaagttggtaagcttgggattttgctttagtgctaaaatttgtcatcttacaaacaaaaagtataagtttccaactgttgatactcattcaattgtgtctttccaggtgcccaggaaaagacgaacttggaaatcattattctagtaggcacgrcggtgattgccatgttcttctggctacttcttgtcatcatcctacggaccgttaagcgggtaaaaaaataatttcccttctgcccatrcacattggttttcatgattaatgaaaactgactggggttctttgagttgtttcttcccattgttattggctcaatgggcacatttttatttcaatacaataacgttcctgcccactttcttttggctggatctcagggatttaattgatagaagccactagagaggaaaagggcttggactgtctagtgtaattaagctttaaaaccttaattctgagctcctttggggracaagggaaactagaagcagggttataataggaccactcycaaactccatgagttttattggaaaatgagacaggaatgaggctccaataaacagcaataacaagcacacaaaacaacagccaaacaacagtgtgtttatgactggaaggattgatgctttccaggccaatggaggggaactgaagacaggctacttgtccatcgtcatggatccagatgaactcccattggatgaacattgtgaacgactgccttatgatgccagcaaatgggaattccccagagaccggctgaagctaggtgcattttcaattgctattaatttgatattgtgtttaccaggccatctcttcctccattagaatgatgacaaatgtggtgtattcagatgttggattctggtttagaaatattaattccatttcttgaatttgtataatcattcatatagccacttagaggtagggtccctatgtaatcatccaaagcaggacatttggagagtgaagggggagttattaaataattaagccaggacaaaggagtaaactggactatccatgttaaattgggatgtatggtcaccctatctagttgatgtctctgcgtatcactttggttgtatagtaatccaagtctgttttcttgttgctgttgttgttgactctaggtaagcctcttggccgtggtgcctttggccaagtgattgaagcagatgcctttggaattgacaagacagcaacttgcaggacagtagcagtcaaaatgttgaaaggtaaaagcaaaattatgtggtgatctatctttctgttttatctagtctttaaatatgttgcaaggcttgtatcagtagctttgtgcttatgtgggcctactagccacacatgcagtcagcctaaataatgcccttgtgcaaattggaaaaaggatcctcctttgtagctttatgccaggatgcatggtctggcaagcaaagttgggaatggctttcaccttcttgcctgrttaccctcgtgcagggctcagccaacacagttgtacttagtggttctgggtacagggaaaaaggactgtggttatattaaaattgtttcttaatatattgtggaatcagatamttatagaccatctagaracatggaaaggaagatagtgaaatacaaaaatagcatgttctccagaattggaatatgtaaaagatgttcatatgtaaaagataatttgcaaaacaagaatggttgtgttagaaaaaaatataatgggttatattttttaaattaaaagctttataaataattgttaattctaatagtaacggaattctggtctggccattttcattttaggaggttagacagtaaagcttctttcttcaattgtgatgttctttcattgatgaaggcagtgccaatgaccctttgccaataggttttgtgcatttcaaagctatctttctccatctgccttttttctcttgtggccaagggagtgtgtaattttgaggtggctcatcasagccttagatgtggaccatgcctgtgaattagtgggaagtgtagcagtccatacaggatcaaacacatagtcttagtgccatcagcctcatgtgccaactggtctttccagctggccttaattcgcctgcacagatcggcacagattggctggaacattcggtatagcccctaacacgtgaagatatttaatacatggtgttgcttccttatgaggaagtgctgaaatgatcagaccctcagaatcatagtgaacctgaaatgcaaaaatccagttttgcagaagaagagaatctgggcatgattccactgcagatgtattctccgctttgcaaaaggtttcacaatgggttcctttaaatatcaaactttctggctcacttaaaatatgaattttatttcaaattagaaaatagaatttacacttcacttttgaggaaatgcatgtggtctgtaaactaggtcacagctgtgttaccccggagggtaagttgtatagtggcatgcagggagggagggaccccaattattgaaggaaatgtcccatacctatgatttccctctttgtactgtatttgtagaaggagcaacacacagtgagcatcgagctctcatgtctgaactcaagatcctcattcatattggtcaccatctcaatgtggtcaaccttctaggtgcctgtaccaagccaggaggtgagtaactgtgggtggttttggtcacccaattttaacatgcctctctgatagtgtttgagggaaagcagtcaactcctctggccttgattttcttagcttagaatactttgcggattcctaggaataaatatatttcatggaggtttaattggcactagaattaaattattgtaaaactttctctgaattaagaaatgtcatgctactatgatacagtttgttacttrwgtaacagatgtccagagaagagtaaacttccctaaaacttgaaagcttaagggtagttacccccaaaatggaatcatatcaggagattgcactgaaaagcaagtagatgggtgggttttcttctgaaattttggttaatcttgtgaaaatgtgttctggaaaaaagaaaagctacaatataaggggattgggaccagctgatttctacactcctgtcccaatgaaaggttgtagccttcttctaaggtgtttttgggttcatcactatattaaaygcttagtgaggaatatragtgaaaacccattttccttcctggacatgctgcctgcagggccactcatggtgattgtggaattctgcaaatttggaaacctgtccacttacctgaggagcaagagaaatgaatttgtcccctacaaggtatgtcatctcctaatcctgctctggccatgttataaaatgaagggaaactcaaaatggtacaggttagttttttagttgaaattttgtgaagaacttgtgaggaatcttctcatattacctcttggctgttgtaacttcctcttttaccttctgggggccatatgtttctgttttatgtatgtgattttaatctactgacccattacagagtgtggacatgggggagaaggcaggtatgagcgaggaaaggggagggcagagggtaggacatctctgggttattctgtctctcccctagccatatttggccccgtggagtgtaaatccctctgtgaagagcatcctaatgctgaaagtgtgtctgaatgcaactcaaaatgtggcatttgtcactttaagctaaagaaggagctaggctttgtggaagaaaccctattatgcacaaaacttgccccaagtttcagctcagagattgcataatcctgaaattgatgtcctccttgtctgctttttagtagwttcaattatctccatggtttactacattttaaaggttgtaaacttttaaagactcattttgtrttcaaggagtttgtttgttcctttgcttttttatagaccaaaggggcacgattccgtcaagggaaagactacrttggagcaatccctgtggatctgaaacggcgcttggacagcatcaccagtagccagagctcagccagctctggatttgtggaggagaagtccctcagtgatgtagaagaagaggaaggtactggctagtgcttcctgcatgctatggcatgctcttgtcagagcagacagggtgatagggtgttacaargaatttgatcatgggraaagtccaatactacctcataatttgaaagagacctgaatttctataatagactgcctccattctgtctccccaaaagtgaagtgtggaagccctagactgggaagtgaagcagggctagcctgagaaatctgggtagtccaagtgggctaagcagtcggctacaaccacagcagtgttcttaaaatactggttcagcatttattagtgagagaggccacaagttttctggtagttgactagcctctccattgccttggagagccccagagtggtttgccccacgttgcatgctttacctgtgcaaaagtcttttcattatacctaaccttctcaaaggcagtttaggagccatctgttgtttctaccctaccccaagcggcttatcaagtcttccttccaaccatacttcctcaggcgagtcttgataaatatcctggcctttattaagttatgtttccagtgatattttatttakttgtttttatgtttatttttatttttttgaggtggagtctcatgctgttgcccaggctggagtgcaatggtgcgatctcggctcactgaaaccttcgccttttgggttcaagtgattcttgtgcctcagccttccgagtagctgggattacaggtgcctkccaccatgcccagctaattttttttttttttgtattttyagtaaagatggggtttcaccatgttrgccaggctggtctcgaactcctgatctcaggtgatcygcctgcctcagcctcccaaagtgctgggattataggcgtaagcctcygtgcctggcctgagtgatattttagtgctctttttgggtggagctgtggtcccagcctaacttccaggacttcagccggctccaggacacactgtatttctgcctccttcagaaggagcagagatagcgttgtggatgtagagatgggtgacaggctggctccccttgaggcataagtctagaagaatagtggaagaaacccactctgtttcccttgacatgaggctacagaragaatttgcatttaactccttttccttagaagctgagaaggtagtgtgaggctgggacttggtctagaagcacatggggaggtggtctaggcttcatttagctgggcccacactgagtggtgctgcctctaccctgctctttgtctttcaaaaaacagtggccagtgagccagaaacctaagagattgagttgttgagaaaaaggctcacagccttttaaatacttacgaatttattactacaactaagtttttgtttactctggtatttgtctccaggaaagaagccataagtcttatctgaccaaagagatgattttgaaacacccatttaatatcttagtgtttatttgtaccagttgcactgaagtaaataccaccaatttacgtaaatttatctttccatgtttctgttatctctcaggaaaaaacaccctcccaggccagatttaatgtatttacagcactttttaagtttgaaaatgaattaaatatatttctagtatttttagttatctattgcagattatagtttgacttttggcctttgtcccaggacaaaacctggagagaagagattcaatgaccctgaatattgttgttttatttttagagttcttgatatgaaactattgtttatccctctgggtacatgacaaaaaacagtgtaagtggcaaatttggaaatgtcctctttatttcccagattayctaggtcagtrttaccttattctacctcctggatttactggttcaatttggctaaaatggaaaaaccagtattgttcctaagggggtatgatgaaggctaatgatactgggattcaggagatttacagaagatagaagcattgactctctgcttctatttcctaaaaacttaactcccaagtcttaaaaagattattactctagcaaacttagaaacatcacactaactcatggaaatactgatctccatcctcctgcctctttggacagctcctgaagatctgtataaggacttcctgaccttggagcatctcatctgttacagcttccaagtggctaagggcatggagttcttggcatcgcgaaaggtaagaaaggttgaggggaaatcagctatcttttcagatcacaggtttggaaataagatgtccagtgtcagccattggtgcttgtttgggattgtaattcattcaccacttctacgtcttttagaagagctctactggggaggctctgtttctgctgagtaagagtggttaaggagttcatgaaattaagctgtataataaaggcttgtcaagcatctactaagtgtgaggcagtcttctgagcactgaggatactgtggtgaacaatcaggcaaagctcttcaccttcatggagtttacagttctagtgggtagagcaaacaataagcaatataaacaagtaaaacgtgttgtaggttagatgagagtaaatgctatggggaaataaagcaagaaagggttatagaatacacaggagcaatgcacttgtgtatgtttatgcttctctgtgtgtgtacatctactttaaacaaggtagacgaggaaggctttactaagaacttgacatttgagcaatgacctggaaaggggaggggctgagccttacagatatcttggcatgagaatcatttttartttattttacattcatcaacatccatcaaaaagtatttgttaggagtataattagaaacgaggaaggacaggcttcagatgagagcgattaaaagagctaaaattagaaaagtaggccaaacaaaggctgagatggggacgtgacaagttacaactattccaaaggttgtaaacaccaagcggggagcaaggctggtggcagtgaytcccctggaaaggataaaaggtgtaattttatattaggtaacaatacttcaaattaaggatcaggaagaactatcagttgacagaatgtattcatgcagcttaatgaagaaagaaagacttaagtcatatttttttttgtttttcctaaattagaatgaaatcttcaacccatgttttccccttctcatagcattaaaggcctcaggctctttgatgtttctgctaggtagctcttatgttctctctcccaaggggaaggaggagaactgggaccttayagggttttcccaaagagaaaggccctttacacttcttggagattatgacttattattaccatttttttatggccggaattcgccacttagtcagggttccttttggggactaggaagagaatggaaatgaatgtgggaatgctttaactttccttacatctaccagactatttcttgaatccacttggttgtcgggttaaaaaaggaaactttttgtttggggggaaaagtcaaaaacactgtctgttttttggaattgccagtgttgctcaattgtgctagataatgtgcttctgaatatgccttgttcagaggagagtgccatacagatttgaggtgtgggaaggtcagcaatgcctggcttacatgatcacttctccaatgatttaagaattctccttttggcyrggtgtgttggctcatgcctgtaattccagcactttgggaggccaaggtgtgtggatcacctgaggtcaggagtttgagaccagcctggccaccatggtgaaaccccgtctctactaaaaatataataattagctgggcgtggtggcacacctgtggtcccaactacttgggaggcagaggcaggagaatcacttgaacctgggaggtgaaggttgcagtgaactgagattgcaccactgcactccagcctgggcgagagtgagattccttctcaaaaaaaaaaaaaaaaaaaaaaagttttcttctaagccattgattcatttcttgtgctccccaagactcattttcttacaaaatatcatgtggagctaaagctgccgagtagtaggaagttagctgaagtttggaggatacagagaaaggagaaactgagaagctaaaaggaagagaaagaagtcaagatgaatctcattgtaytattaatgcactagaaaatcaacctgacttgtgataggctgaaattgccttaatagacctttataataacccagcactttgaaatcaggggaagccacattgggaattgtttatcagagccagtctggcttcagcttcatacggaagggggaaaccaacaaagagcactaaaccaatgagagccccttgtttctgatttccgtgcattcattcaaaaaacaaatcccgttctcggacctccttagaataacacgttttaaaccaaatatggggccaggtaaaaggaatgtgtggatgtgaccagaaacacactcttttgtgtcctagaggagcctatttatgattccatcatcatattataacttaattatttaactccaaaggctggggctgtttatggaataagcagatgtgtgtctcagcaaagctcacagacttttttcctgaagtgttgataaaagatactaacccagtccttgttaatcagttggctttctgatgtgggatttttttttgatgcatgaggtcacaacagatgtgaaagagatcagctgtgccgagacctaatgcacacatgattctctttgcagtgtatccacagggacctggcrgcacgaaatatcctcttatcggagaagaacgtggttaaaatctgtgactttggcttggcccgggatatttataaagatccagattatgtcagaaaaggagatgtaagtttcaaatatgaacccagtgcttggttaagtaacagaattaaaactcctcgtagagagcttcaggacctgtgttcaggaacagaggaagtttttttcttcagatatttgctaatttgggttctgaatccttgtcttctacccctgtaggctcgcctccctttgaaatggatggccccagaaacaatttttgacagagtgtacacaatccagagtgacgtctggtcttttggtgttttgctgtgggaaatattttccttaggtaagtcatttctttttgtccttccatccagactccaaagaggaagacaaaagttgtcttttcctctcctgtacttcatgtctatcaggcaaaacttctcggaagctttgaaaaaaaaaatagatacataggtgatgaggatgtgcaagattcaggctcagggttttctataagagaaaatcaaatcaaagaatgtctcctccctgttttattctaggtgcttctccatatcctggggtaaagattgatgaagaattttgtaggcgattgaaagaaggaactagaatgagggcccctgattatactacaccagaaatgtaagactttaagaagtattcctgtgttctctttctttgctcgcaaattctccttgcctggaagactttccattatatagaccttcttcattgcccagttagtgtcctgcttttactttggggcctttcttgataatttcaagcatggagtcatcacttcttgaaaagatagtactttattattcaaagcaaccagttagtttttattagatgttgctttaaatgttttctatacacattgagcctctggagtatgggactctgtgtcttacacagttttgtatccttatttagcatctcacctcgtcrgctctttacaaatgtgtactcatttaagtgcttattttcagcattcaggaagaaagaggcatttaatgaaatcagtgttttgcttctctaggtaccagaccatgctggactgctggcacggggagcccagtcagagacccacgttttcagagttggtggaacatttgggaaatctcttgcaagctaatgctcagcaggtttgtcacctycatccaagaagcacctacaaagagtacttagatgtcaaggactttcctactgcctgaactgtctcatggctaccatgccatcctctcagccattgaataatctactgtattcttctacatctgagtaataatgcttttctraaagctgtaattacccttttagacagataggattctaatttataacccgggagcagaccactctgatttctacctacttatctttttgttatattttcaaatcctcttctaaagttaaaacaaagaaaaaatctggttgatccacagaagatcaacaatggaagaaatttcaagaaatttttaataaattctgcaggcaaaaatacatctaagctatgcaaaagagatggtttctgtcttggtatcatcccaggttcttataacttccactggaagattttagagttgtagtgtttactattagaatgttatttaatctctagtcaatgcctcttactacaatggaagtgaatttcctctttcttttcttttgaacagctgggggacgataggtcagctctatttttatcaataaaccttccaaacatttacagatatcaaatagccctttatttctttttcttgatgcaataatattaagttgtgcaaccttttctcaaaagacccattttcctacccatttgttgcttttctttagactgtcatcagtttttccattgccttgaaatgtggtggctaaaactggatgccatgccctttgaagggcttggctcgtgtggttagggctttgtgaatgagtgattttttgttctatgtagctccttgtgttctgttgttacctctctgaccacagcctgctttctcttcattgtaactgcacttccctgtgggctgcttacccatcttgtttttagttctctcctttaatataccttccatttcaacagctttttgtttctgacacatgatttgtattgttgtcttaaagttctatgttcagatatgaaagccacacaccctatgtagccaagaagtccctgtgccctttgtttttaatgaaaaggcacttgaagaactgaagccataacaacagtcttctgtgtttattgtttcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcaggtactgtatatggcctaacatcccccgggggagggtgacttcaaggccatctcgggagggggattggaagtggaaggaagaccttgtctaaggctgttgcatcccacttccacataaccttagccctgaggttaacataatggggaatgctcctggaagagggcctgggtaggtgtgcttcctcccatctgtagcccacgctgctgccacagcattgcctttaagaattccaagccctgcagctgcaatagctggaatgccacagtttgctaatttccagaataaagagaygagttttacaaagacatctgcatttaaattatccccgtgtatgcttttattaatgtgaattaaatggcttaggagagattcagaaaggaagagttctgtgcttgcatgagaacatgcttatggctctctggcaaggatacagaaagccatgggtctgtgtccggaattagactggacactgcatctcagaagcccctcccacgtctgattttcagcattttatttgcataatgggatgtctgggcttatttaaaacacatgcactgcagtcctttcctgatttgcagaggggttctaaaggcagctttcttttttctctctcccagcacctgtgcataaggaaagagttggtgtggttttctacaatatgatattaaaattgccctttactaaggctgggactacttcattttgctttgtttctttcctaacccgtttgggtgttttcctgctttaatggaacccctgacagcatgggtccagcctgccagcccgagtgtgcctgggctgcagggaggggcagggagctctctcatgtccagaacttggccaggttgccacatggcaggggatgctaaggagaaactcgtggacagtttgccctctagagtcgtgtggggcagcagaaacactgatgggaaggaagaaagcttagaagccagcaagacagctgaccgttccattgaagtcaaaagcattaggcatgtttttaaagaactttgccgtatattatcagatgttgcccacatcatgacactcagagtcaggcaaggtagaaacaatgatctttttttttgatgtattattgaacatgaggctcagttctattacctgagggcagtacaaacttgtagttaaagatcaggtattagagtcagatagaaatgagtaggacccccaagtctgtcttgtagcagctgtgcaacttggggcaaatcatctaccctctgcctcagtttctttatctgtgaaatgagacaaggtcagtggtgctgtttgaaaatggctgttttgagagttataagatataatctatttctaagcacctggcccttgaaagcactcagtaaaagatacctattaagtgagctgcttaaaatcacatccttgagatgaatccagttcctctgacccctaagtccatgttgtttcctcccatgccaaggagggccctcagagagaawcagtaatgagatgagactacaattccactcctgtgtttacacatttccagttcaagttgagctggccttttagtgtgacagttgttcccacacaccattattgcctccccctttatcrgaaagccatttgatcatgaactacattccatgtgttttctgtgaccaagtagagtgatgatccgagtcggcagcctcctggctcaccgggtgctttgcatatggtgctgagcaggagaagaaatcatgtttgtgtaatggaagcaccaaatacgatgttggatatatagaagggctgctaacgtttatccccagaagcgtggacaaatgtgacaccacactcccagcacaggcctggctcctattttctgtctgtgatttttgaattggtttttccagcccagtttctcttttatccagccataatttgaaaaataaaatggaaattggaatcttttgtctgcatctcctctccacctcctccaccttttttcctttctataaaataaaactcacggtcacattttaatcatctggttttgaagaaaagcagatagaggcatttgcacacggcatgcttcattctgttgctctcctggggttctgtttctctggggagaatgagttgaggctggggtacttctcagggagcttgttctatcctcttacgcatttctggccaagtacaaaagctgagcagtctttctccttctaattttcaattctattgcattataaatagagttggacagagatatcactgtgggagctagcttcatgatttgttgcccctttaaaccatttgaaaaatatttacttagcatttatttagagaaaaggctgagaagtgtgtgggggagggaccactcatgtctagacttagctttgcctctaatttcccctgtggaccagctctggcctcaagtttgcatgcttcctgcaagaaaacacatacttgctgggctcatctttctttgagggcagtttggggaccatcggcaattgctctgtcattttccctgggagtttcacctcacacatcaagcagcttatcaaaaatttctttgcagttctctcttagagaaaggttttggtacataccattttcttcattttgtaattgttagggatgattaaatggcccttgtagattgatgcttggggcagcctgctagctaggtattcctgagtttggctctaccattagactgtttgcagtgggactgtcctttctgcactttttgtctgtttcataccccgtacttacacccctgaccctgctactgcatgatcagtgcatgcatgacaagagaacagtgctgtgcacatactgggtgcttaataatggcttgaacaattgtgtctgctgttttcttctttcttttccctcctgatactcttccaagggagtctgtatggagtagagtaaaacaaaacaaaaacttcacatgggctttagtgtctgaaggcctaagtttgagtcccagttctaccttttattagccattttctccctaatccttgactccctcatctccaaaggggaaatagttaaaagacctgtttctccgtcttaggagaaacagatgcaccattgtctgtgaaaatgctttgtcaatcatgagaggatcatgccatttaaaaaattactggattaagaatttaaggagctgtcctttctaaggcagctgaattattgtccaaactcgccaaccctagttgattctatcccctagatatctctagaatgagcccatgtctccaaacctcatgggcattccctttttctagccaagctgcctttctttctcctgaagaagtgcagtatttgtctcttgggtcttatgcctctagtcttattcttttcaatccagagtcaattctctaaagggcatatctgatcttgtcaatcccatgcctaaaatccttcagtggctcttcattgccctcaaaataataatccaaacattccagttatgtgattttggataagttcctcaaattttctatgccttggtttcctcatctgaagagttgggatagtaatactcacccctagagaggtaccgtggtgaacacatcatgagatgctgcttagacagcwtctggcacagtgtcaggcttgcggcagattatcagtgagggcttcctgaacaagtgaatgcaggaatgattgactacggtaccagtagtgtttgacaactgttacttttaggggttggacttagaaagtaggctttgcttgcaccctgtgtatcatatcctcttaacttgtggagtttcctgagtgaggatgtcaccggaaaatctcattctctcctctctctatagggaggaaccagcctcttggggtaggggagagagaattaatttccattcttctcctttggcccaaggtctatgcagcatgttccagaagtctgcttgtagtgggaagtaggctggtataggaatgaagaatgtattttctgtctcggtgggcccttccagtgaataggacttcccttccctccacttgggctgtaagtgattttgatagcatcaactagactcacccaaagccacacggccgggaaggagcattctcaagaaggagaggatctgttgttcaacaagtcttattctttggactcctgaaggaagctttggaagtcaaaggagaaaaatgagctttgtttgaagagggcattattcttcctaagagcaataagcccaacattctctatgtcattcatcttcccaacatccctgtgagctggggagggagtgctactgccaacacatcttatagatgggacaagagggtcacagaaatattcatgactttctcaagtttctgcagtcagtggtagactctgaaataggcaaaatatcttgttattctcaaaccactgctctttcctgagacagcaactctgggggcgaaaacgaggggacagtgagactcagcccaccttctctttgcacaccaagcctctgttacatggaggaggaagaggttgtcttcaaatcactgctgggttcagtatcctttaaggagaccttcagatgtttcctctgcctatctttcattgaatggttgctctgtgagcattatccagaaaaactttcccaggagatggccagacagatgtgaaacactcagtaatatatccagagctcgatggaggaatcccatgcaatcaggaagccaagtagaaggcagttgatcactccatctgctgttgttgtctttagtccagaactggacctcagaagtaggattcaaaagaacaggctcatcgagactcctcagttatattatacttttaaatgtactttctcaggaaattaagccttccatgtgtgctagcagagaaagatttttattttgttttgtttttctaaaggatgttttgaaggttgctattaagtttgtggttgaaagataatgaacttaggtagccgatctgcagtcaaatataccaccactaaaatataaatatttgttcttttgcagtcagtatctgcagaacagtaagcgaaagagccggcctgtgagtgtaaaaacatttgaagatatcccgttagaagaaccagaagtaaaagtaatcccagatgtaagtacgtcttttaaaaatagtcttagaaataatacaaaggatgaaacactagctagataaatattagcctaagcattaaagttttggagcctcattagaaggctgccctcgagtgtgtgtatcatggggtcattatggagatggaactttgtttttttcataagtaaagcccttggtccaaggttcaagacagtgtagctttctgaccaatttcactaaagtgcaagtagtgtcatagtgaagacagcgatggtaacaggcattctcagctgctgatttgtaaattttctcttctccctggcctgtgtctactcataggaagcagttgcttccttttgtagcttggacaatttgtggctatgatacctttatgttcttccacaggaccttatttgatagacatgatagatgggttgagaaatcagcttaattaaatagttggtcattttatatgctcaattaactgtgccatctcattgtctcttaaaaaggacaaccagacggacagtggtatggttcttgcctcagaagagctgaaaactttggaagacagaaccaaattatctccatcttttgggtaagactcagccayattaaaaagacaaatttcaataggaatttttggaaggaacttaggactttcagtgtaagtgcagaattttccctatggggtctttgttggttggagaaattagcatcaatttaacaaataaagaatggaaactaaccacacaataaaattaagtgataaatctaaaaataatctgaaataaattagagaatttggtcaatttttatgagaattcatgaatactagggaatttctgtgtatatttactgtggtcagtaatggctaaatgaaaaaggtgattggatgtgatccgtaaagctgtcaatatgattacaatctttgtggactctgaagaatttttaagtctgtatacaaatgggtgcatctgtgcttaagaagtatgatatataaataagccaatatctatttgtttgagacatttaaatattattgtctgaattcgaagtatttcattgtgagaaaagtattaaaattagttttaaatataatctcccttctatggctcagtaggaatttgtaggtgtcttgaatacgtgtacgttctcttaacataacaaatcaatgaaaatctatatttataagaataatagaataagtgtagttatgtatttgctggagtttatttgctagagtattcttacctaaaggtaagaatagaggaggttttgatctgcttataatcttttatataaaatgggaatactcatgggtttttgaataatgctcataccaaaaagaaaacaaacaaaaaaaaccccaacatattaaaaggtgccattgtgctattttattgttttctttaaggcccaaggtaagaaattgtgaaagtcaatgatatgtttcattcattgattcaaaaaatgtttattcggcaagtatcatgtgcagagcaccatgccattgcttgagacacctacattagttttgttggggttgaattgaaagaaaaaatkgtatttctcattatttgaagtaacttttaaactatgtataaacacgagttactaaaattcccttttgcagttttaacatgaagaagttggggaaaacacctattaccgggaaaaaacaccttagaatggcttgtgaaagtgtaaatcctgaagttttagatcaacacagcctgcatttctaggctttgacatgattaccgtctgtcaggattccatgccattgaaaacattttctagttgctgctgagtgacwggggttctcagtccttccaaggaatgtggttttgatgagtaaaaagcagcgtttgatatgtctggcttgactgcacacatgcttcaagttattaaagtttaaagttgctcaagagctttattacaaccatacacatgccccgtaattcccaaattgccacaataggaaaagcacaagtgaaatttaagaacatcccaatttccttgaatatcatgcaagtggccctttggygcctgtcactgtatacaaatttgtcaatctgcgaggccataaacatgttccatcagttggggcctttgcataactcgagagaactgcctttcatctcatttgaggcttgaaagacttggacctgagtaagaggacttatctgcaactactaattcatgcgagtacctgaaaatagaccttgtccctgtaaacctgctatgctgattaacaactgggagagatacggggctgcggtctccagggagatggcagccatatggagttgggaatggggtgagggtaaaaagcaaaagaattgtcttctctctgccaactcmtttgtttgccatttcttctgcagtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaacyggtagcacagcccagattctccagcctgacwcggggaccacactgagctctcctcctgtttaaaaggaagcatccacacccccaactccyggacatcacatgagaggtgctgctcagattttsaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctctttttcattcatttaaaaagcatttatcatgccccctgctgcgggtctcaccatgggtttagaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaaggaatccctttgcaaggttgcattactgtacccatcatttctaaaatggaagagggggtggctgggcacagtggccgacacctaaaaacccagcactttggggggccaaggtgggaggatcgcttgagcccaggagttcaagaccagtctggccaacatggtcagattccatctcaaagaaaaaaggtaaaaataaaataaaatggagaagaaggaatcagacataatttccatgtggttgttttacatttttactggttttcttactcttcttataagggatattttcataaactgattatatattttacaaaccaataaatgtatttgtagtacaaagtatgagggtataatatcaccacaactattttgaggataagtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatccctcccacacaccccccaacactttttcatattatattctaagcactttagtagtattgttaaaacagagtatatgtgattccttggccctccagtgaactccatatctgttagaatagccaatcatgaaactcagggggtgaaagaccctgagacaagtgatcagacccatggcagtgcagggaggcatggaccagatttacagtctctaataatattctactctatacttacagagtcagaacataagatccattattgccattttgaatgattaccatcacccaaattcagtaggtggagttatttaataaattattggcccaaataagtgaccttattttttgtgattttttaatacaagattttgaaatgtttatctagtcaaatatgcctctccctatttttaaaaaatggctcctaggttttaaaaaattttattagagaaggtctttccaattctaaacccccaattctaaattttcttcttttattgcatttaaatccatttgggattatttgcatatatggagcaaagtgaaataggagtctaactttattctttttttcaagcagattatcaatcatggcagcactgtttattaaatatccctgttttccctgtggttggcaacaaccctattgtatcattgttcaaaactagcacgtcactgagacgttctgcacagctttgtgatgaagggtggggctgttgctgttgtgtgttcttggggatggcacttccagattggggatgagaacattagggtctcctgaaagacactggtaaactgtgggtcaggctggccttgtagagagttcctcatctgttcctgttgttacagtctctttcagtaaatgaatggaagagtctaggttatttgggatggagaagaccttgtaggaaaacacaggattttcttcactttaagaaaaagagaagattttctttttcataagtggctctggcattgcttccaatgccagaaatttggattcagctgaaacttcacactttattaagaaatgctttcagcacctcaggcagaatgattaggaggtgaggtttggccttcttcctctcttttctgtcttccatgcctcttgttcttagcatttttttttctcctcatttgcccctgtattgaagaaaagtctgtggtttctaaaagtgcttcctgcagggtcttattttcaaagctttccttggaggcttttggtgtgttttaggtggggctactgtttctccctctggcttctgccctccctccttctctcccttgatccacttctgtccttctccctccctttaaaccctcgtctcctcatcttccatttctctctccactcaccttctwctctgcacccccgaccccagcaggagaggtgagagctgtggggaggggygggtttcagttcactaccccggattaggttttcctatcaatgcacattcctttgtcctcttcaacaaaaggacgaaaagcaaaaaaccacaacccacagctttctagttgctgacttaacccaattttcctgtacccccagcatgtctttctttctacctttgactcagatatttatcagcagatgataaaatgcaggcaaacccagaaagctaaagtctttggaaaaaaatagctgttcttacacatctttcctcatttgcatgggcctttcccttaggggcactgggcaagtccatgtattcttgggtatgcagtgagcacagctcaaagggggttctaacacatttttataagattgcgtttcctaaatgaatctcttccatttaaggatttaggcataattaaaaatctgtagcgtttttgtgaaagcaaatttaagtttaacttttggaaaagttacagactgctcttaggtgctaaaaaattaaaatggtaaaatacggtttaccctgtttttgattgaaatggagaaaagtggcagaatctgggaggagcaacccggagagaaattaacagccaagttgacctgaagttctggtagtagaacatactggccccaggagaggtctaactcagagataaggggggagttatctgagttaggaaaaagtattctaatgaagactactgataagacaaggtttacagtaaactgtggttgatatcaagtgaatgttattgagaagacatcaaattgcaccatagattttatttgctttataacgcaacatatgactttcctgtaattacttaatgcctcctagatgttaaattcagcacttttgtgaatttttttgtttaaaaataaaaaaagaaaagaaaatatgtggtttaattttttattttatactcacctgttgtttatgccaagcattttagaacatagaatcagcgtacttaccaaaagctggtgacagtggaccctcatcccttaattgtttgaagctctcaacttttagatattgcaatagaaaaacagaataagaaaatggtttttactctaactttatttcattttttgctctgtttatcttttcctttcttcaggaaataatattttgggggaataaattcaggaaagacaccgattcaaaaaaattttcattacatatttactgtttggtgcaaacgtatacaagagctttgattatctctaaagaaaataaatgggcagggannnnnnnnnnnnnnnnnnnnnnnnnnnnnnnnnnnnnnnnnnnnnnnnnnnnnnnnntcatgatttcagattttagttagaaaacacatgtatttgtagaaaggtccttttgtgggttgagttcttccagttaaaggtactctcacaatgtctgactctgggtctatgcgcagctcacaggatccagacatggaatgactcaccaggagccctccgaacaaaccttaccaggagaggtttaacgagattctggtgctttgcacgggagatctctttaagctgaaataacttatcctgacaaaggggattgaaaacattccattcattgccacagagagaacataactggaatgaaaacccagatacgaggcagagaactcaagctagacagaaagtgaacatcaatatctcatagtcactccccaggttaacaagaaaactggcagacatcccaaaacacatagtggggaaaagcaaggccttccgtagaaaccaagtgtcacgttcagattcagcccttaatactaaacattaagtgagtaatatttaatttatatatatttatttgatcatatttaattgcatctataacgtgcttaaatgcgccagacattattttacagagttggttaatatgaactcatttaagtaattgggaccctaagcaagatgtaggtatcacagtgtagaccacgtgggtaggccagagtaggatgcacaaaaagagtgtcattaatgatttccacaagtgtttgttaaggatttactatgtgccagacaacctattaggcagtggtcaaaattatttccttaggttcatgggttaagggttatcagcagaaccacagagaggaggaaggccactcttattccagaacagtctacatatctttatggtcttaccttgatgaattgagcatagttctcactattggctcagttattctttattcagtcattcttatgtaaagagctgagttcaggaacctctttaagtatcgtaatgcatagatttaccatggaggcacctaagctgactttagagtcagggagctcatgggaaaaacccaggtaagaaccctgttacagaaggctgaggaaattaggcttatttagtctggttcacctcatgttgcaaaatttgcatttcacttgtaaagcaagatgagattgtgttggtgctctggaagaactccgtgttagcagggactgaatggcaacatggaaggaatctttggtgtaatcgttaagcaatgctatattgtcctttttactactgttctgtattttactttactctttttttttttttttttttgagacagggtctcactctgtcacctgggctggagtacagcagtgtgatctcagctcactgcaacctccgtccccccaggttcaagcaattctcctgcctcagcctcctgagtagctgggattataggtgtgtgccactatacccagctaatttttgtatttttagtagaacagggtttcaccaatttggccaggctggtcttgaactcctgacctctagtgatccatccgcctcgccctcccaaagtgctgggattacaggcttgagccacagtgcccatgctgccttttacttttctaatggatgaacatacagagtacagaaagaatacgttctatcatctcattagttttactaggaattattcagtaaggattgtttcatataatgatttttttcttggggatttcaaaaacattatcaagcaacacacacaacacttcacaaatacacctgtttcaccaagcaaagggtacttctgtataaatcaccttgagaatcttttcagcagcctgtacttgagtcaacagaaatgaattttccctcaattcaatcattgtggatagatcatgatgtattgctgtgctgttcccctgctcctctgtctaatatggttggcaaattaccttgaagatctgtcatgaagagagaaaaaagcatcctcattcttctcttatcttcttattcatcagtgaatttcagagtttggtccagctttttttcctgtgaccctttgtactggaggaaggcttattgcttctttgacaaaggagcaaaatgttatgccagaatccattcgtaagttggctcttacaaaattagttaataatgctcacttaaaaaaataccagtgagcattaattttggacaacagatatgctggagcaagtttaatcacagcataatagaatttaaaaataaatatatataatgtacttaatttgcattatttctctctatttcatggtgataggcatctaagtagctctgcagtcactcagacatgagcagctagaagggtggagaactgctattgatcatctgccacatgccaggcatcgagcctcatatattatctcattaaatccttgcaaaggcccttgcattaggtgctgttatcaccatgttacaagtgaagatgggcagttaaggcttgaagcctcagtatgaaaggtcacatataccagcattgaatccagtctactgaagacatgggggacatgttcttacttgagataaaagccaggatgagatctctcttgatggcaggcagtgagctgactcatcctataataaatcaatcagccaaatgacaggtacatattaaggtga

SEQ ID NO: 17743 - DNA, 61718 bp, Homo sapiens
  misc_feature (1)...(61718): n = A,T,C or G, or insertion/deletion polymorphism (see Tables 1-2)
ctggggaatgttggcatgtaagctattcacagttacatagttttgtgttctgtttattgtcgtaacatcagttcttcctgaggtttttcagtagagtaggcttgggccgtggcctactgtagtcccatgtaggatgtcaaatatggttttgttgtgaccactttccttttctgtgctcagggcagacattactaatcaatcacaggctcttttcctaagccgggttgtagctttagaatcctcaatattctgttttggccctgaggaagggcaatccatcccttaccaatgggttcattcatccactccttcattccacaaatacgtagagagcacctacagtggacgggtaccatctcctaggtactggagatattgcaaagaaaaggccatatgtccattactatggagttcacattcttatgggaaataaaggaaataagcaagtaaatgaacaagataatttgagacagccataggctctatgagacaactaaaacagggtactgtagttgagaagaactggggtaactactttggacagagagagcagagaaggttaaggatatactttttgtctgggagctgactgaggagaggcaagtggtttcatgaagagcattccagagatggggcagggcaagtcaaagacgccaaagctgggaataagtttggtttgttccaaggacaactaagaggccagtgtggctggagcagagtaacgagcagggagatgggtagaagaggacgaaaagcacagccgaggaaacaatcaatagattgaagagacagcctacagaattgcaaaccatacatctgataagggttttatatccaaaatatataagcaactcaaacaactctatagcaagaaagcaaataacccaattaaagaatgggcaaaggatctgagtagacatttctcaaaaggagacatacaaatggtcaaatctatgaaaaaatgctcaacatcactaatcatcaggcaaatgcatattaaaaccacaatgagatatcacctcaccctagttacaatagttgttataaaaaaagatgaaagataccaagtgttgacaagatagagaaaaaagaaaatccttgtatgccattggtgggaatgtaaattaatatagccattatgaaaaacaatatagaggttcacccaaaaatttaaaaatagaaccaccatggccaggcatggtggctcatgcctgtaatcccagcactttcggaggccaaggcggacagattgcttgagcccaggagtttgagatcagccttggcaacatggcaaaacctcatctctacaaaaaatagaaaaattagccaggcatggtggtatatgcctgtagtcccagctacttggggagactgaggtgggaggattgcttgagccccagggacttgagactgcagtgagttgagattgtgccattgcactccagcctgggggacagagtgagaccaggtttttttaaaaaaaaagaaaaagaaaaaagaatcaccatatgactcagyattcctaattcctattacgggtatatatccaaaggaaatgaaatcggtatgccgaaggaatatgtgcattgtgttgtttactgtattaccattcacaatagccaagataatgattcaatctaagtatccatgaacaaacaaatggataaagaaaatgtggcatatatccactatggaatactagtcagccttacaaaaaaaaggaaattctgtcatttgtgatgacatggatgaacctggagggcattatgttaaatgaaataagccatgcacagaaagacaaatactctatgatctcagttatatgtggagtctgaaaaagttgaactcacagaagcagagaggagaacgatggttgccaaaagatgagatgtgggagtggaggggtggggagatattgcttgaaggatgcaaaatttcaattagatggaggaataagccaagagatctatagtgccacatggtgactatagttaataacaatatattgtatttttgaaaatctcagagtagattttaagtattcttctttttctttctttttctttcttttcttcttttcttttcttttttcttttttgaaacagagtcttgctctgttgccaaagctggagtacagtggtgtgatctcagctcactgcaacctccgcctcccgggttcaagtgattctcctgcctcagcctcctgagtagctgggattacaggtgcctgccaccatgttggtgaatttttstatttttagtagagacaggagtttcaccatgttggccaggctggtctcgaactcctgaccttaggtggtccacctgcctcggcctctcaaagtgctgggattacaggtgtgagccaccacgcccggccagattttaagtcttcttaccacaaaaaaaataagtatgtgaggtaatacatacgtttattagctcaatttagccactctacaaatgtgtatatattttaaaataacatgctgtacatgaaaatatatataattttttgtctgttaaaaattaattaattaattaattttaaaaagaggagggcagggaatacttgtgtattttgttaactggacaaatgaaactctactttcatttgctcattaaacaaatacttgttttgtgctcagcatgattctaggcactgggactactgcattttggtccattacttccttgcgcacaaaaaccctttcttttcaccacgaatacactatgaacatgtttttttcttcagtgttggcatctcttgattccttccctccaggtctttgtgcgagttttactctttaaaccccagatattgtcatatttttctctgttaaacttttccaaacaactcaaaatagggtaatttcttcttcttctgaatttctctgacaattattctatgggtcatttattaacacagcataatcaaacaacttatttattttcatctttcttgatcctttcttcagttggatgttgtctttgagggcagaggttgtcctctatgttttgaagtctccacacagctcatcgttgccttgcccgtagttgtagctcagtgaaataaaaatctgtccgtagaaggtgatgtctgtgactggtgagccgagagcttgtggggttggtgttgtatttgggtgcatgtgaatcagtgcatctcctgctccattggtgttaaaaggctcccatcgtcctgggaacacaataggaaagagaacaggtgggaaggcactggatgaaggaatgtggagaatggaggaaaagttgatcagattgttgacaactttcagtgttgaaattgtcaccaaaatcaaagtcagtaaataaatttacaatgtccttttcttcaatgcatcaataacttcaccttcctgttcaaagcacagcaagtaattaatctcttatttgcatttgaaacccaagtttcagatgtttgaaggtggttgtaaaaaataaaaaccaaaataaagccaaaataaataagcagcagcactaggccgggcacagtgtctcacacctgtaatcccagcattttaggaggccgaggtgggtggatcacaggaggtcaggagtttgagaccagcctggtcagcatggtgaaaccctgtctctactaaaaatacaaaaattagccaggtgtggtggtgtgcccttataatcccagctactggggggctgagacaggagaattgcttgaacctgggaggcagaggttgcagtgagcagagaccatgccactgcactccagcctgggcgacagagtgagactccgtctcacacttgtggaacccagaacttagtaaccatgaacagaaccttaataaacagaaagttctggaaataaagtttaatcatcatgcaatctttatcactgggttaaatgaacaatcatctgggaacatgtcttggaatgcttaaagctttgagatgcatgtgcctatgtggcagacaaatttcaaatgtgaaacgtttagttaacttggtcttgctttttaatcactgctttaaaatttaaaaaatgctgctggtcaagtaaaaatagcaatagataaaatctgccctgagcaaacagaccatacatcaataaatgaatacttagcttaagcgattttccatgagacccatgaagcatttctaattgaaacttaacaagctacaacccaacagacactccaatcttcacttctagaagggaaatgtgatactccatgtagacgtagctttttaaatttagctggaagacagcgtgacagtgaagttgtgtgctgtaattttttaaaattgctgaagtgtcatggtttgctatttcgtatttattgaaaaaatgtaaatgctatatttaacagaatggcagtaactctgtttcaatctgaagacttaatcttactaatcatggtaatatatgctggctggagttgggaatatttcataaaatactggaataaatttgtgcttatatttcaggggaattaataaaagcaccttcatctgcaacatttaaaatgttattgcctttaaatttgtattaaataatgcagggaagatagatcactgggggagaatggatgcacctctgtgaggatcttggtcattcaacacacgtgtacgggtgaggaaactaaggcacgacttactgggtagggaggtagggatattagcaagatccttcacttgtctgggctttctgtctttgagtcacctttgcgcagtttttcactggacttcacaagcctctgaggcggcagggcagacaggacatccttattttatagaggaggaaacttaggcttacagaggtttcctgccccaaatcacaaaggtggagcctagaccttctcagtctccaccaactgtatttcggttagccacaatcctatctacccacatccaaatggacacygtggctctgcaacttctgtcaaaagggctctttggcaacaggaaaaacgtcatggctccattgtattgtagaggatgggaatgggtgttccggctaaattctccctcccctttccctccacagctcagatggcaaatgtgcgacccagggacctcccgctccagcagacctgtgcgcacaactttgcacagattacctgctaagtcagagccgaaaggtaacacagatgccaaaggataataaaggtgaatgagatttactcaaaattggaaacttggtgtttggtttttcaggagaacaatcaacgactgtgatttgaagttcaccagggtattctgagagatctaatcaaagatagagtgctggtttgaaattattaaaaggtaacagtaaaagggagagcaaaaccccagtcccaacgcaacccataaatctactttgtcttcctcgaaagaggggcgcgggtgggcgcgtctccccgcgagcatctcacctaagggggaatccctttcagcgcacggcgaagttccccctcggctgtcccacctggcagtccctctaggatttcggccagtccctaattggctccagcaatgtccagccggagcttctttgggcctccgagtgggagaaaagtgagagcaggtgcttccccagcggcgcgctccgctagggcccggcaggatcccgcccccaagtcgggaaaagttggtcggcgccttttctccccgacgaagccgctccagggctgctctcagaggacgcgcggcaggcaaagagaatgaacctgagcgtccacgaaacgtcctgcacggctcccgggagctgggagaaacaggtgcctttctccgacgtccgcgggcgacgcctgccgcaccttgcccgctgccgcgcccctcccgggcacccctcgccctcggcgcccctgcccccacccccagtgccagggcggaggcagtcccggctcgcaggtaattattgccagcggagcccgccggggagcgggggtgggcgcgccggcggtgggcgggcgggcgcggcggggcgcgggcataaaggggcgcggcgcggggccccggagcctggctcccgcgcagcatgcccgccagcgccccgccgcgccgcccgcggccgccgccgcmgtcgctgtcgctgctgctggtgctgctgggcctgggcggccgccgcctgcgtgcggagccgggcgacggcgcgcagacctgggcccgtktctcgcggcctcctgcccccgaggccgcgggcctcttccagggcaccttccccgacggcttcctctgggccgtgggcagcgccgcctaccagaccgagggcggctggcagcagcacggcaagggtgcgtccatctgggayacgttcacccaccaccccctggcacccccgggagactcccggaacgccagtckgccgttgggcgccccgtcgccgctgcagcccgccaccggggacgtagccagcgacagctacaacaacgtcttccgcgacacggaggcgctgcgcgagctcggggtcactcactaccgcttctccatctcgtgggcgcgagtgctccccaatggcagcgcgggcgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaacccctacgtggtggcctggcacggctacgccaccgggcgcctggcccccggcatccggggcagcccgcggctcgggtacctggtggcgcacaacctcctcctggtgagtgcgaggggccaggcggagggccacgcaggggagacagagrgcctccacaggggccagggggaagtgtgggaactgagtctcccccagacgaggcttcacttggacacgtgtatgtggtcaccgggggaaactgagcagttctgacttcccttggaaggcgtggaattaggagagaaatcccttagtgggcacacgagtgagtgccccttggagtccatctgtggaaaggaagcggtgataggtttccgcagtgaggaaagaaactcctttctctgggtgtagaggaattcctagaggtgagggcggggaggatttgctaggagtaactgcaggaagagaatgagcagggtggatgaaagaaacacgtttgttcttaagccgcacagatagcattactctctggagctgtcacgagttcagtgttaatccaataagatctgtcttgcttgtggcacaagttcacactgttgtgaaagtgtcaaaacacaactcccggagagtcagatttaaactgtgtttggaggtcccttctgcggcagggcagggaactgcatccaccaatcttattcaccggggtgtgaagaccgctttatacaatctcaaacaaagctagtcatagaaacacagaaacaactgcagggtgatatagattgttctaccacatctrtatttccacagtgctctctacagttgaaagggttcctcacttatgacattgttagcctgataaaattaattgtaacacccttgtgcaaaatattttattaattttgacagcaggaaatattgmtatgccatggtaaagttgtctcaagtatttcttcctccttttttctccttagtgttcaaatttaggcaccattgttttggggattcatttataatcatgtcagttgttagtacactttgtacagagttttgtatcacaataaaatattttatgtacatgtataaacattttaataaaagtgtttaaatgtacaacttttggtacccaattctgatsacttgtgggcctactggaagacttatttttaaatttagaattcagccacatattctgaacaaagtcagtactaaaaccatttctaaacacttttaattaaagccatagataatatggscagagcagtactgggttattgaggtgacttagtgctctgagctgctggtaatgttgtaataatggctaaattagattttatgtcagttccacaaaacctgtttgctgctactggccataaaagaatgttggatttgtttggaaacacattgtgatttttgtgatttcatacttatgtatgtcttttcataaggatgttttagagcggtgattcttatactttttcaayccttttatggatctgaaaaacyctaaagaccaccagtgtatggctggtgatagaaaaactatgggaagaatggtctcactttttgaagaaaacataagcaagttatcagttcatactggaagcaaataaatggatcagctggaggatctaatagatcatgcccataaaatctttactttagatttaaatcctacaagttctatttttagagtccctaggataaacttgcatatacaaagtagtcaattgttattatagtgacttataggatcattttattataagataaagacttgcgtgctctctggtgctctggtgttttaaataatcaacatgttttagatmtttttgcccactcatggccctctgattaacttctcagttatatttttcaatgcttacacaaaaaatttgccaaacactaaccatccttcctagaaatgcagtggactttgtatttagggaaattagtaacaggtgaatgctccattttgctgatgttgcaaacaaactgtyagttggtgtaaagtattaattttgctttcacatttcttttggtttggtgtttagtcattcttgtatcttatttagaagcgagttcccattgtcaaagaaagtatcttgaattaattttgttgtatgagatactttcattctgttttcaatgacctttctcggtgtgtatataggggttgsgggaagcgagaatagaaaaatttgagcttacctgaaaaagataaaacattctgcagattttgataaaagggcattttagctggggcttagatattgctgctgtacagatataggggccagttgtgttccgggatctgatgttggtgaaggataaagactggctagcacccttccctcactccctctgtgtttccactaacttacaaatgggctaaggagatcccctgggatgatgggaagcttgacccctcctagagagtcaagaatcattgatggcctggaggacaggaggcagaacaaacaaacagcaggacaaataatggaggccctgctcagaatggaggtcttggtgttctttgtgggttcctcatactggagtgagccttggcaaaaatggtgtgtgtgtgtgtgtgtgtgtgtgagagagagagagagagagagagagagaggagacagragagaaggagaagaggggagaggggaggagggacagagagagagagaggtctcctacaragagcttggagctcaggctgctttgctcatttgagtgtaatccaggaggatgcaccttttctctcggacttgaagaccaactgctcagccttcacagctcttgaaacaaagttcttaatgtcccctgaaatcagcactagggactgtagttggggagttcagccccagcagtgcctctgagtctttgttctgtatrtgggttctaagaggattagaatcaagttggaaatacacgtgttcccatttcccaccttcaactcccctcaccgcctgagattcttgcaaacatttgtgcaaggaacctgtgaaaaagacttctttcacgtaaggaagtagggctaggagatattaatctgggcattgttgagcattagcatcagtgtgcaggtctcagcccatctgtctgcaatgtttgttgaarccatcacttcttgtcccttgaatccttcctcaacttggatttcaggcyctggctctcccttgcttctcctctcagctccctggcgattccctcttagtctcctttgmttgttcctcctcaccttgcctgtaaatagtggagggctcagggctctgtctagattcactccaggccattgctttgaatactgctgcatcccgatgactggagattttgagtctccacccaggtttccccgagcatcagactggcatagacaaccgccttctccacgtggatgtctaatgggcatgtcacatygaacacatacatcccaaaccaaacccctgcttccccttctctattatgatgactttttactcttccagttgttggaccccgaatcttaactactcccctttttcatgtcttgtttctaatccatcaacaaatcctgcagctctacctacctccaggatgtgtccagaatcaaaccacttctccccttatctatgactacgatggaggtgcaagacaccatccaaccttgcctgggtaatgggaasagcctcactgctggggttcttatttctgccttgccccctgcagtgtgccatgatggatgctctacagggtgacattatgtgtggacaagacagagtccttgctttttcaaatcccacctgttcttctggagccagctaacacgctcccttgggccccatgcctgaatgccatctcttccttctatggcatcctgcacaggacttcrctttgctcagatgcctcctcccgcgctcttccctttatttaaccatttgtctccattttaccccttcgctakctggggtaatcctgttcccttcatctgtatctctgaaaatggcatcttgccctcccttggtgctcagaaggtggcttctggtttaccgaatagcctgatttcacctttataaactcatgctactagaattttctctccttgtcagtctttctagccactttccaatggaacagagactaccaaatcctaatctgataaggaaaaataggtaaacataacgtggcagactctgacatctgcagtgaaaatttaaggttcatcatcaaatgtatgattccattgtgaaaatgtccagttaaaagctatctgtagtcaccatgcagcattatgaagaagttttcagaataagggcaggtggtaaagtctcctggccagctttaggagtatatattggaaggggctttgttagctgattgaatttttattccccaagtaattagtatgagcgatttgtctactgtatatatgctcaaattacatatactatgcacttttgagaaatactttacaagtttttctttcattaaaatgtrtttggggccgggcgcagtggctcacacctgtaatcccagcactttgggaggctgaggcgggtggatcacctgagatcaggagtttgagaacagcctggccaacatggtgaaaycccgtctctactaaaaatatggaaaattcaccagacgtggtggcaggtgcctgtaatcccagctacttgggaggctgaggcaggagaatcgtttgaacatgggaggcagaggttgtagtgagctgagatcgcaccattgcacwccatcctgagcaacaagagcgaaactccatctcaaaaaaatgtattttgtacataactagaataatcaactggattgaaagttaatataaattttagaatactactgaattcaatagtgcatttagtcagaaatagttaaaatatctcccaaacagcttgaatcactcctttttgaacacattgttttttgaaggttacrgtcaagtccaagaaaaaattttaaaataggaaaagaattaatcaaatcatttcaaaatcatagcastgttttaacaatgccaattattttgagttgaagaaaagaaggaaaatgtaaactatgcattcaagtaatgtcaatgcaccttctcaggtgcaaaatgaatgaacaattaactgtgccagctgaatatgtagcaatcacggcttttgcacatagaagccttctgaattatcttatattctcaaaaatatcattgctctaaactagaattttattataattaatttgtgcaaaagttgtctttctttcaatgaatgttrtctttttraggcataaaggaaattttaggtggaggaggagaatagaatacatgcttactgggaggacaagtaataataggtgagtaaaaacacacagcttattgaattgtctcagatccacattttctccagaaatgcaaagttatacttgaaatctatatttaaacagataagcagaatgtgacttttatatgctctattttgatgtattctgagtatgaagataacctgaaggatgcctttttcccctctttatcttggggtaaactcttacttacccttcagagacttgactcaaatattttcattctgcaataaccacaggtagaatggatcatttactcagttgtggctctcttaagagcacagactacctatcatatttatttcaaaatttgtagtgcttatctcagtgcttggcacagaggaaagaaatacaatttttaataaaggcataagtggagaggtaaaatacatatttctggtttcaacgtgtccatattctttcttgtaaatggaatattgygcttgcagtctgctctcacacaatatctgggaaggagttttaaagagtgaggaagaacagtaaagattttcctaggcaratacgttatgtgacctttgttgatttccagagcacataatatcccaatttcatccagtggacaggaaaagagaggaagagggaaaaggtggcctctcaagtgcctgacctggaagctgcacctatcactgtcccttgggcagaactcagtcacatggtcaaaaggagtctgcaaataattgtcccctgaggagccgggtgctcagtgaatgattctattaagttgaaatcagatgggaacagatcatttaggataaccagcaggctctaccacattgcctaactcccaggcatattgtgagaattaaaagcaccttatatatgtcaacgtgttttgaaaaaatacaaaaagctctacaaaagtgagctataaatttatcattaataataatagtaataatagcaaaatacttgagaaatggtcctcttgagctgtttagaaggaatcatacaaatgcattagacatggtagcctcacttaactacttaatttgcctcttctttgaaattatttcaatagcatttgaccaaaaactatcaaatcatttttgaaataacgtatttttacataaaacacattatcaaatatctttctggatccagcttggtggtaaaaagatacatactaaagtttatgactgatataactttatatattgactaaaccaaagataaatattgattgaacttttgtggccccagtttcaatagatttttttattaacattttttgtttgaagtacagatgtcacgtcatccatgaaccggtatcattatagcttgataaaatactcaaactgaaagcagtgatgtacaytaattttaaatataatggttaagcaaatgttatttccatatctataagtgcattttatttgataattagaatgttagaatcagaaggaatttggaaaatcccaggttacacttctctccaggacgaactccttacagtggctctcctggggtcagctagcttttgcttgaccctttgaagcaggaggaactcagttccactcaagttgcccccttgattttctctttcatattgaacctgctgctgcacaggactcctccgtgactgtctctttgccttcctaaatctcaaagaataaagcaagtcactttttgacaagacatctttcacatatttgaaaagacatctttcacatatttgaaaagaccagtacgttttgttcttcctagaattttctccttcatgctaatgtctgctccaagaagacatggaggtgactggacatttagtcaggaacatttcttgagagcttaccctgtggcaggcaggtgcaatgttgaattctgagaatatgaatgtaacctttgaacaggtggctctgtcttctgacgtttcaggataaggtggaggagaggagaggggaaagtcgacctatctccccagcggggagggtttagggttgtctgtgggacctgcctctgtctcatcatccatcaccattgtcctgctgatgggtgcagaggactgaggacragtggttggagttctccctgtgccggaccctgtagagagtccagagccctggctcccaaaggaggcatatttgtagggctcttttcgtgagggtccagaggacggctgcaaagctgcaggggaggatgggggcatgggaggcaagcccgttgccctgtcagagcctcttggggatgctgctcttccccgcctgtcctctcttctctttgatktctcatcatgtggtcctctttcctctgccttttcctctcttcggtgtcccaagttcttccatagagacctgtgtccccttgttcccatcaggcctttatgccagccctgcacaggtgcggggacagtggtaggggcgtctcactcccgrctcaactacattctcccagaaattgtctgcagtcaaacacaactcagcgtggacattgctcaccaaaggtatactgcttgggctgcacgagagattcagttttctcctatctatctggcatgggctgtgagggggctcctaacctagggggcctttttactccttcctggccagagctgccatttccaagtttctgcactgtcagaaaagrgggataaggtaagattcctgccctcatgtcacagattagtaggggagaggtaattgtcaaataattacagtaaaatgtataaatgccttaagagaaataagtacttgcttaggaacctatttcaagaaaggagagataggttagcgttttggggaggtagtacrggagcagtcagggaaagcaatacttgtaagatcagaggctggcaatctttttctgtagagggctaagttttggactttgcagatcctacagtgtctgttgcaactattacacagttctgtggttgcagcatgaatgcagccatgggcaatgtgttaatgaatgggcacagctgtgtttcaataaaactttatttacaaaaataggtagtgggccctgctgctgggcttggcttgctgggcacacaaagtgagaagggcattgtgcctttctaggaaacatcccttgcaaagtcagtrcaggtgagacagtgtggccattcccaccacagcatgaggtcttttgaatggctgaagcgtcaggtgggaaaggatgaggagctgaagaagaaagcctgggaatttccaaggcctctcttaacatttgctgtgcagaaccaagcagtgccccaggtgttcagagtaggcttcagcgattacatttcttgttagacactgaattttgttcatgccgcccaagattgcattaacaattttggctgtcaccttaccgcggactcaaattagtttgcagtcagctaaaacctctcaggttttttccccccagcttgtgaattgctgtgaagccaaacatccctgtcatctctttggtagtttattttcaaactttcaatcttattaaatttcatctccaatgtgcaaagataagaggaagtttaccgcwgatggtggtttattctttaaaactggacatcagctaaatgtgttaaggtaatccgttagaggaatgttggtacgcttatacagtggaatactaattggttattaaaatgttgatgtatgattattaaaaggcagcccatgktatgtctcytctgtatgaataagtatgtaaaaagtatgtaaagattactgtayagttcatgggtgggactgggctctctctagcctctgtccttcattctccctgccagtgccttttcccttgcagtgtcccttccctggctgcatactcaagactggatttgcccagccaaaccccattaactcacagaagcaagaggaaaaaaataaattcttattagttcaattctccaaattgggggcggtctatttcacagcaataggtaactgacgtaaaaggaaaggaaacaatgaagtaattccagaaaatttcctatagctggwggacatgcattttcatattgaatgggaagaatggggtgggggggtcatacctctgtgttattgcagggtcctggctcctagggacctaggcacctcttcagtcagtgaattatagcttggaaaattggctaagtcggggaactgtacaaggggtcatcactttttatgtagccatgctctatgaaccatctttataactccctggcttctggcagttaagcaccactcactatctggcctctgtaatttcaacttctgaccatccccgtgggtggcaacaagcccagctctgtgacacctctgctaccagcagccctggcctggagagcggtgcccccactgaatgtctcagtgagattggcacccccatgagcatattcctgagggtgcagtgaatgctctttctccctacttgggacttctgggaaacactgtcctctggtgggttgtttgacctcacataatatactggttcttgcatgccagcttctctctgcttcttgattcttttatcagctgttagggcaacaatgtcaggcatttccgcctgctcagcattgggcatccctttttacaggcttctcagagccaccctagcagcaactttaccgcgtctcctggggtccttgctggatcgtgaaaacatacttccggagaaagtgttccctagataatgaattatttcttgtcctgtgttaagttccagttccttggtcaaggaccccagcgctactcctcaggatttgcagtgcatgctcaatcttgaagcaatgttgggatatagtatcttttcttctctatcaggcccagctgtctccaggtgggttatactaggatttaatcctcgttagtgccgggtcagctcctgaggggtgcacctgttgctttttagggacgaggcctcttcagcataaagaagtgctatctcttactagggaagaatgggccacctctgtaagctccaaatattcccaggtttccccaaccggggccttgaccttggcataactgatctgccttggctgagcatttaaacatccctaaatctctgcaagtctatcaggtcctaggcctgctgctaagtttctctactcttccactgtaggagagaaggctgtggctcttatattgagcctttaactgtttgttattggccctcagtttctcattagctctctgtagagtctcaatacaatatatcagaaagcattcaattccatctccttgtaggcagggaatgcctaaatcattgcacctacaatgacattctccaccaggatatttcccaggttactgctgttgaaatatttagcaattgaagcaccatttgtgcaaggggactatctgcccctacacaacactcagaatggcattctctttgctttccagaaagtgaatgagctggttccccaacccctcttgtgttagtttgagtcctgaaagaagtaaatgtcaagataggattagatgtacaagaamtttattggggaaagaattgtgaaggataaaggggaaggagctaggggaggcattgaacctttggatcatgatgtgtgtccaacaactatgaaggagagtgggcagggagaaggatgggctgggaagagtttcagttggcactgtgggtctcagaacaacccaggcataggctgatggggacgccttgagccaatgttgcccattggcggagtccacatcttgctgaaatgggcctgcattagttcccctgccatgtttagtcatctgggagtagccgatgagaatcatgatcttaggatcaactgcaatggcagattcaaaggggtagcaactgatggcctcagtcaactgtgctccttatagcaggaacactgagcagtgcatttcttggccatcacaaagactagtgaggagtgcccttcagagaagggaatgaaaattatttccagcctagaatttgatacttatctaaactgtcaatcattcatgagagtcaaagtcccaaaaaataaatcttccataaaccctttctcaggaagttattggagggtaaccgccacataacatgaggaagacaaggaggaagacatgggatctatgaaagggcaggtctaacccaggaaaaggatgatgaactgtagacccatgatgtcagatgtgcagcagactaagatcagccagtgcagaatgggggagattccagaagtgtgtccccccaaaatattggaggctcatgtgacttccctggggaagtttctgctgagaggctattggaaattgagggaagaattagccacagtcccaaagaaaacagagccaatcaaaaagcaatgcaattatgaacttcaaagaaaacaaaaataagaaggaaaacagtcttacttactacattacaaggtccagctgtgaatgatattcatgttggcagaataatgtcaataccaaatgtcggttaaacccaaaactattgtataactaaattgcctgtgtaagagagctaaacccttatctagcataataggaagtcagtggatacttcctgaagtgtggatgtgtggagatgtaaattccaaaagaaaacgtcttaagagtcaaaagtggttgcctctagagaggagaactgggggaattgtagggcaatgtaggacagggaactgtgatttttcttgtaagttgttctgacattttaaaccatgaacatatattacttgtatttttaattttaaaaagacataaatattttttctatcactttaaatattaattttgctagttatagcacatatttatagcattacactctgtagagctcttttggattcaagttttggagaattttcaaagttttagattaatgcctttgtgagttttcatccctttgatgataacaagttacaaagaaatagggttatgaataaaccttgtgggatattgttagtcaccttctctcaagtcgatctgtcccatgaatcaatgtttcaaacattgaccagcatttgatacttaataagcaacgagtaagtttttgttgaaccaatgaatactcttaaaatatattttttcaagtggcaacagtactatcttatttgcactctacttttctttttgaccctaagaatgtcacaaaaatgtttagcaactgtcaagattattacatacagagatgactattgtgttctcagatatgctgtatgtcttagytcatyttgtacagctataagagtagctgagactaggttatttatttatttatttatttattttttgagacggagtcttgctgtgttgcccaggctggagtgcagtggcacaatctcggctcactccaagctccgcctcccaggttcacgccattctcctgcctcagcctcccgagtagctgggactacaggcacctgccgccatgcctggctaattttttgtatttttagtagagacggggtttcaccgtgttagtcgggatggtctcgatctcctgaccttgtgatccacycacctcggcctcccaaagtgctgggattacaggcgtkagccaccgcgcctggccctatttttttttttttaaaggaatttatttcctcacagttctgttggctgggaagtccaagggcaagtctctggcatctggtgagagacttcttgctgctttctcccatggtgraaggtgagagggcaagagagagacaaaaggaggctgaactcatccttttacaaggaacccatgcctgagatattgaacccacttctatgataacagcattaattcattgatgaggacagagacctcattgcctaattggcctaaagtgagacctcttaaaggtctygcttaatactattacaatggcaattaaatttcaacatgagttttggaggggcaagcattcaaatcatagcaccatataatacaataaaaattttctgagctargtttggtaaatttattctaggaatccatgttgtctcctagttatcttcccttccatagtactgatgcatttttgttaaccattacctaattttgcttgagtctattatttctgaaattcacattatcttcccttttaaagttgagwaaattttcattcttcaagcgccttattttctataatctctcaaagtaactgatggctgttgcatgatcataagtgcaaattattttgctagaccacacttggagatgatgaatttggaatggcatgcagactcccgacatcaggagtcttgtctcctgcaataatcaggaacccaggcttaaaagggagcaggtacaacagaagggcaaggggtgacaatgctggtgaaagacatttgaggaaagctatcaacatgaaacagaataaaataaacagaaaagcaaaccagggaaaataaattatgcaggaaattaaacacatacacaaactgaaacaggaaccatcagaacatataaaaaattcttgaacatcagtaacacaatagttgaaacaaaatatttagtaaaatatttgaaaagtaaggtcaaagcaatgctgtaaaagtagtacaagatgataaagaaatagaacacatttttgaaagggaaaaagmtttaaaggatattcataaagatccaacatcagactaatagaagttctggaaagagagaataaggaaatacaggtcaggaaatttgtaaagaaataatataataaaatgccccagaactgaagaacatgagcttttaactttaaagagccgactgagttcctagctcaatgaatgtatagacatgtaagggtattgaaagttcaccttcagtgtcatgtttcctaagaagctaatggaagatatgcaccagcaaaattgtagtaaatacataggaagaaatagtatatagaaaaagtatggtttcaatccataagaaataaaggaaactcccaggacgagagcagctcttgacagcatctagtccaaactggacttggaggctggaaacttctagcagggaaggaagagctctgggtgaaaaagtagactcaacagaatagatacgatcatagaaaacatgatagagaatcactaacacattgaaaaaatcacatatagaatattctgcacgcttaataatgaggtcattatttattcaagggaaaattaaaagctgtttagaaaagggaaatgttatagtgccctatttggctctaaaatgaacatttatataggaatcttcatgtaaatactaacaatgatttaaataagaacagacatttcggaaaataagggaagaaaatggggcatgtaaaagagctaactcctcattatcctaatgaattattaaatttcacaatagcatagtatttagaaatatgatagttattacgagaagaaagagctaaaaggttgccagtggggagcaggagtgagggttagagacgggattgggggagatgcttactgttttcatgataagcctttggtactatttgattttaaactatataaatgcatttattaatttaaagtaatttaaaaaacccataccactggataatgcttgataatttctagagtcmtttttttttgtattttggggcaggtaaattcattgagagacccagagagtttagctractttcctgtgggtaccaagggtcagagctggggtcaaaactcaggttttctgaacccctattcccagtgtacattccatgactccaggctgcctcccgcattgcacaggttacatctaggggtgtgctagcaaatgcctagaccatcctcgtccacatcagcatctgaaatggacaagaatgttagtcatgacttgccactaacgtctttaaccttaattgacatctgagagtgtcatcattacatcattacaaaaacactaacccagatacatctgttcccattactatttctgcgtaattcccccagacttaattgctttaaataaccattttatttggtttacaaacttatgggtcaggattaggggagggctcacccacgcagtttttctctggtccgcagtcatctgaagcttgaacggggtggggcatgcaagacggctcacacatgtgatccgcggttgagcctggctgtggaccagagcatctctgttggcctcgcttacacaagtggtctcagattagtagcctctgtacatggaaactagcttmcctcccggcragcatcccaagagaactaggaggaagtggtatggacttcttttyttyttcttcttcttcttttcacttattcttgatatcatgtagcttcatttctatcagagcagtcacatgcccacagattcaagggggagggtccacagatccgccaatgggaggaacagccaggttatatcgtaaaagatcatggggcatgggagatacccatctattttctgtaaaaaatacattttgccacagcatcactggctttccagctcacagtgatctgcctggaatgcctttttccgtctctccaggatctacatctttcaatataaggtttagaaactacctcctacaggaagacttccttgatttccctcagcaagaaagaatctttccttcctctgaatcgccattgcattaaaaaaaaaatccatcttctggcgttttcactttcagacttatactgtaattattctatgtacctatgtttgacccctcacgatgcccagcataataatttgtctattgagtaaatatttgcttaatgaaataatcattacatgataactcaaatagcagtcctgaaaaagtgcatttcaattcagatctctcttttttcttccttcacaattctcatttccgaaaaatgaaakaagccagaggatcctttatgaggagttacagtataacttatgcgtggctgtttcctgtgtttactgctactcagtgagaaatacgggagatgggagagtgaaaaaccatgtcatttacaatttgattaaaaagctttttatcttttcctttcacgtttaagccttgccgttttaaaaatttccctttcgtcacaggggatcaagcagcagttaacgctgcagttccctgttctggaaacactctcaaaggtgtttcaacacattttgtctcaactctgactcctgccccgctgccccacgccatccagccacactgaaggtcttgcatttgtgccttggggcattatttttttttactcttctccctgcctggaaggttcttcccaacctgccctaccgccatagccacagaaccaacccttcactttccttaagtctatggtcacaagctccttctcaaaggaggcacacctctaaccacccccatttggtgacttcctgtctcctggaggcccccggaactagtcttctctacttccagcaacccactttacgagcagcggagaagactgactacttctgggggcctcgaggagacaggaagtcaccaaatttacaggtgctgtggatgaaactgtgtgataatgaatttattgggcttgtttttttagcttctgaatagaagaaccaataagatcatttttttaaaaaagataaaaacagacaaacacaaaccctctagtataaaagcatttttttttaaaaaagatgaacacacaccctcagattgccttcttttgaaaaggcaatctgagattccttatgaaatccccagacagaagctgtttctttgaatttaatatgctgtacactgtagagccaagaggcttatagagtgttaattaacaccccttgtcaaacatttgtaaatgaatctggctaaagctcaaggaaaccaggtttttctgtgtgataaaatataatctttggagattatttatgatcacaaagggagactgtacagaaaattttcctagacttggaaatgaggcaggattattggtgtccatctggactgaggcctcaggcaggcctgcctagttaatcccattctcctatcctcattctctgggggtgaagaaggcagtgcacctttgttcaatttgctgcttaccatggattagggcattttaaattctgtaagggtagtttttaacttgtagaaaactgatagcgatgggaaggattcttgcctaatagggacacaaacggattttgttctgtagagatgtaaatgaaaagatgaaaatcacaacacatttaatgaaaggaaaataaagactcttgtgagtgccaccaaaaaaaaaaataaataaaatgtatctcctctccgtggcaccccaggccttccttacctcactctatttcttcatagcacttattgccttagaacattctttataatttacatttattatgtttgttgttggttgtcgctcctcctgctaaaatggaatctccgtgagggcacgggtttttctttgatttgttccctgttgtgccccaaagtgctagaatcatgccaggcacacaatagatgctcaataaatacttctggaatgaaaatccccctccacttagaccagtgagttccaaacttttttgatcttgacccatagtaagaaaggcattttccatgttgaatatacaccattgaaacaaaattttcacagaaaaaacttaccattattacaggcagtgcactgtgatatttcctaatctcttctattttgattttcaaaattgctgaggctactcataggttgatttcacaagtggagtttgtgttatgaaaaactttgacttaacaccatgtcgaaactgctaccacaaaaaggcaaatgcgaaagaagggggaaagagcaggccgatgactttccgctatccaccactccataaagcatatttcattttcctgtaattgtatcctgttcaatgatgtagaaatcctcacacactcacatgccactttttctttgggtgaaaagcgttctctactgcaagatgaattgagttatttcaaaagcaaagagctataaatgagcctgttaaagaaagtctcaaggagagtctgttggcatctgctgttgataacttaaagcaggagaattagataaggaggcagaagtagaatgtttagaaaataaaagtgaccattatagaggaaaaactgcttgtctcagttttgttgatattggagagtagctctttcatgagggtattgtggaattattggcaattatactaatagatgtttactgaaaaaatcctatttgactgatgaaccatggaatacttttgctgaccttgtggaaaacatcacttatctgagttccttatcttcttgtctcttttttctcatctagcctatgcctccctacctgttccctcatggttctcattttgttgctattagaaaaacagagatacaaaaaccaggaattggaacccctctgtgtctccagtaataattctgtgattaatgggttagatggattctggtcacaagctggatattttgttaacaacctagcgtcaatgacttggaatgattttcaccgcagcatgatttagtattgaatagaatgatttaactaatgttaattagttctgtacagataaattaatgaagcaagaagctcaatctctgatttattgatgtatttacccagtgtaagttatgaaatcttttttatttcatttgaaggaagtttttatttaaatacaaataaataagccctttattgtcacctactttggaaaagtccagakaaaacaatcttaagtaacaaaactccaaaattacaacatgattttcaaaaactaccctgacctttgtcttgcctggttgttacagtgtacttttaactaaacggattcttatagaatctcaagtttggttatatttgtattaaggaactctatatttgcatttgaccagccctaactaaaacaagcttaaggaagaaaagggactttacgacaaggacaaaggattgaagaagaactccagggactttagatgttaacaactgtatttgtcactaaagtaaccattactgtcaaggtgggttctccttctccctcactaaacacatgcacacacaccacacacacatacacataccacatacataccacacacatgcacacacaccacacacacaccacaccacacacacagaaatacacacagacatacacacatgcacttatgcttgggtcagtttggcttttatcatcccagagagtctcttcccatgtcagcaactccagattcacttcctctcctaatataggacagtcacatgtctctattccagcaaaacaatctcagggaaggtatctcattggcctggcttgggtcattcaacttgaagtacaagaagagaaaacagtattcttttatttttatagatttcctgtaaaatcagtggataatggtaaaaatttcatgacagcaggtgttttaccttatttatgtttactatctctagaacccagtatgatagttcataataaatgcttactaaaacaattatcaaactgtacacttaaaaattaaaagagtaaattttaagttgtgtatgttttaccacagtaaaacaaaataaaataaacctattattgatcttattgtctatttctcaaaagtagcatacgtcataatttcatgtgatttctaaaggagatctaatctcaaacttagttcttagagtaaaataaaaggttttrgcaatcatatacagcagtagactttaccttgaagatttaacaaaggtttgaaagcaaaatgctatgatactgaatatactaatgtttgagggcttgtgaaaaggtcttaatataggaatcatatatcttcttttagattgtgtcttggggaacattgggggtcagtttttctatcagtgttagtatgtagtaagtaatggcatacatctaagcttgagattttgctcatttctgtattcttagcacttatatatccaacatataataggtgttggataatatttgttgaataaatgactaaataaatgtcttggcatragaattatgccatctacaaaaccgtcacttttaaaaaaaacaacaaagatttttgaacctgtagatccagccagaaagcaagaaatatcttcacctttccagactgacttattttttggtctagctgtgtactatgcatgagctgtcaactttaatactttattttttaatgcctaggtctagtgagttacaatgtgatgtagactgattgaattaaaggccccaatgttgtcctctcttcattgtatccatgccttttgtcatgtaactttgcagtgtcctctactctaggtgtccattcagcttatcctttgactctggccttcttctcctttgactctggctttatccatgtgacttactttagccaacaatcataatgctggcaaacactgagaaaatgcttattagtgtctgcttagtctcttgcttctctgcaattgccatgagaaaatgcccaagctagtacactggaggatgagacatgtggggcagaagcaacctgtcccatttgtcccagccaacaccatcctagattaaccagatgagaccagagcagaagacatgttcagtggagcccaacccagctcacgaataatatttcttcatgagcatgtgagcaatgtgtaactaatgcaccatgctctttttattctgcacttccaaacatctctcagattgccctgttgttttgcttttcagtagtcatcacctttgtccagaaccttaattgtatctgcattttggcagtatcctgccarttttccacatccagctgttcacattctaatgcattctgcaatggatgattttgagcatatgactgatcatcactgtctcagaaatttatgctaatctattgtgacctattctgtcaaatccaaataactttacattcaaaacttttcatattctggccccatactgtctattgtaatcttattttctaaaagccacaaactattaatcctgtagcctaattaggttgatatcatcattttcacaacacgttgggtaaattcttatatctgttcctttaatcatagtttccatgcttagacactccattgccctccctaagcaccagccagagtccactatggggggatattttaaaggctcttttcccctaacccatctgccccagaggtggcacaggctagaaaagatagtccaattatttggcttaattatttggatcttacagtttttttgggagagttccagatgatttgatgaaatgcaacatggtcaaaaacattttggtggagaataatttaatcaactagaccatttggtgaaaaataaatcccagttactagacttcccagtattaataattttggtatgccaggaatttttaaaacatttctaacaaattttttcagaaatcagaatgactgaaakgtataacaataggaaattaggaaatcaataagtaatcattgaaaagtgagtgattgaattagttggaacaatctatgccatccatcctgtgggggaaaaaatgaaaacagctaaacaagcagagcagacatcatcaacttagaaaaacaatatagtaaataatttgaactagaaaattttccaaaattgaaaattccagttttaaaaaatttgtgttttcttattcaaaaagcaatacatatttcgttacataaaagtcagaaaatcagagaagcagaagaacataataaatrcccactgtcctactcaatagagactataactgctatctctgtacaaatcctttaaaatcctgtcttatgtgtatttattttacatctgtacatatgattccaaaattaggtaatactgtacgtggtctatctatagctaactatagtttgtaatttaataagctatatttgtccatggtgatcatttattgctcataaaattaataaattataatttatttatcaacactgatcatttgttgctaataatttatttcatttaatgtcttattcctgggttattttaactaatccctattgttagccctttaggttgtttcaactaatttaagaattataaatggcccatagtagttacttaataaatatttgagtgaaaggataaatgaatgaataattccacattattggatgttcaagttgtttccattcaactttattgttgtgggggagtataatacaatcttggtgaagagccaccaacttaggaagaactatgaagaagcatgttatttactcctgcttgtgggtggggtgcattgggaaaggaatgcctaaatgcacgtggggagccaaacaagacttcacaggggagatgggaattgagccaaatttggaagaagtgagaattttcagttgataattggggaagatagtactaagagtaagtggggttcattaggaactacttcttagaagaggcaagtccagaacagaaggcagaaagggatatggatatgaaggaaaagtagaatgcaacttcagggctagtaggttggcatccaacgtaggtacagccctggatgaggagtaatgagaaactgacctggctgtagcaaaacagctaggctgggaagtgatgctgtttacatttatatgcgattctactggtcttcctgttactttgtagaagrctgtaaggcttggtgctcagagctagaaatgcaacttatttgatttgctaagaagtccaaagcaggtaggggtgccaagctgctgcctgttcacacatattcgtctaactgggtgtcagggaaagcagatatgagcccccttgcattggttaaatcctgagcaacttttaaggawctgcacacagagactactggctattttttgtggataaagttgtagatagttatttttgggaaattatttatgtgttctattaggtggttgttttgtgggaggctgtttgaaattctgtcttaaggaactgcagcttataaaccatagtgctgatagaaataagagaaataatttggtctgcgagcacaaacatcaggctagttggcatgcttatgtaaacaccacacagtagcagtgacttttaaggaagtcctcagacaatgtaatcccaatactcttcttgaagttgaggtaatagggtgccagaaagaaaaagaaaataaatctctagtgccttctaaaattttttcaatcctttgacctttttgaaaacggtcacctttaattcagaactaaagtaacatctggagggcccttttcttagatagggagaagacataaatgagctatttgaattattttctgcttatgggctgcatttcatttcttccaccattggtctcagtccatttaattaagattatttgtaggattaaattaatcctttaagaattattccatttcaatttttaaaaaatctaatgaatgatagataacaaaaagcggtccattcagtattacccctgaaacatatttgggtgattggtgataccatccatgtctctccaacttcagcttcatatactcagctgagtaccaggcatcttcattgaaagctagacttgtgacctaaatagaacttgatcccttcccttccccaactccttattttttgttttctttgagttccttgattcctcttcccctcctcacatgcaacatgtaacatccaattcatcagcaggttctacagattctgccttcaataatagcctaaatctagccacttgttactatcttttttggtccaaaccatcatgatcttttgcctggaccattgcaatagttgtctaactggtatccttgctcccattttgtcctcctagatcctattttccacgtagtagccactgatttttggaaacttatcaatcattacccagacacaatgagtacatttacatagttgtttgattccatttacataaagtcccacaatcactctatgtactgggaatcacaacagtggtctcctatgttgagaattgattaagagtcacaaggaaacaaggagtaatattccattgtattaacagaccacactgttcatacattctcctgtaaatggacatttatgttgttttcagtttttttgctattgtgattaaagctattaggttggtgccaaagtaattgcagtttttgccattactttttaaatggcaaaaactgcaattactttggcaccaacctaatactgtaagtatctttgaacttaccaatcaaacattactacaacacttgaataagaaacacttccatagcatttacaattctaagtgctttccatgtattgacttagttaatcctcacaaggatataaccatgaggtgctattactatccctactttacagatgaggaaatagaggcacagacttcagataatttgcccaaggtcccacagctaataagggggcagaattaggaaagcctggctgagtctatgctctcatcacttgctcaactctgcctggaatgcccttcccgtaccctctaccgcctctgcccaatcctccgggttctctgctccttccacacacccccatctcaggtcccagtcttttktagcattcttcactttttctgttacagatcctcagacaatgcttccttgaagaagacttgcctgtctaaactgccttcccatcccaatccctgttaccttctatcctttctctgctttrttttcatttgttatctctcttcttcccaakaatgtaagctccataagaacaggatcatattttgaatcccctagaaaagtgcctagtgtaatatttgttgaatgaatatgatccctgcaattaaaagctaaatatatatatttttttaactaacagattactgtagtagtttcaaagatgaatttatgtttcggagaaaatcagtattctcttgccacataaattgtaggtaattatatttctatacctgaatagctttgccaatgactaagatattaatctattatatatttattaatctatagatctttaaaattgatgcacatgttttataagcaatttgatgaattttgatgactacatacacctgtatgtgtatggatatctgtaacaaatatccaagtaaagatatagaatattctcattaccccagaaagtttctttgtgacttctaatcaattctcacctccgtaggaaaccgctgttgtgattcccatcaccacagactgattttgggactttatgtaaatggaatcaaacaactctgtgaatgtactctgtgtctgagttctttcaatctacacaatctttttgacattaatccatattactgcctagaagagtagttcactctttgcattaatgaatagtattccattgtataaacaaaccacactgtttatacattctcctgtgaatggacatttgtgttgttttcagttttctgctattgcgatttaagctactataagcatttttttttaattgygatggggtttcgctcttgttccccaggctggagtgcagtggcagcgatctcagctcactgcagcttctgccacgtgggtccaagcgattctcctgcctcagcctcccgagtacctgggattacaggcatgtgccaccacacctggctaagtttcgtattttcagtagagacggggtttcaccatgttggtcaggctggtctcgaagtcctgacctcaggtgatccacccacctcggcctcccaaagtgctgggattacagtcttgagccactgtgcccggccagcatctttgaacatatcaatttgtaagttttatcttaatattgtacaagtctttkggggggcttatgttgtcatttctcttggtaaatacctaggtatgaacttgctagattatagagaaaatctatctttaattttataagaaactgtcaaatagttttccaaagtggtggtactatttatactcccaccatcaatgtatgaaatttccgttgttttacgtccttgccagaatttgttggtagtctttttttttttttgaggcagcatctcactgtgttgcccaggcatacaatggtgtgatctcggctcactgcaacctctgcctcccaggttcaagggattttcatgcctcagcatcccaagcagctgggactacagaggcgtgccaccacacccagctaatttttgtatttttagtagagatggggtttcaccatgttgcccaagttggtctcgaactcctggcttcaagtgattcgcccgcctcagcctcccaaattgctgggattataggcgtgagtcactgtacccagcctgttgccagtatttttagttgtaggcatcttagtgggtgtgagtgctcgttggggttttaatttgcattttcctgatagtgttgatgttgaggacatttctatgtgtttactgagcattggtgaagattstcttgtgaaatatctattcaaatattttgctcatggtgggaaggggagttatttttcttttactactgataggtaggcttacgtatttatttcggatataattattttgtcaattatatactaatcataaacaaaaactgataaattggacgacgtcaaaattaaaacctgctcatcaaatgttagcgaaatgtaaaggcaaatcacatactgaggggagatattttaatatatgtatatttatatagtgctttctgtgttctaagaagtattttcctactccaagataaagagactattctcttacattttgttctataagttttatagttttagcttttagctttggatctatgatctgtctcaaatttttatgcaagattggggtttaattttttcatacacttttccagttgtcaaggatcatttgttgaaacgtctttcctgttgccacataattgctttgatgcattcgttagaaatcagttggctgtgggtttattttggaattttctgttctgctcctttgatgtatttgtctatccttatgccaatatcaccctatattaaataattatagctttataataagtcttgaaatcaggtaatgtgaatgtttcaactgtgtttttcctttttctagttattttagctgttttatgttcttattgtatatattttagaatcaacttattcatttctacaaaaagtttattgggattctggatgagatggtgttgattcagtaggtcaatctggggaaatctgataacaatattgactcttccaatccatgaaaatggtatctcattctttatttacatattctttaatttctgttagcaatgtgttataattgtagcaaacttgcacatcttttgttaaattattttctaagtattttacgattttggtaccactgtaagtggcattgtatttaaaatttattttctgtttgttttctgttcatatataaatgcaattgattttcttttttttttttttttttttttttttttttgagacagaggcttactttgtcacccaggctggagtgcagtggcgtgatcagcactcactgcagacttgaactcctgggctgaagggagcctctcacctcagcctcccaagtagctgggactatgggtgtgagccagtgttcctggccaaatgcagctgatttttgtattgacattgtattctgccaacttgctaaattaacttattcgttttaatagtttttctgtttttttaaaaatcttaggatttctacacagacaatcatgtttttaatgaacaacaaagtttgtttttttgtttgtttgtttttcccttttcaatcaacatgccttttatgtttttatttgccttactgcactggctaggacctccagtacaattttaatagcaatggtgagagtgtttaaatgtactcctgtgtatattttattcttttggaacttattataaatggaattgttttcttaattttctttttggactgttcattgctattgtacagaaatacaactgactattgtgtgttgatcttgtaccttgcaattttgctgaaatcgtttattttttgcaatagatttttgtgaattctttaggattttccatatgtagaatcatgttatctgtgaatagggatagttttacttcttttctaacttggatagttttttccttcctaattgctctggcaagaacttctagtacaatgttagagagcaatagtgaaagcaggcatcttcctttcaatcctgatgttaggggtgaagctctcagcctttcactgtaatgttggctgtggattttcataattttttgtttgtttgtttttttgtttgagacggagtttctcttgttgcctgggctggagtgcagtggcgtgatctcggctcatcacaacctctgcctcctgggttcaagygattctcctgcctcagcctccagagtagctgggattacaggtgcctgccaccacaccgactaattttgtatttttagtagagacggggtttctcgatgttggtcaggctgctctcgaactcctgacctcagrtgatccgcccrcctcggcctcccaaagtgctgggattacaggcatgagccaccacgcccggcccataaatgcttttcttaatcatattaaggaagttcctttctagtcstagttttctgagtgtttttattatgaaagactttcagatttttgtaaaatgcttttcctgygttaattgagataatcatatgggttttctccccctttactctattgatgtaatgcattacaacgatttttttwaatgtttacccatctttgcattcctggaataaatactagttgattgtgctgtataattcttaaaatatgctgctggatttgttttgttagtatttggttgcattcttttgcatctatattcataagggatattgatctgtaactattattttcttgtggtggctttatctggctttggtatcaagataatgctggccacattggctaagttagaaagtgttctttcttctattttttgaagagcttgaaaagagtcgtgttaattcttctttaaatatttggtacaattcactattaaagccactagtcctgggcttttcttagtttgawagtttttgattactaattcaatctcttttacacctagattagattttgtattttttccttagccacttttggtaatgtgtgtgcttccgggaatttggccaggtcatctctgttatctaatttgctggcatccaaatgttcataatgttctcttgtaatcctttttattatagaaatgatatacagaaaaggtcagttaccactttcttttatgattgcattaatttgcttcttttctctttttttctctagtcagtcttgctaaaggttggtckgttttgttgatttttttcaaagaaccaacttttgattttgttgattctataatttttctgctctgtattttgtgtatatccattctaatttttattagttcctttattctgttagctgtgagtttagttggctcttcttttttattttcttaaggtggaagactaagttattgagatatatctttttttttttttttgatgtaggtatttaaagctataaaatttcctctgagcattgcttttgctgcaatttataagtattggtatgttacatattcagttagttttttatatacacatttaagcttttgctaatctaccttgtgatttcttcattgacttattgcttgtttgagtgtgtcaacaatttccacgtatttgtgaatattctagttttccttttgttattgatttctagtttcatttcattgtggtaagaaacaatactttttatgatctcaacagtttaaaatttattaagacttattttctggtctaacatatgatctatcctggaaaatgtatcatgtgcacttgagaaaaatgtatattctgatttttttaggtgggtggcatgttctattaatatatatgtctgttagctctagktgaattatagtgatgttcaaagcytccattttgttattaatataaccatgccagatttttaatgctgtccatttgcataatatgtctctttccattctttttcttttacatgatcactttatatttatagtatatttcttgcacacagaatgtaattgaaacttacttttctaaaatctactttctttttttttttttgagatggagtcttgctstgttgcccaggctggagtgcagtggcacaatcttggctcactgcaatctctgcttccygggttcaagcaattctcctgtctcagcctcccgagtagctgggattacaggcacctgtatttttagtagagacggggtttcaccatgttggtcaggctggtcttgaactcctgacctcrtgatccacctgccttggcctcccaaagtgctgggattacaggcgtgagccactgcacccagcccctaaaatctgctttcatagcatctgtcttgtacttggaacatttagtccatgtgtatttgaatatttattgatatgtttgggtttatgtttacaatcctgctatttgttttctttttgttccatgtgttttttgttttttatttctgcatcttttggaaaaatcagattttttggtaattcatttttcttattttattggctttttagagaaacctttaatatctttgtgagttttagggattacattatttattcttattattattccatttagaattaatattgttaatcccattmaaaaatttgtttatttcgcttttcagttctagaattttcatgttttcttcagttgttgtttctctgttgttattctccatttgttcattatatctatcttttctttgaaatccttraaaatatttataatagctattttaaagtcctctgctaatcccratrtctgggacatcttggcttctgttgatattgaatacttctttttttccccttaattaagggtttcmttttcctgctttttcacatatctagtagatttttattatgctctgtgtgctatgaatgagatattataggragcctggtcaatattgtctctttttaaagggtgttgtatttagttctgccaagaagttaaattaccagatttacttgatgtggctttaktctttsttagagctggtctattcctgctttgttcttacttctcaggtaatgaccttcctgagtttcagctggatgcctgaagtgctcagctgcatttttctactctggctattctgaaatgcaatattttccagacctacccaacctttggtattcatctcccagacctgtggctgcttctctttgctgagcctcacaaaatcttgtcctgtgcatggacagccamggatccttgggaaatctyatgcagacttctaggtccttcctttgtgtagatttcttctctccagtacgttgacctgcttcagagtcctcatcattgctttcttccttttcagctcagcaatactgctgtgtattgtgtgrgcttcatttgcctcagccatacctagaacacaacccaaggcagaaagctggagtggacctgaggytcatcacctgtttccttccacccaccatttaaaagcagcttatttgtgtgaaactttttgttgggttctgtgggggataygwataggcaaatgacagggagcttataatttagccaaagagaaaatgtctatatgttctgtggaattcagagtattttcctcgacttccaaaattattttcctcgacttccaaaatttggggctactagctagttggtaggaaggaattccagatccatttttcttctagatttttttcagactccatgtttcaaaatctaratggaaggtaagaaggaagcaaggagggcatcacatacgagagagacttataccccaaagtggatcattagcacattatgagataatatggtattattctcagaggcctgccatataaaattccttctaatttattttttaatggtatgtgcctgaaagttttctgtctttcatgatcttgaaagcaaaataagaaccagagtagcttatgagagagttttcctgcttcagcccagaaaaatgttgcttctgtcctagaccctttgatctggttcttagtgccagccttcattcctctagatctgtttattgaatactggctctgttgcagagactttgctagaatctgagagataaaagactcaatgccttcaaaacacctacaatccagacacttaaataaatgcaataatatatggttaaggtcttggatagaggaccatcatagaaacacatagaacagacatttagtccatgctagggagagggaagatgtcaaggaatgcttcctggaggtggcnacatctaagctgagttttaaagtgggtgtaagagtgaaggaactgggaataggyaaaacataccttagagagctgcacctccaaagcatggaaggctagataatcttagaacttcaagtggggttcaatgtgcctgggacttggatttcaggcagagaccatagggcaagttggagaacaggtgggcagggtgagatgaagcagagacttttaataaccatcaarcaggcctgccatccaactgctatsagccattttccctttttgaattttatttttttaatctytagagcaatacatgtttatggtaggaaatgaaaaaaatatatagatgggtaaaatgaagtgaattataccacccacaatcctgctgtaaaacaggttttaacaagttataaatccctccagatcaaagtgctactaaactctacttgctattttataacctttttctgttcagagtattttagaaacgtttttacatgttaaytgatattcttttgcattatcctgaataatggtatttctttagttatactatcatgtattaaaacattcatacatggtaaacatatttgaatattagacatttcaattgttttcaatgtttggctattaaaaatagtatttagatgaatgttcttggccatacagttaatracttcactgagtccttgtcaataactttattaaatcccawtcttaagacaacaagcctataagattaacataccaggaataattagaaagcattgcaagactatatgtaaccatctccctgttaatcatccttakttgttgcaacatcctaaatagygaccttcccacactctgcctcataatatttaatctgtcaaatgtaccatcygcaaagggagtgaactggctcgtgaagaggtggtgaagctggttcaactcagtttaacagacaatgagggcctccgtgtgccagggagggagtgagggaactccacagggagctcattctggggagggatgcccctcattatctgcagtaaatgatattagagaagtatgtgtgagactcttggtgtccagaggaggggcatgcagcacagtatgggggtccatggggttgcagcgatttcttagagacggtgccatgcctgggatgaccaccaagttaggatgctgtaaagagtaatcaaataagtttcaacagggttttggcatgaggtgagcmgttaatccaaatgatatctgaaatgctttctaatgctgcaagtgtattcctctgtaaaataatcaactacttaaaagacactctcacttgcattatgtcatttaatcctcacagtgtccctacgggacaatagatgtcattcccacttgtacagagcagtaagtgaggctcacaccggtcatagttagaggagtagggaatctaaacctaagtctcttctactccaaaccccaagttttatcagtatgtcacatygctactgtgggctgaattccttagcaggggttgtttcctccacctgcaatattcttccttttggtttgttcatcctctagagagagaagggatacgcattcatggagatcctactgttgcaaactctgcattaggagttttacatgaattgtctcatttagtcctcacaacagtcctgtgaggcacaggaaagttagatttacctgcccaaattaaggaatgtggccaactcaagagtgacgaaggccaggtgcggtggctcatgcctgtaatctcagcactttgggaggctgaggtgggaggctgaggatcgcttgagcccaggagtttaagaccagccagggcaacacagcaagatttaatctctactagaaataaaaaagaaattagccaggtgcctgtagtcccagttacttgggaggttgaagtgggacgattgcttgagcctgggaggtagaggctgcagtgagccatgatcccatcacttcactccagtcagggtgacagagtgagacccagtcttaaaacaaaacaaaacaaaaaagagtgatggagcaggaactttatctgccatcagagaccatatatgtctttccttatggcccaggtcatttatcatgtccttgctaaacctcctcctctgagccttgttaaagtcctcaaggttagaagagtggtctataattataaaaaattccattgtatgacttcagctacctgcaaaactgaccgagattaatgcattctttgtttgctttcactctttcaytccctgttcagcgcttattctacagaaaggtgcctggtagatttaggacatgactgttcataggcctcaaatgcggtcaaattaggaaagtcccctggtttttggtctcaagaggttaattgctgagtactagcctggactgctcaatggattttatgtttaactgttgtgtttatttgtttgtttgtttttgttttgtgagacatatctttctctgtcacctgggctggaggtcagtggtgtgaacatggctcaccgaagcctccatctcctgggctcaagtgatcctcctgcctcagccttcctagtagctgggactacaggcacacagcaccatgactggttaagttttggattttttggtagaaatggggtctcactctttgcgcaggctagttgtgaactcctggtatcaagggattctcccaatgtgctgggatttcggcctcccaaagtgctgggactgcaggcatgagccatcatgcccagcctctgtttaactgttaacatcatgaggtttcctttcaatgaggaagggaggcctggggaggtgtgatggggaagatggagaagggtaggagacatcataaaactgacagaagtgtggcacgattaagaccctggtttcttagaccacataagcaagtgccactattcttttgatcaacatttgattctctatttccttcttagcatatagatagctgcttcaggtcgtgaaaaaatacatttagtgaaatgaaacatagtagatatgttcaccaagaaactaaaaagaaaagttagccacaaactatcttatttcattgaaatgtttggctgaacccataagaatgttgatgaggccattcttggatgcctgtactgaaatgaaccacgagaggaatatttaggatatgttgaagaggctgtttggcttaatgaacaaaggagtttctgcaggcccagggagtggaatgaaaattggcatgatcattttggagaatatatggagtcaaacagagaatttgaatggagttttcaaagaggatatgttaggggaataaaggctgataaacaacacttgtatttgtaggaaaatagggagagtaaatcaaggaattcaaagagaaagagaaactcacttcaagtaggggagaaaaaacccctataattttcactcttccttgtaaataaaaaggaaacaaatgaaaataagatattagaagtcagtaagaatttatgggagtataaagttggttttatggatgcaaagcccttttcactgctgtacgaaactcctggctgcatgctaacaatggacaactgatttccttgcagctgtattttgctgttttttgctcttggcttggacctagcaccctgggtctgtgggaaaccagaactgtcccagagttctggagggtaggccaaggttagatgctggagtgggttctttaatttattgtactgattcttcttgggaagaaagaagattgcttgttagaattttagctacgagagatgactatgaaacagtaaattaactccaacgacctgagtcattttgaaaactcccagtctcaggataaaaaatataatcctatttagaaattcctggtgtgatcacagatgtagcattggttcttttcatgaaacccgtaaattaaaaagtacataatccaaagtcaattaaatagtaagctattataacaaattcttttatttcattagcttttcaaaatgtggataactacacactcaacccaaggaatctacatttttccactgactgctaaaraccaatggaaataactctagtccccgtagcacctcactgtggggtgacctacctttgaaataatgtrttggttctagctgatttttatattgttagtcattaagttaggcttgatgagaaacagatataatytgakttggggattcaagtattatattgcatttstcctcacaactagagataaatttgccatggtttttctcttcataggctcatgccaaagtctggcatctctacaatacttctttccgtcccactcagggaggtcaggtgtccattgccctaagctctcactggatcaatcctcgaagaatgaccgaccacagcatcaaagaatgtcaaaaatctctggactttgtactaggttggtttgccaaacccgtatttattgatggtgactatcccgagagcatgaagaataacctttcatctattctgcctgatkttactgaatctgagaaaaagttcatcaaaggaactgctgacttttttgctctttsctttggacccaccttgagttttcaacttttggaccctcacatgaarttccgccaattggaatctcccaacctgaggcaactgctttcctggattgaccttgaatttaaccatcctcaaatatttattgtggaaaatggctggtttgtctcagggaccaccaagagagatgatgccaaatatatgtattacctcaaaaagttcatcatggaaaccttaaaaggtatgattgtgggtaaagttctcatttcctgccaaaatcttctggaaaaaaatctctaagattatctaacataaatgatgtgaatttatatttttaaatcctaatggagacattcattttggcaatagtagaatgcattcatktaacacctttctcatttggagtcttgaggaacttgaattaatttttaaaaacccatttgtaaatgagaaactgggttataatatttgtaattacttaactttcagttattaatctagatttttagattaaattgaacataaaacaaatcccaggatatctagctctctgcacatgtttttcagttcttgttattttggttgaataaaacactttaaagaaaaaggaatgtccatgttttctagagaaaatagtataaatagatcatgcttttaaagccttcatttatttatttattgcatcagacacaaagctgggtgtctaggatggaaagtggtacaagacatctttccagccctgtagaatatctattataaataaggaactattttttcaaggtgctcagaaatccaaaaaacatattagataggccrattttgagggcatttatttgtagagttatataggtttgattagagtctttcgtcaagaagaaaaatcattggcttaccaaacgagaagcattacactttatttatttaagtaggaaacgctcagctgctcttgaaccatgatgcaagtgcccagcraagggtcatgttgctcttgtcccctcttccctttgcagccatcaagctggatggggtggatgtcatcgggtataccgcatggtccctcatggatggtttcgagtggcacagaggttacagcatcaggcgtggactcttctatgttgactttctaagccaggacaagatgttgttgccaaagtcttcagccttgttctaccaaaagctgatagagaaaaatggcttccctcctttacctgaaaatcagyccctagaagggacatttccctgtgactttgcttggggagttgttgacaactayattcaagtaagtcagctgacaaaaccaatcagcagtctcaccaagccctatcactagtaagtagtgcttccttcctaggctgattgtcatggcacattgtccgttctttgagccaaaaacaattccttatgagtacactaagggcacaatttggaatgctgcacccttctctccaaaactcttccaatcttcatcttgtttaagttagatccaaagataaataaatttaaagcatatcaatatttaagatccgattaagacagtaaaaagataaaacactctcttttcatactgtggtttttgatcctttttaaggcagttgagttttttcatgaacaggatctaacacagaactccaaagcctctgagtttcagtggtgctgctgagactgaggcaggaacattaggcagagtcctccagaggcacaactgtgggctccacaaatgtgcagaaataccctaagaaagtaaaccctagatccaatgattcactggtcagaatgtcttttttagcaatagtcattgaaatgataygaaatttcttcagaatgatcaaccaatatttattgagcatcttctcagtagtaagcccttaacattctttcagayttcctaaattttgaaggggcttgttttccagcatttgactggatactctagtaagcacttattggatgtctagtgtgtccgaagccttgtgttagttgctcgggtcgcttggttaaggggagtgcaggtagagggtatactgagatgagtaagggtaacctttgctttcaaaggagcaaaggagtctactgagcgaaaacaatgtatgcacaaatgatgcaatggagtgaagcgggcatggtggtaagtaacaagggcggggctgggggattgctgctgatagagtcccaagtgtgaaaatagccctcaagacagagacagagttcagtgtccatagacaagcagttggctttgacatgttgggttatggtagccaattaattggttctgcaaatcacagcttgaaaggaaacacttggaagaatgtgaaatgggttgctgttttcttgtaaatatccaattgaaatcttttatttataaggaaataaattaacaccatccttagtacattttttgctggttgggattattcttctttttcagaccacccagttcattttacaggcagtctcagacttaaaccctcgccttccatttaaaagatgactggctcacgcctgtaatcccagcactttgggaggccgaggcgggcggatcatgaggtcaggagatcaagaccatcctgaataacacggtgaaaccccgtctctactaaaaatacaaaaaaaaaaaaaattatccgggtgtggtggcgggcacctgtagtcccagctactctggaggctggggcaggagaatggcatgaacccaggaggcggagcttgcagtgagccgagattgcgccactgcactccagcctgggtgacagagcaagagtccgtctcttaaaaaaaaaaatgactggatgtgtcatcttttatgccaggatatgtgagcccaggagaaaggcttctgagctccctcctgctcggtgtgcaattttctgccctgccccgactctctccttctctcccagcctcctgctatttgaaatctccttatcctaatttccctcctcagagtggattccactgtggggttcagagaggatctgaggtgggagaagtgaggctggtgaggaagaaggggaggagaaagggaagaagacctccgtagccttccttcctcctcctctttactggggttggggatagatcggatggtccctggtccttgttctatctcttgaccttctgcctgctccctgctgagcacggatctctgatagcagcctgagtctggcaggttcagtcctttgtatgcggcacaatctcccagccagcattgctgtgcagatcatgggaacgaatgcagaacaagagtgggggtgtcggagggagccctacttctcctgttctattcctcatcagggggctgtgcgctggctttgggaattggtaaatagtgagaaagtcttaagggtacatcctatttccttgagggagaagagaaaacgctggtcagaagcaataagtatagcagtgaatagcaagggagatgggagataattccttttcctactacactctagaagctattgttttagaatctgacctaaggtcagccactaattggccccagaggtctctctctcagatcacacggtccttttttcctcatcagcttggggaccycacccctcctcctggcagtctcctcctgtgcagaacccaacaaacacaaaattaagtcactctcaaacccacagcagatgagagcttctctggaagctccctggtggggaaaggctgcaattgctattttcttcttctggttttcacctcaggctttgtgttatattgacagtacccttctcaagctaactccctaactgacgtagtcaaaataagttctttgtatgtcagttctgaggtgtgtgtgttttcacttacaaacagtactctacagctttaagacattatattaaagtcctgagaagtgatttttaaaccactgaacttcatcttttccctcctggctagtatttcagactttcagtgtttgaggcatgcatttcacctgaacaacttgaaaaataatatcctaagaagcacacaacctgactttaggctcattcacatggattgtcactttacttggacccactttctcggctgagaggtttgttttcccataaccacggatgctcatagttaatataaatattgaactcactatgtagtgaggacatagagcctctttaacattggtccctgttaggagaaagtttctcccataacatactaaatacatgttttaatagccgttccttctgaaaggtccaacttcactattttatttttttagtaaaatcttagttaacaaattaatggaggttaggtggaattttgccccaaaagtcctgtattttctttttttttttttctttttttttgacagagtcttgctctgtcgcccaggctggagtgcagtggcgtgatctcggctcactgcaagctccgcctcctaaggtcacgccattctcctgcctcagcctcctgagtagctggggctacaggtgcccgccaccgcacccggctaattttttgtatttttagtagagaccgggtttcactgtgttagccaggatggtctcaatctcctgacctcgggatccacccacctcggcctcccaaagtgctgggattacaggcgtgagccaccatgcccggcctgtcctgtattttcaagaaactttttttttcctccagaaatgataccctagtctttcatatttgttttcagatggactgaataaaagctgttgttttggaacaatcacggttaaaaaaaaaagttatgaatttagtcaactcagagctctataaaaataatccaaaaaattccttcaaactctgaacgcttcaaaagagcgtgcaaatattctgtccttcaaagctaaggaaacatgatttgtggggtgcatcacagtggaaaaatactctgacagcattcccacagcattaggggaagtgcatgtgtgggtgttctgcaagggacaattctccagaaaaggcaatttccctttgacatgctgtttttaatgacttttctttataaacacacttatctctccagagaaatagcagtgcatttgcaacaggcccgtaaaatgcaacaaaacctctgctatggtttctgacccctgcttttatacagagcatcagaccaaggaacctgttctaacaggattatttcagaggggaacacaggcttagggtgcagatcttccagctggatttttcactttgcattccctccacagcagacacatgaaggaatgattttgtgattttgattttataatttgcacacttttcctaaatactttttttaaatttttatttgggaggattttatagcatatgattgagaactataatcatcatcattgttacagaagaataatttagaaaaattttttaactacgttaaaaattccactatgggtggatgacaatattgttctttccttccacattctccctccttagactttcttttctttttttctattttttttttgagatgaagtctcgctctgtcactcaggctggagtgcagtgccatgatcctggctcactgcaacctctgcctcccgggttcaagtgattctcccgcctcagcttcctgagtagctgggattacaggtgtgcaccaccacacctggctactttttgtatttttagtagagatggggtttcaccatgttggtcaggctggtctcaaactcctgatctcatgatctgcccgccttggccccgcaaagtgccgggattacaggcgtgagccactgcgcctggcctctctctcrgactttctaccatcagtcagattgaatttgttaaattctgtcactgaccctaaacccaacaaaaggcaagagttatgtttatttagcacttcctctacctatagcaaacctcaatttagagcgtaattttaagcacaatttaattataaatatcttttcattttcttacttaactcactcagttttttaaatcttcttttttgagacaagatcttgctctgtcactgaggccgatgtacagtgatgtgatcatgacttactgcagccttgacctcccaggcttaggtgatcctcatacctcagcctcccgagcaactaggactacaggcccgtgccaccatgccgggccaagacggggtttggacrtgttgccccagctggtctccaactcctggcctcaagtgaccctcccgcctcggcctctcaaagtgctgggattataggcatgagccaccgcacctggccaactcactcacattttaagttttttctttttttcatctagttttttttctttttaaatttgaaagcctcatgacattaatgatttcttacattaaaagaaaaacacccaaaaatactctgcttacataacaccgacaagtagtgtgcaagactcattagcatttgtcatctgaagtgaccaaatccagacttttgggggtcacattaaagaaacagttgaagagttagaactatgggtaaagcgagtgtgcatatcagaaagtggaatattgtcttcctcaggagctgacaatttatgaaaaatagttcacattctcagctagaaaggcttctatttttgctcatattcctggctagttttgctgaaataattgctttgaattacttcctcaggactgcccaggtgacgctaatgtttactctgcccttcacaggtagataccactctgtctcagtttaccgacctgaatgyttacctgtgggatgtccaccacagtaaaaggcttattaaagtggatggggttgtgaccaagaagaggaaatcctactgtgttgactttgctgccatccagccccagatcgctttactccaggaaatgcaygttacacattttcgcttctccctggactgggccctgattctccctctgggtaaccagtcccaggtgaaccacaccatcctgcagtactatygctgcatggccagcgagcttgtccgtgtcaacatcaccccagtggtggccctgtggcagcctatggccccgaaccaaggactgccgcgcctcctggccaggcagggcgcctgggagaacccctacactgccctggcctttgcagagtatgcccgactgtgctttcaagagctcggccatcacgtcaagctttggataacgatgaatgagccgtatacaaggaatatgacatacagtgctggccacaaccttctgaaggcccatgccctggcttggcatgtgtacaatgaaaagtttaggcatgctcagaatgggaaaatatccatagccttgcaggctgattggatagaacctgcctgccctttctcccaaaaggacaaagaggtggcyragagagttttggaatttgacattggctggctggctgagcccattttcggctctggagattatccatgggtgatgagggactggctgaaccaaagaaacaattttcttcttccttatttcactgaagatgaaaaaaagctaatccagggtacctttgactttttggctttaagccattataccaccatccttgtagactcagaaaaagaagatccaataaaatacaatgattacctagaagtgcaagaaatgaccgacatcacrtggctcaactcccccagtcaggtggcggtagtgccctgggggttgcgcaaagtgctgaactggctgaagttcaagtacggagacctccccatgtacataatatccaayggaatcgatgacgggctgcatgctgaggacgaccagctgagggtgtattatatgcagaattacataaacgaagctctcaaaggtaaggagccctagctgcggcwatctcctgaaggttatgtcaccagagggcatgacacttgattaaatctccaacatcaacacacactgccacccttggaatggagggctatccattttgtgcctcactgaaacagtccaagagatatctagcatttccccaaggataaaggagtgtagctaaaagtagaagaccagaaatccctagcccctactctggatctatgcaagcctagattcttgtcttccatcttggatggctccacagcagtcttaactgtttcatgtacataaagcagtacataaagatttaaccttgctgggcatggtggctcacacctgtaatcccagcattttggaaggccaaggcaggaggattgcttgagcctagaagtttgagaccagcctgggcaacatagtgagaccttgtctctactaaaaatcacaaaaattagctgggcacggtggcatatacgcctgcagattcagttacttgggaggagaggcgggaggattgcttgagcttgggaggtccagctgcagtgaatcatgatcacagcactgcaatctggcctgggtgacagagcaagacactatttcaaaaaaaaaaagaccaagcatggtggctcatgcctgtaatcccagcactttgggaggctgaggcaggtggatcatctgaggtcagaagttcaagaccagcctgaccaacatggtgaaaccccgtctctactgaaaatacgaaaattatccaggtgtagtgatgcacacctgtaatctcagctactcgggaggctgaggcagaagaatcacttgaactggggacgtggaggctgcagtgagccaagattgcaccattgcactccagcctgggtgacagagcaagactccatctcaaaaaaaaaaaaaaaaaaaaaaaggatttaacccaagtatatcatagtagattgaattatgtaaaacacccatttaacaaccaggtccaggtttgttctctctgtgtagtaaatcaatcactgtgacacaggttttgcaaaagagaaaagatttatttgtaaggggaccaagcgagggggtgggagaataacttccaatcctgcctctctgaagacaaggcttaggaatatgtatgggttagggaatgggtggtctaaggcatggtgaagagtgattggcagggggggaaaatgaagtaacaggttagacacatgcacagaaaatggtggtgttagcatgatctgagggcagagttttgggccctctgacgtcaaaagaccacctctcaggcacttgtgcaggcccagtggaagggtcagtggtcttaactagtttgaactggacaggagctgccccaagttcttggaaaaacaactgaagtgaccattgccatggtaacctatgaatgtcatcagtaaagtagccagtgaaggttaagtttcagcatacaatgggacaaccttcagcttcatggaaaaaggaaaaaaaaaaaacacatacacacacgaaaagcaagtgaccaaaagcaagcaggacaggcagacctgatccaattaacccctgggtttcaaccctgctaaatgcagctcaatatttgtcttgataatttgcctatttggctttacataaaataaagccttttctgatgaaatctaattgagtctgaagttgtattaaatggtatcggaaacttcccagcaggaaggctacgtaaaagtggccgggcgtggtgactcacgcctgtaatcccagcactttgggaggctgaggcaggcagatcacaaggtcaagaaatcgagaccatcctggccaacatggcgaaatcccatctctactaaaaaaaaaaatacaaaaatttgccaggtgtggtggtgctcacctgtagtcccagctactcaggaggctgaggcaggagaatctgttgaacctgggaggcggaggttgcagtgagtcaagatggtgccattgcactccagcctgtgtgacagagcaagactccgtctcaaaaaaaaaaaaaaagtgatgtgttgtgtgcaaaatacgtaataactactctcctatccttttgtttttccagcccacatactggatggtatcaatctttgcggatactttgcttattcgtttaacgaccgcacagctccgaggtttggcctctatcgttatgctgcagatcagtttgagcccaaggcatccatgaaacattacaggaaaattattgacagcaatggtttcccgggcccagaaactctggaaagattttgtccagaagaattcaccgtgtgtactgagtgcagtttttttcacacccgaaagtctttactggctttcatagcttttctattttttgcttctattatttctctctcccttatattttactrctcgaagaaaggcagaagaagttacaaatagttctgaacatttttctattcattcattttgaaataattatgcagacacatcagctgttaaccatttgcacctctaagtgttgtgaaactgtaaatttcatacatttgacttctagaaaacatttttgtggcttatgacagaggttttgaaatgggcataggtgatcgtaaaatattgaataatgcgaatagtgcctgaatttgttctctttttgggtgattaaaaaactgacaggcactataatttctgtaacacactaacaaaagcatgaaaaataggaaccacaccaatgcaacatttgtgcagaaatttgaatgacaagattaggaatattttcttctgcacccacttctaaatttaatgtttttctggaagtagtaattgcaagagttcgaatagaaagttatgtaccaagtaaccatttctcagctgccataataatgcctagtggcttcccctctgtcaaatctagtttcctatggaaaagaagatggcagatacaggagagacgacagagggtcctaggctggaatgttcctttcgaaagcaatgcttctatcaaatactagtattaatttatgtatctggttaatgacatacttggagagcaaattatggaaatgtgtattttatatgatttttgaggtcctgtctaaaccctgtgtccctgagggatctgtctcactggcatcttgttgagggccttgcacataggaaacttttgataagtatctgcggaaaaacaaacatgaatcctgtgatattgggctcttcaggaagcataaagcaattgtgaaatacagtataccgcagtggctctaggtggaggaaaggaggaaaaagtgcttattatgtgcaacattatgattaatctgattatacaccatttttgagcagatcttggaatgaatgacatgacctttccctagagaataaggatgaaataatcactcattctatgaacagtgacactactttctattctttagctgtactgtaatttctttgagttgatagttttacaaattcttaataggttcaaaagcaatctggtctgaataacactggatttgtttctgtgatctctgaggtctattttatgtttttgctgctacttctgtggaagtagctttgaactagttttactttgaactttcacgctgaaacatgctagtgatatctagaaagggctaattaggtctcatcctttaatgccccttaaataagtcttgctgattttcagacagggaagtctctctattacactggagctgttttatagataagtcaatattgtatcaggcaagataaaccaatgtcataacaggcattgccaacctcactgacacagggtcatagtgtataataatatactgtactatataatatatcatctttagaggtatgattttttcatgaaagataagcttttggtaatattcattttaaagtggacttattaaaattggatgctagagaatcaagtttattttatgtatatatttttctgattataagagtaatatatgttcattgtaaaaatttttaaaacacagaaactatatgcaaagaaaaaataaaaattatctataatctcagaacccagaaatagccactattaacatttcctacgtattttattttacatagatcatattgtatatagttagtatctttattaatttttattatgaaactttcctttgtcattattagtcttcaaaagcatgatttttaatagttgttgagtattccaccacaggaatgtatcacaacttaaccgttcccgtttgttagactagtttcttattaatgttgatgaatgttgtttaaaaataattttgttgctacatttactttaatttccttgactgtaaagagaagtaattttgctccttgataaagtattatattaataataaatctgcctgcaactttttgccttctttcataatcatatgagtggttgctagctaatttttttgtaattaaaaaaacttgagttgactaagccacctaagatgtgatgggagcagtggagaaatgggtgtgactgcaagaggcctgacccacgcggctggaagatggtaggggtgggagggcgacccaggctaggccatgtgtggagcagagagaatttcagagatgagacagcgaaatacacaagagctgaaaaggacaaaacagaagccagagccgcgaagagaagcgacctctgagaaccatccagctaccttctaatgcccgcctcatgctgactctgagtcggtaaaacttcgcaggtagcttggggtgaacgaaaggagggcacctctaggatcagccccgggacactaggcggcggcgctggaggcggggacttcctggccctggtggggcgaagtgcactcattcctccaccgcgtctcagagcaccgcgttctttccactctagtcttcttctctgatgctttcctctcatgaattctggtgtacatataatacagaaaccatcctccagaatgcctacacctcttcttcctttgtgggccaattctacaggggcgctaagtggccgacttgtggttccccagtgtgtctgggctgtttcctacacacttgtattcgccctgcattcgcggcgtattcctttgatcccaggtggacttttatccgccgttcattttgccctgctttggaaggacggttttccagtttcattagtgacacgtcattttatctttgacttccacagtcaatacttagaatctggcttggtcctgttggctcatgcctgtaatccccacactttggcaggccaaggcaggaggatcaattgaggctagaaatttgagaccagcctgggcaacatagtgagacccgtctctacaaaaacttctaaaaattagccgggcgtggtgctgtgcacctgtagtcccagctactcgggaggttgaggtgggaggatcacttgaactcaggaggttgaggctgcagtgaactatgttcatgccattgcactccaacttgggcaacagaatgagacctgtctctgaaataataacaagaagactctattagagccttggaagttttccattaaattatttatgatagtgctgttcaacagatacaagcaagccatgtatttcattttaaattttctagtagtcatattaaaaaataaaaaggcatagaagagataaattttaataatatattttattctttccagtatatccaaaatattgtattttcaacttgtaattgatataaacattattgagatatttcacattttttttggtactaagtaattttggtactaagtaattagattggtctatagcatatttgtttaatatttaatattgagcaatgctgctggaaatttgcacttggaaaggaacatgttaatttggagcatgttggccatcctggatgggaggacctcggttctagaggggaaggcagaggccatgtcttgtctggtatattttttacagtgtttagcgcagtatctcttacatgatattgttcaacaaatgttgattaattgaatacatgacggaataaatgataagcagaattagctcactgccatcacctgtgcccagagactggtttaatagagatcacctgtcagccagcaatgacgatgtgttagatgccacacagctccatcctatatattcagaggaaggaatgataacctgtcttactaggtagagaggcagtaaaacttactgctgtcctaaattgttgcctccagacaaatcactaagtgaaaggttgtaactttttgtcttccttatccacatgtctttcaactagtcagtaatctttctgtctcaggctgagttctttatctgtaaacaaaaacagtattttagaggaaccctttatgtcatctccaaatacttagtttcctagaatgtgtagcttttcccctcagacccattgcatttttccatttttataaccactaaatattgttggagttttgctggttgtaggacatttcctggaacttgttttttccatatctttgtggttaaacacccattgtctgatatcaaggagaaagaggtccagaaaacccacagggaaccttgagcaaagggtggaaatgccactaataatggtgacaggacacctacaatatggtgaaatcttgttttacatgatttctgcataccagaaaagacttggtgactactactcaagtcccccgacctctgcttttttttttttttttttttttttttttttttttttacccattgggttagagaagaaaacaatttcaacctacatattattgagataaaaaggcagagaaagaagaacaagaccaggctcaaaatgaccttacagttgggtagttttgggtaacgcaatccttggtgaacctcagtttcctcatctttgaaatgggagtgtctatcttagcacagtgctgaacataggaaatattcaataccttgggtatctaccccagacgttatttttttcctagactcatacaacttacccttaatgtgcatgtgatttcttgttaatcagatattttgagctcaataatgtaaaactagggactattacagtcaaaatgattcatcctgaagccttctagttattttatttgtgactttgaatatacattttcatagaatacccttggtaaaactaaatttagaaaaacgaagccccacatttacttaataataccaaattaccttcttggattcaaattttacaaatgttggattgatagaattctgaagataatttggcagcagatatttctgtatcaatatgttgaaccatctgctcttttgaaataatctaatgacacagacaaaacattaaaatgtgtatatttgttatttggttggtaaataattgaaggctcattaatttttatgagattcaaaaatctctggtagactttctgattttagtataatttttcaatatgtttactttatggtaaaatgaattaatgttaagtgacctaatttattttgtatacattatcttcaacggaaacattattccttaataaactgctggaatagactgacctttttttctgtttaaaatctcaattgatcagtttataaaattcaatttcctttcgatattataccagttgttgtctaattatggctgtgaccataaattttgcctaagacatttcagttggttttccatgtgaatcaaagctttggataatttatatccaacatgttagatggcaaattcaatagtgttccaaggtcacagtattgcatttaaggcatattggttttataaccatattttttcccctttaaattatgagaaccacgagtctctggtaagtagccccaaggcttcaaaatacaacatttcaatcaacagggggcagtagtggtaagccagagaggacacaacagagatataattagaggaagatggatgggtcagatagagatattttattagtaaaagacgagatgagattgaaccaacttttatcccaaattggtaccatgttaaatgtccttattttacctgtgcctgttatgggcctaacaatccaccaaaacaaacacartgtggggttactacgaccatcatgttgacaggatgagctgcaagattccagcagtgttggcaacatggctgcactggttcactcagacagagaggaaggagctgagggaaaccagaaattaggtaatgggcttgcagccttggggagagccccagagtggagtagtacctctgaatctgcatgctctgggatgtgctgcctaaatgcagaagaccaggccttttcccctcccagcccacgctttcgaaagtgcctttgggggaagatggcggcagcacccatggcttggtaagggatcactcccgactgattctgacaccctgttcatggagaaccacggggctttgtggaagggtgtagtcaagggcagatccagtgaatataagaaggcgagaaagaccagtgcacaggcaattgaacgagaaacaggaatgtcggaattcgagggcttaggagtgaagcatttccagcttgcatcaagaggactgatgaaagagaagccagccgttggaggggaagctcagggagtgttcctccaggatacgaggaaggtcgtgtacaaagaggctgaaaaggctggggatggttttagggcttgtgggagtgggcccagtggaggaagggaggaaagcaaaggatagaggagaactgtaggcaacgaattcaagtgtgtccagaaagtcagagcatgcctgagttgagaaagtggagtggaagggcaaggcagtaatatgccagcttccaggaactacaacagaggccctgggcccaggttttgggtggagcaggctcttatatttattccaaattggtaccagttaggtatctggtacctaaaccaggtagagagcccctattttctagttctacttgcaaatttgctttataacccagaggaagtcaccttaacccacggggcctcattgttttcttgtctataaaaagagggagttaatcaggaccagtgcttttctaccttggttacacatcagaatcgcctgggatttaaaaaattcctcagactaatgaagtcagtttttctggggggcagtggagctagctcccaggtgattgcaatgggaagctgaaattgagaaccagtgatctaatcagtgcgttgctgactttaacacacatatgagtcacctggggatcttagtcaaatgccaattctgattctagaggtctaggatgggcccaagggtttgcatttctaacagcctcccaggagtgcccatgatgctgctcttctgtggaccacagtttgagtagcaaggggctaagggccctctgggttgattgagggatataatttgttctaatagggataacaagagacagagagaaaagaactattagtctgttgttactgaaatggtatcatagaaagcgtcagaatgcaacaagtgccatggatggaaaacaggtactgatttaaggttgccacaatgaaaaccttaagacatgatgtcctaacaaacaaattatcactttaaatgcataatcattgtttgaaacagacgtgttttttaatattttaagttctgtggtacacatgcaggatgtgcacattcgttacataggtaaatgtgtgccatgttggtttgctgcacagatcagcccatcacctaggtattaagcccagcctccattagctattcttcctaatgctctccctccccttgccccacccctgacgggccccagtatgtgttgctccccccagtgtgtccatgtgttcttatcattcagcccgcacttagaagtgagaacatgcagtgttcggttttctgtgaaacagaccttttaggtgcagatgactacaatttaaaatttttaaaacagacttcaaagtctaaatkaccatactttttaaaattggaaataactttaatataaaaaatcatgaaaaaaagtcaaaattatctgctttttttttcttatttttaacatgttggaagagtaactaaatcaagagccttatgctgaaaacatcctatatgctcaaacatcttctggtgatgtatattcaatatgagataacaaaaatgaaaaacagcagatctgtatgataatgcacataatattatgtgcatgtttactgataacagacaagatgtgaattaggagacaaatgttttaaatttattggaacttttttatcattaaaaatatattttaaaatatatgttgaatgaagacagaacgaagctagtcttgaagggagattgctgcgttgggcaggttgaagtctgaaaaaaataatagttctggaacaaactctctaagcctgtcatagacctgctctttctcacctggagacatcgtgagacctaggtttaattgccatttcttttctgtgtttggtgcatccat

SEQ ID NO: 17744 - DNA, 53598 bp, Homo sapiens
agcgggcctgaatcctcctgcagccggcctgaatcctcctgcagcctctcgcctccctagctcctcagtgcccagagctagacccaatgccaggcacctgggtgaggattctgctcccagcatctcagctgaggcaaacttgctagccagggtcccacaggcgcccctgcctgctggatggaaattgttactaaacaaggcccagatccaaggaagatttgtaaactgggtttgccccagaaatagaacagggccggtgtctcctggcctggctgccagctcagtggccctgccatcctcagagctcccctggagtcgggggaggccctgctgaccctgctcttgtccccagaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccaggtgggggtcgcgggggcgcgcagggtagggggagggcgctgctaggcccggcttgggggcggggacgcggggggcggtgcggggtcctcggggcccgtcccagtccccgccctcaagcggcgctgggtctctgtgtcatgtctcaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggaccttggggactatgggtaggtgctgagggtcaaactggtaagccggaataaagagacaggcaattacatttattttgaaatggacaacttttcagagtgctgtgggaatgaatgagacaatgtatacaattcttcctctgactcttaggagatcctcagtaaatatcggttattaattttcaagttatttctagctgtccatcctatatcacaaacatccagctttttgaagttgagaggtggatcataaatctccatcccagacgccctctgacctcagccctcccagctgaccgctgaccctgctctctttgcccacacagagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccrgcagcccccggaggccctggccttcaagtggccgtttctggggcctcgacagtgcatcgcctcggagactgmctcgctgcccatgatcgtcagcatcaaggagggaggcaggaccaggccccaggtggtcagcctgcccaacatgagggtgcagaagtgcagctgtgcctcggatggtgcgctcgtgccaaggaggctscagccataggcgcctagtgtagccatcgagggacttgacttgtgtgtgtttctgaagtgttcgagggtaccaggagagctggcgatgactgaactgctgatggacaaatgctctgtgctctctagtgagccctgaatttgcttcctctgacaagttacctcacctaatttttgcttctcaggaatgagaatctttggccactggagagcccttgctcagttttctctattcttattattcactgcactatattctaagcacttacatgtggagatactgtaacctgagggcagaaagcccaatgtgtcattgtttacttgtcctgtcactggatctgggctaaagtcctccaccaccactctggacctaagacctggggttaagtgtgggttgtgcatccccaatccagataataaagactttgtaaaacatgaataaaacacattttattctataattttgtaattttctattttattttaattaattaattatttttgagacagagtctcactctgtcacccaggcgggagtgcagtggcccaatctcggctcactgcagcctctgccttccaggttcaagcgattctcatgcctcagcatcttgagtaactgggattacaggcatgtaccaccacgccaagctaattttttgtatttttattattattattattgagacagctctgtcgcccaggctggagtacagatggcgctatgttggctcactgcaagctctgcctcccgggttcacaccattctcctgcctcagcctcccgagtagctgggactacaggtgcctgccaccatgcctggctaattttttgtattttttagtagagacagggtttcactgtgttaaccaggatggtctcaacctcctgacctcgtgatccgcctgcctcggcctcccaaagtgctgggattacaggcgtgagccactgcacctggcctaattttttgtatttttagtagagatggggttttgccatgttgcccaggctggtctggaactcctgacctcaagtcattcggcagcctcagtctcccaaagggctgggattacaggcacaagccactgtgcccggctgtaattttccattttaatcaaagctctgcaaattgaggaaggagcagaaagttctacagcgattaggtcaacctgattgtaaaactaaggaaggagcttgagttggccaagacttggtaaagatcttggttaggtaatacatgaaactaggattaaaatgctttcagggccagcacgatggctcacttctgtaatcccagcactttgggaggccgaggtgggcggatcacttgaggccaggagttcaagaccagcctggccaacatggtgagagtgcatttctactaaaaatacaaaaattagctgggcatggtggtgtgcgcctgtaattccagccactcgggaggctgaggcatgagaatcgcttaaacccaagaggcggaggttgcagtaagctgagatcacactactgcactccagcctgggcaatagagtgagattctgtctcaaaaataaaataaataaaaataaaatgcattctgattctagaatctatggtacctgccctcccagaattgatacagaaatttctttttttttttttttgagacggagtcgcccaggctggagtacagtggcaggagtgcagtggcgcgatctccgcttactgcaagctccgcctcatgggttcacgccattctcctgccttagcctcccgagtagctgggactacaggtgcccgccaccacgcccggctaatttttttgtatttttagtagagatggggtttcaccatgttagccaggatggtctctatctcctgaccttgtgatccgcccacctcggcctcccaaagtgctgggattacaggcatgagccaccgcgcccggccaatactgaaatttttttgttcttgacactttgactttcctgggcatagtgactgggctttattccaatcctacttgcatcaaaataaaatctgtgatcaaaattatcatctatacttagagaagaaaataaagcttcagaggatctggaatttatagctgtaagagctgtgcagctgggcgcggtggctcacgtctataatcctgaggatcacctgaggttgggagtttgagaccagcctgaccaacatagagaaaccccgtctctactaaaagtacaaaattagccgggtgtggtggcacatgcctataatcccagctacttgggaggctgaggcaggagaatcgcttgaagccaggaggtggaggttgcagtgagctgagatcacaccactgtactacagcctgggcgacagagtgagactgtgtctcaataagtaaataattaattaaaaattaaaaaataaaatagtgattttacaagcacttcacacaactgacataacaaaggctgtggctatctcaactcacatatcgatccatcaaggccttctcttgattttgaaataaccttaacctactcaagaacaaatttagaaatcctttctctctctgaaatctttgtcagtggctccagcattctaattaccaagaccggaaccttgcacttgcctggacccatggcacagaccagacaggtgggggcaccattcattgaggaaggaaggaggacaggcaggtgcgggagtggggagtggaagaaagattggacagggacagtctaaggagccaacggggagtccaggggccacacccaggactctgcagaccgtcagatgtggaggtaagagagcagggaggggggatggccaggcgcagctatggagggacaagggcagagatgatactggcggggggcatagaggaaaaaccctggaaaataactagtggctagagctttggggagagaaggggaaagacagatgggacagaaaagaactgagagaggcaggaagagaccctccccaccccactcctggacagccacagactggcgctagaatcagggacagggaggtaaggaggaatttttttttttttttttttttttttgagacagagtttcgctcttgttgcccaggctggagttcaatggtgaaatctcagctcaccgcaacctccgcctcccaggttcaagcgattctcctgcctcagactccctagtagctgggattacaggcatgtgccaccacacccggctaattttgtatttttagtagagacggggtttctccatgcgggtcaggctggtctcgaactccagacctaaggtgatccgcccacctcggcctcccaaagtgctggtattacaggcatgagccaccgcgcccggccataaggaggatatttttatgccgttacagaaaaagatgaaagctcagaaatggaagggaggtcggagaacctgcaaaggcatgcatgtggggtgaggactgctcagagctcagagaggggtgctggaagggacctgagaggaagctttggtccaaccactcatttcacagatagggaaacaggggcctgcggacgggttggtttgctccttgattcccagggcgcgcggtcctccccgaacccagcctcgcttcccgcgcagcgcccagcagtccctggcgcggcgggccggccctgccctcgcgagcttgcggtccggttgtggaggccaccggctccctggaaacatttggctcccggccgggaggcatgccgcgctctcggacctgggctggagtaggtgcccttggcggccctggctcgagcagtaatggactagccccagggggcgttggaaatgctgcgacccgcccccacatttttgcccgaacggagaccctccgggctttcacggtccggccttctacagcggcgggggagccgtggcctcttgcagggcgctccgcgcggttcccgactacccggagccgaggtgcgggctgaatcctgctgagctccccatgctaccacccccgcaaccccactctcccggggcgggtctaagagctcttcggggaaattcaaagcactacagggaccaacgtttgcagatgctctccctgcgccgcgaccaccctgtgcttggcccagttctcccggaggcgtccagagactgggctcgtgccgggggacggaagagggtgcgccccggcggatcccttcttggagcctggacgtgagctggccggtccggggcttgcagacctccgggaggagctgcggggctgagcggcgaccaggaggccaggccggggcagaggaccgccgagggccaccgcgggaggcgcagtcagctgcgtacaggcttgcgccgccgcgggccaagactccaaattgggaaaggggtggccgcagctctgcgcatgtgcaggaggcgccggagtttcactttgtaacttttaagtggtcggaacacgccccgcgctgctgggtcccgccagacacgccgccgccgcaggtacaggggacagggggcgtgaggaggggcaatgcaccctccgcctttcccgggacgtgcgcgccaggtgtccggttccggaacggctcccagcctacgcagaccccagagcccccgaccccaagcagggggtgacgackcgggattgggtgggaggagagggtccgggcagcgcctccattccagccctgcgctccttgggaattcctggcggcttttcaggactttcctctccggcttttcgctttcagggctggtatctccttcttccccacccctctctttgggatttgtcggcggagtccgacctcccacctaactaggagtgcagctatgggctcctcggaccctatacgaggccgggctgggaaagggccaagcgtccgactctcctgacgccaggaaggcagaggccacccctcgggctgttcctgggtgaccacttcctgcagccttggcggagtcctgaggagggaggctggggactcggggactggggggaagggcgggggcggaaagggtgaggcgagctctgctaagaaaccaaatccgcaaaggttccagcacctgataagactagctacctgaggccctggaggggccttggtcattcagccccaggcaggtggtgtcctcttcaagggcaggggtggacagcgtggcggacccactgaccctcccttgacacctctcaggtcatcctcaagtctgctgtgccttcaagggggatatgaacggaagccgaggctccttttcccttcacacgcccctctcctttgtttagtgtgggggcaaaggtctctcctagctgttcgttgggctctaacagagaagacgtcaggtgggatcctgcccttgtgtttcccattagctggaggggcgacttaaaataaaggcagacagcttctaattgcttgctagggccgggtcctgggctaagtgctttacaggtgttgtttgggatctgtgcctcccaacagctccgtgagagaaagtcatcactcgcatttcctggcgaaggaagccaaggcacagagtggttaggctgcttgtctgaactgcgtggtgctgagaccytaactccagagcctgctcacataatccctgagccacactgcctctggtttcagccaggggctgtgtcatttcctttgtgctccagggtagaggtaaacagttgtccaggttactgggtcctgtttggtgttgccataaggagaagtttgtactttactttgcaaccttattctgcatctgaaagaccagagttagctcctgaggcagaaggcctggagctgcttgtagtttcgctattgtcatcacaggattgaaagatttggtgatgataaaattaccctgaatttgtacgggccttcttgcaagaacgaacaatatccatatacttcctgcaacattctgctggtatttctagagcttgtcaagttgaccaccaggccagtccttgctgccaatggagactggcagtggattagcataggtagtttactttggcaaatttagaccagctgttggatttagccctctcccactggccacaatcagacgcttgcctgcacatgggttgaactttgggttgggagcgtgaagtcacctgctgcccactctggctcttgggcctcagcagtaattcttggctttcctaccctcggcatattgagtaggaataaggggatgaatggagaatttctggaaggcacaggtaagtgctaggcattcacatacatctaggatgactgaatattgccaggggttctcagccaggcagtgccacttcaaccacagtgcctagctgctggtttggcctcctctatacagctgccagctgggtgctcccctccccctgccttctcctcagcctggcagcactgtcccatggtgtctgtgttcccagctgcctgctcagagcgtgcctgtttgtgaaaatgcagaggagctgtcccatggagagccagagggacggagctgtttcagggggatctggactttatgtgtctaatgggcagggacaggctgggactgagctgaaaggtctgagagagattgtgggtccccagagctctaccctaacctgggtgctcatcggagagggcagacaggactggccacctgaccttacctcygtctcaggctgatagtatttgctagccacctccctgagttcatatcaaactttgtcaaaccaycctgggaagcctatttggcaagagacaagtaacttagaggcatgactggggctggagggagggggaagaggagccgcaggtgtttccctccgcagaggcctctctcctctctgcagcactggcgagggtatgccactcccagcaccaccacagcaccctcccctttccagggacaatgctctctctgtgagcattttatggggatgttttttctttccacttcacatttcaagccttccttgttcatgctgctgtgttcccttttcctgattctagctcttggggaaccctggggagcctccccagtagcattggcccttggggcccaggtgaagtcctttgcttggggccctaccgtgagcccacaacctccagggtttctgtgggagagggctgctcccctagacccagcaggtccytgagccattggcaaagaggagagaggctggggccacaggtggtgctggccgaggaaggaggagtagggtcgcacagaggagcactgatggatggagaaccagttctgggagtttggggagagatcaaggcaggagggagcccactgggcagaacctaaaggtccatatgggcagcatgcatacacaggtgtgtgctggagggtttccatccagacccctacactggaaaagggtggctcccatgtgatgcttggtgtctgtgatccttcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctggtaagtgtggggacaggaaggaggaggggtaggtggtggccttgaagtgttgggctggkgtgttccattgggtggtgccactgggggattttaaagggaagccaagaacatctgtgttccagaggtcactcttgtgacactctgttcagagtcagcagccccatgactctggcatcacaacccccactacctccagccattgccaagtctcttagaaggttgagaaagtsacttggctgtctgtgggatgctcccatgttcttgggctttccactcattcatgcttcctgtgcttcgtgtgtgtgtgtgtgtgtgtgtgtgtgtgtgtgtaggtaggtaggtaggtaggtaggtgtccatgtgtgattgtccccagcactctaggcctaggggttacccaacatacacacctcaccagcactactggtatccaaacatctgtttgggttctctatatcttttcttcttgttctcaagatctttgtccctgtaacagctagaagcaccagacttagcagaaaaatcccctgggaattctagatttaccagatttgggcaggtaggatcttaagcaagtccaggctgaatatgtgttctggcccttcagccacagcatgagaacttggacactaactcccggtcctctggtgtcaggggacagacactggagatttctattagcttcaccaggggcgccaggagcctcaggaaggaaaggtcaacaacccagcctggagcagtgtttgctttggaaatgctgggccttgcagttagactgatggtacccaggaggggtatgtgtgtgtgaaagcrcagagctaggggacccagaggtccctgaggaggccctgggactcctgactccctccccgtccctaccctagaccaccccctttactttctcctctgtggcaaagtaaaaagagaagtggcatctgagagtcaggatattgggtttgggattcaattctgccctgaccagctccttaaccttaactttggggcaagttattaaacctctgaggcttggtttccaagtatagcagatggacccatctctgaggtcccagctctgacattctgtgagcagtgggagtgaggtgttgtctgtggctcgtggatggaccatcgtgaatacttggatgttcccttcttccctgkttgtttatcccggtgttttcctcttcctgcctttgtgtgcctttctccctctcctctgcctgtactctagatccgccagtggcttctgcaggagtgactttcccaacacgagtcctcgaggctagaggaactttaggacttcttaagacagcagctgcagcaactctgtccctcctttgctccatgtcgccccctctggggatctgcccactgtgtyctggatgagccatccactctgaccatctgatcccctgagattgtcccacaatgcagccattctctgtggacactgccaggcaygcagaggtccaatgtctggctctcccggactccttgctgctggctyactgcccgatcagtccctgggaaacgcctgcctttggctctgccagcactggtgggaacctgcaagaaatttgagccctgaacgtctgccttgtcctgttgtcctgtgctccagggargacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctggtgagagccctcatgagtcgtgtcccactgcctcagttatttgtttaaatgccccacccagggccttctgggaaacttagatgagaagtcagacatagctgggtttaaatctcaactctgctgcttaccagctctgtgacttaggcgtgttacttagcttctgtgcacctcccctttctgctccggaaatggagatcataattcctatctcagagaattttggaatttggataaggccagaatactcayatagctatgcctgtgattactaccgtgattgcagagctctcagcctgtcgtatctttaaggcccttgggaagggtcatctcaaggggttgagacatgtgamtggagagtacggactagaatagagcagctgcagttcccaagtgtcacctcctgttcccctctggcatccctggggtttttaaagaatcagaagctgggccaggtacggtggctcatgcctgtaatctcagcactttgggaggctgaggcgagtagattgcctgaggtcaggagttcgagaccagcctggctaacatggtgaaaccctgtctctactaaaaatacaaaaaattagccgggtgtggtggtcggcgcctgtaatcccggctactctggaggccgaggcaggagaattgcttgaacctgggaggcagagttgcaatgagccgagatcacgccactgcactccagcctgtgcaacaagagcgagacgctgtctcaaaaaaaaaaaaaaacaaaaaaaagaattagaagctgattcttagagcgtaccttcagcaggtggcctttctttaacgtagatctccttgttcacaaagatgccccatggcattgttcttccttatgcagactcaacgttggctggctgagatttattggggttaaagtgccccttcttttcacaaatgccatgggctggccagtgcctcttgatactgtctcctaacatgtggcagagaccatctgagtgaagggggcagatggctctgatggagtaaacatccttggactgcttggagctggagactaggctcgggtggggaacatggggagggtggcttagggtagcaaggaggagtgggcaggggtgtgggggtggatttcagaattggtgggattagaggagggtggccttgggtcttcagggtggggagagtttggccaaggtgaggagtacagagagggggacctgggcagggaccctagctgggctgggtgggtattgttgcaacagtgttggctgagaagagagtcaccctctattgtgctgctgaaggtgaattttttttttttttttttttttttttttttttttttgagacaaggtctcactgtcacccaggctgaagtacagtggcataatcacaattcactgcgacttcctcctcctgggctcaagcaatcctcccacctcagcctcctgcatagctgggactacaagcacatgccaccgtgtctgggttatttttgtatttttggtagagatgggatttcacaccatgttgcctaggctggtctcaaactcctgagctcaagcgattcaccagccttggcctcccaaagtgctgggattacaggagtgagccatggtgcccggccaggggtggatttttattgcagtaagttttgggggtkggggaggggggacacataagagccagagggccctggagagcatgggtttgtgggaagtgtctgcactgcacaggycagggcggcagccgctgtggacagagagggcaggcacctgctgagcaggtttcgtggttttcctacaacatgactcacctgcctttgaaaatatgtcaccaacttcctgattcacctgaagaaaattccacgagaactcagtgcctctggggttcaggtcttctggatttcctttaggaaaacaaagcctaccttcaaaacccccgtttctgatcagagcaggcagggatgtgcttactaagatgtatttctctacctccctgaacctcaaagagagggaccctgtctagggagggaagagaggcaggaacatggcatggagcctgccaaggtggactgtggggagtgaggacagtctagagtgtacagatgtctagagctaagcggcttagtccagccctgaggttgccattggacacaagcttgctgaggtgtcccagcttacggaggccaagccagcccgagcacaggttctcgtggtgccttgctgcctgcatgcatgctctctgctgggggattgcagggcctgcggggcctgccttcaggggaatcaaactcagaggaaaaaactgaccgtttctggctcagcctgaggaggctctgctaccttggttctgtaatttaaaatgaaattttctggccagcatggtggctcacgcctgtaatcccagcactttgggaggctgaggcaggtggatcacctgaggtcaggagttcgagaccagcctgaccaatatggtgaaaccctgtctctactaaaatacaaaaattagctgggtgtggtggcgggcacctgtagtcccagctactctggaggctgaggcacaagaattgcttgaacccgggaggggaagttgcagtgagccgaaagaaaaaaattttctgtaaagtgaagaaggatgctggttcctggggctgctctggggccagaccttaccctcctgctcggggccactgaaggcagagcagggcccgagactgggccttgtggtgttaccgctgccttgagagcaagagacagggctgacgtgcagaactaggcaggctccaggcaagcttggcgtcagcgctggcagccttggtggcgtgggcacaggtgacaggagcctggtgaagggggtgagcaaagcatccgggctactgagctgcatggccttgggcacttcagtgccctctctgggcctgggtgttttccttctagccctgctgagtgcgggcaggtgggctttacccctgagaccgctgtgtcttctaatgagaagccatccaatatgcttttacttggtttcttttctgtttttagttcttaatcttggtgttttctattataagaagaagattctgggactatggccgcattgccctggtgtcagaagcagacaggtaaagacatatcgcctaggctgtgagcatgcgtgtgcgtacgtgtgagtgtgtatatgtgcgtgagtgtgtatatgtgygtgtgtgcatatatgtgtgtatagtgtgtgtgtgtgtgtccctggaatgggctaggggcttatgaagccctccatgtgggcaggacccacacatgacactgctatgagattgtgttcattaagtgtatctacctggcctgtaccaatagctgttctctttgctcttcaccacagacccatgaggtcagcctygctaccctcattgtgctcacaaaacaaaaaacaaaaacaaaaacccaggctcagatgytcagctccctcagggcttctgttgggccaaggctatgaaccttgttggcttcagactggttgctttagatactgagggctttcgtcatcctctgaagaggatgcccattttctttctcaccttgagtatttttaagtgatcatctttgaaattaattagcttggggccagggctgagtgaggatcaagggcagcagagccatcagggaactgccccaccctcctgccaggtcagcgccgggtttggatgagtctgttacaaagcacaggctccctcggccaggcttcaggtccttccagttctgcgtggggctccaggattctctgttcatgtcgcctgaagggtgacagtgaattctggatctgcacaacctgacgttccagctccagctggctgtttgcacccaggatcttgtgtcagatgtggtaataggaagtgagtgatgaaaactcagggactggccccagctgccacccagagccccagaggggctctggcagaccctccactctcgggcgcctcctgacatgtggcctgtgcggcagggtcctttgaactgggaagaggaggtgtacctgaaaatgcaccatccttccccgtgatccctgctctgggatttgctaaagcctgaggtgatgatgaccttggactgttggagagaaacttttgggacatctgatgcctttacggcacattcagctggaagtggggccatgtactctggttgaaaagaccacctggggatcagagggccctgctgtatccctggctgtgcgaccttggtcaaggccccaaacttaatagggtcggtctccttctgtcctctcttccccatgaggtcacggtgaaggtcaaaagggacagtgtctctgcaaaggcttttaaagttaagtttcgtcatgtgttttgtctttagtaggggggcagtagaaccaggaataggagactagagaaaaggagtcacagccaggcatgttggctcacacctataatcccagcactttgggaggccgaggcgggggtggatcatgaggtcaggagttcaagaccagcctggccaagatgatgaaaccccatctctattaaaaatacaaaaattagccaggcatggtggcgggtgcctgtaagcccagctactcgggagactgaggcagagaattgcttgaacccgggtggcagagcttgcagtgagccaagatcaccccactgcacttccagcttgggtgacagagccagactctgtctcaaaaaaaaaaaaaaaaaaaaagaagaaaagcagtcacatatacgtattgcaaacacctcagatttatagcgcatggggtgtttttatgggggtactcgcaagaaaggatctgattaaaatgccacaatataaagtgccatcatttgtccactctaaaacatatgttttgacattttctcatctctgaaattggaaggcatcttgttattgatgggtggtcatagtttatttggcagcattttttctttagtgtttcataaaataattgtgcaaattacaaccagtggtatcttagatttgataaaatgtagtatttattccaagttttatttgataatatagggaaatatgctataaataggcaacactttgaagtcagtttagctagacgagtcacagtggtgtggtttctgggtgttgaccccttgctattcatcccgtataacatagagttttataccatgcctgggaatggtcattgtccttgtctctatctttcacagagtgagttatattttgtcccagccatcgagggctggtagctttggttctgagctccaagaggcagcaaaatactggatgtgatctttttgacttgtttggcttttttttttttctaagaattatctgtcattttttttctttttgtgtctctagcgagtccagatttcagagattgtcatcgacttcctcctcaggtcaacaagactttgaaaatgagctggttggtatctaaggcccagttgtggtcatggccagggggtggggactggcagtcatggttttggggagggagcagggcggatcttgagcggcaagtgctggagaaagtgcttttctgcatcgacgaaggcacctgaacttgggaaataccacaggagggatggcagctggatgacccgggaccttgagactggatgaatttgcaggcaggaaggggtacggaatcccttgggcttccccagcacttctctctcttacacctatggctttgtatgacagttaattatggacttgctggctggattatgagccagatgtgggcaggagccctgccctctccagccctgtttcccagcgcctgatgcatagtaggtgtttagtcattgttgaatgaattattgaacaaatatttgtctttcctagctggataacagcccagctttaggggtattaagtttaagagatgtgaaggacaataaaacctgcagacaccctttccccctaacacccactccagcggaccgtccaatccattaggcttgtttcctctcttttgcctcacctcttggtcagtgattgtaaacaatcaaacagcagcccacatcactttgcccagagctgccctgmgctttcatcagcttttgatctaagttttgtgatttgaccacgaagttgtcaggagattttagcaagagttccaggcatgtggtgtatattgtgaagtactgggctcatgcttgctgaatatgggataaaagcactgttttttatacaacaggaggttaaatggttatttaatgtcaaagacaatggttacatctgcctctcaaagacacaaatgttggaagctaatccctgttctctccgtttccagggatgctgtccctggctgactgccatcttccgtctgcagtgagtacacccgggggcagctgctggggggcctttgggctggtttttttgggtgtttggccagtcaagaggcaagagccaagatgcttgatcttaagatggtgtctcttagatactttttagttaatgtccaaagcagtatgtgagggctgagaatcaaggtgaccaggcagcccctggggtcaggggcagaggaaggaggcctgtaggattggagcctccatgctggagggcacacagtscctgctggagcctggggcttcccaaattgagctggatcccaagagttcttgaagatagagatgaactttatttatttcaacatattcagtggaaatcatatgttcatctctcataatactgcacaaactaattaaagctatttttttgctttaattattcaacttaatatttaacaccaattagatgtcaatggacgctctcctaggcaggtttgcatgtctttgaattagtgaaaagtgaagaaatataatacattcaattcatttggttacaagttttctttttttcaatggggcccatggagagaaagctaaaagattattaaaggtgattaagagccagttagttacctctcatgtggtgtagggagccaggaggcggsgggggcggggactgatgtgagtcttggttctcacctgctgccatattccattgaatctaagaagttattgttgtaagatgcatgttttttttttttttcagaccgagtttcgctcttgtcgcccaggctggagtgcaatggcacgatctcggctcaccgcagcctcygcctccygggttcaagcaattctcctgcctcagcctccagagtagctgagattacaggcatgcgccaccatgcccagctaatatttttgtatttttagtagagacagggtttctccatgttggtcacgyggatctccaactcccgacctcaggtgatctgcctgcctyggcctcccaaagtgctgggattataggcatgagccaccgcgcccggcccaggtgcatgttattttatatagcactaagaacaagaaaatgttgtcagctaagctaccatcaactataacgatagygtacacctcatttcagaggagttgaaatatggccggctgcggtggctgacgcctgtaatcccaacgctttgggaggctgaggcaggcagatcacgaggtcaggagttcaagaccagcctggccaacatggtgaaactccgtctctactaaaaatacaaaaattagccrggcttggtggcgggtgcctgtaatcccagctactcgggaggctgaggcaggagaatcgcttgaaaccggaaggcggaggtcgcagtgagccaagatcaccccactgcaactccagcctgagtgaaagagcaaaactgtctcaaaaaaaaaaaaaaaaaagaaaagaaaagaaaagaaatatgaaaatgatatcttagaattgatgaaatgtggtggttatataatgaaatatggtggttataaggatgaaatgttctgggcctcagttttcccaactgtaaaaggaggctgaggataacatatgctcagcctaattcaaaggaatgaatacatgtgagagcatgttgtaaatgttcggtttggtaggagttgttcccaggggaactggcaggagacagagccccatgggagacagtcaactctggtctggaacaggaggaagcaggaggcgagttagtttatttagaaatgagaacaatgtagttaattgcaaagctttgtcctctagataaatagtaatcaggactcatatgaacaggcatatttctgagcatctgctgataccacgtacaggactaggtgtttgatgcttattatctcttgagcccctgctaagccgatgaggtaggcagtgggcagtttccttgctcgaggtcagaggcgggtaagctccatgacctgccctcaggtggaggccgctgcgctggattacactgtggtctgactgcaaagcccacrctgacatctttcacatctgcctttttatgatgcagcccttgcccccctgagctcttcccaaagcactgctttcccagcctagaagtagcgccttcagggagtgggaaagagcagagtgccctgccccttctccctctgtagcacagaagtctggcttgtgtgaacctggaattttctgagtccccagtggacccagagcctccaagtgtagcactccaagggtgggaaagggtggagcaagtcacctccccatctctggggacacagggaggaggccagggtggtaggatggactgggactcttggctccacctcaggtctccayctgagggggagacaggaaacaggtgggggcctggggcctgggcatattcccaactttattctttttttttttttcttttttgagatggagtctcactgtgtcacccaggctgaagttgcagtagtgggatctcgactcactgcaacctccacctcccaggttcaagcaattctcctgcctcagcctcctgagttgctgggattataggcatgtgccaccacacttggctaatttttttttttttttagtattttttagtagagacagtttcaccgtgttggccaggctggtctcgaactcctgacctcaggtgatccacctgcctcagcctcccaaagtgctgggattacaggtgtgagccactgcgcccagccctaactttattctgaatgtgatttcttagaagcaggacagggctgtgagatgactgtatttacgtacctttcccacacacgtaacttgggcacaaatgtttctagcaacatcagatggagtgctggtattcctttacctcgagtatggtacaggggctaagacgggctctggaatttatatcatgtgagatcctgaaagttatgcaaatttcctgtgcctttatttcctcatatgtgaacaaaaatgtggggatagcgatcgaaccatctcataagagtgtggtgaggatgatatgagacacttcatgcagagccccgaggcctgttccactgctcattaagattcctctgtgtcttggccagtgatgaccagatcctggaatggtgtggggaggacgccatccactacctgtccttccagaggcacatcatcttcctgttggtggtggtcagctttttgtccctgtgtgtcatcctgcctgtcaacctctcaggggayttgctgggtaatgaccctcctcacccttgtctatgttgtaatggggcagagtggcagtcctagggaaagggctcactgtggtagaccagaaccccaggagtcatgccccacttcagatgtaagatggtctcagggtgactctgaacatttctatctgattaaagatctggagcaaacctaggctaaaactggggccccaatatcaatgtctggttctatttaaatagggaaaaaagccccccaagatttacagaatcaggggctatcagagagtcttttatactttcctgccctcacccaaattaggaggtcacaattaatggacccagaagatatccatgatacttaattaaaatcagggtgtggcattatatctaagggcaactgcaagaatccaccttccaaaatgccaccatgaatccacttaggatacccagtggttcccaacgttggttttgtaacaacataggatgtttttagttttctcaaaacaaaatgaattcacattatgcctttacctgcaatggaaggttgagaagttatcagggagcattttggtttcaagcagaggccttgatggtgtagctctggaaagaccagtcagacgttgtcttcctgctggtccagacatgctcctcctccccagagctccacaaaccaaggctgattggttacgccccctcctgcttccccacatgaccctggaactaagtatctgtgcttytctgcagacaaagacccgtatagttttgggaggacaacaatagcaaacctacagactgagtgagtatggagcccgtggggataggtgctgatgggtgagatcaaggagaaggcaggtcaggagcccggggcaggccagaggtactccaaagggggccggctggtatctgaaggccccttgcagctagtgtgttgttgagctgtgggcatgaacaygccacaggcagacactgttttgccagggttttaagaaacacggagggtcctgtggatctggagttcatttgtcaggacagggatggggacccctctgaagtattcactgtgggctgaggggtgctggccacacaacctctgtgggaggcatctcttgcagtgaagctgttggtcctcagttcagtgcccactgagggtaaccaggccccagctctgcacccscagctccctgcctgggatcccagccctgatggcaggtggtttccctctcagcaatgacctcctttggctgcacaccatctttgctgtcatttacctcttcytcactgtgggtttcatgcggcaccacactcagtccattaagtacaaagaggagaacctggtgagtgaggcgggacttagggacatgtgctgggagggactcaggtgggagtcggagtggaagggcctcccaggctctgccacaggccctgactgcaatgagctctgggagggcctcaggagccccgcttgcttattcttgctcacacttggcaccatctttaaaaaaaacagtttcctggtggattgtttcaagatttggacagttactggtgctaagtaaagaaatttgggttgagagcagccctttctctttgccgcccacagcttcacaggggaggggagcttctgtggcttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctccccyggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccggtaagcaggtggggtgggaggggagctgagccccctccacgtaggaccaacacagccccacccgcagggcgagcaccttaggtgagcgccttctgtctctcgcttgggtatccaggtgagatctgagaaggacctggccctgccacacgtgtatggagtggctcctgtgtgccagccctgctggtgctgtgcagtgaatagcgccctggtggcctatcctcttcaagcagcctgtgcacagtgtccagagcacagaccagggtgtaggtgcgaataaacgtcttgagagcatacgggggaaaaaattgttgaccccggggttcttagcatcacctttgcagaataagagagacgtgagctgagcatttgtatggacccacagggctagggtctcacaggtggaaggacctcggggccatctctgcgtttgttcgtttgtccacccactgagcgggtgtctgttgagtgagcactgtgtctgagtccaggctctccctggtagaacctcctttccagcggctccctttgagtatctgcaccaccaattcctgcagatggaggctggaggaaagtctttcctgtgaggagattacgtgtgcagccagggatgcggggaaaggcccagagcatcaggaaaggtggcggtggggtgcaggggggcagggcaagcagtccgggaaggctcccaggaccccatgctggaggacctgaaggctgggctgaggagctgacattttattctttcttcattcctttttttgtaatcytatttttttagagacagggtcttgctctgttgcccaggctagagttcagtagtgcaataatagcttactgcggcctcaactcctggacttaaggcatcttcctgcctcagcctcccaagtagctgggactgcagacacatggcaccacacccagctaatttttaaattttttatggagatagagtcttgctatgttgcccaggctggtctcgaattgctgggctcaagtgatcctcctgccttgccctcccaaagtgctgggattacaggcgtgagccaccatgcccggcctctcttcattccttatcaatacagcagccactaatttgttgcatggactaggagttggctgcactttaactttgcactatttgtgaagaaagcacttgctaagcaaattgctagacaggatcgtaaactgaatgtttaaaatttgaaaaacttcttcagaaactctaagtattttagaaatatttactaatatgtaaatactcaataccagaatcatttttctgtatttccttgaagcaactcctcaaagttgcctgctaggcaacacctggaaacagtaattccacttaatgtataactttaaagagaaaaaaaaagtctcctcattctcatacaaacattgcatgactcatgctttcccctattttaagaggcctttttagtgaatgctgttgcagtccgtggggattgatgtatgaatttgcctttcaagcagggatgcttaaattgcagttttcttcctcacagctcttattgagaccagaaattgtcctactgtttaatttcatgattgatatacctatgggctgtctctctcactaaaatgtaagcacatccaggccctgttaccagcacctagaacagtgcctggcaggtggtaggtggggatttacatggttctggaatcccctggaattgtatgtataattttgcgtgtatggtgagggggtattgcatggtggccatgagcattgaccttggagccaggttgcctgtattcacctcctggctcagacactcactagctgtgtgatcttgggcacaagccacttacctctgtcggcctcagtttactcatctgtaaaatggggacaaaacctcacaggttatgatgaggattaaataaataaatatatgtaacaatacctggtcaatagtgagtatgtattttgctggtttttttttttttttttttttttttgagacggagtctcactctgttgcccaggctggagtgcagtggggcaatcttgctcactgcaacctctgcctcccaggttcaagtgattctcgtgccccagcctcccaagtagctggattacaggtgtgtgccaccacacctggctaatttttgtatttttagtagagacagcgtttcaccacattggccaggctggtcgcaaactcctgacctcaagtgatccacccggctcagcctcccgaagtgctgggattacaggcatgagccaccgcacctggccttgctggttgttaatatgtgtgtagatattttctggtctgagggtcctttgctttcattagaccctctgaaaggtctgtgaccttaaaaaaggctacctgaataggatttcagtgatggctcaaggtagatactgacctagcacaaacaataaatctgttcctttgggtctttagaggggatagtgatgtgttcatttttccccaggagaagtgccagctgattccaagccaagtgggtataaacttgtcagttccaggcagttagcttcatactactaaaaaaggctagcggggtgcagtgactcacgcctacaatcccagcactttgggagggtgagacaggaggagtgcttgaggccagaagttcgaaatcagcctgggcaacatagcgagaccccgtctctacaaaaaataaaaatcagcctggtggcatgtgcctgtagccccagctactcaggaggctgaggtgggaggattgattgagcccagaaggttgaggctrcagtgagccatgattgygccactgtacagcagcctgggtgacagagtgagaccctgtctctaaacaaaacaaaacaaaacaaaagccctctttgtattaaatttcaaaatttcccccttttggaggataaaagacaaagagaagagaggtctccgctggcacagaaaccagcagcgagatcactctgccatcctttcccttggatccgtgggcacgtctcctkcttggggtgttttcttttccaacggtgtcttttgcctccttctctccctggccacagggacgcgtatcccacgtgtgaggtggttgatgtgcagctgtgctacaacgtggccaaactgatctacctgtgcaaggagaagtgagtggtgggcgggccttgcaagatgccccctccttccttgctggcctcgcatctcccagctaggaagggaggcgggaggccctggacccctccttctcccctggcgttcgatggttgaactgtgggtatgggggtccctgccacaggattctaaatctgaggtttgtgcccccgctcccacccctacagaaagaagactgagaagagcctgacctattacacaaacctgcaggtgaagacaggccagcggaccctcatcaaccccaagccctgtggccagttttgctgctgtgaagtgctgggctgtgagtgggtaagggtcccaccccccggctgggagcagaggcattggcatcggggtgccccagataccagcatggggccacgtcatcccaatgggatgtgtcttgtggcaggaagacgccatctcttactacacacggatgaaggacaggctgctggagaggatcacagaggaagaacgccacgtccaggaccagcccctgggaatggccttcgtcaccttccaggagaagtccatggccacctagtgagtgtrggcacatccagaccccttcttggctgactccctgttcccctccagataactcactgtccctctcgagtggagatggtactgctgacccaccatccctgggatttatctgtggtgtttccttctcctccctcagctacccacactcactttcagccagcccagcccatgtttgtgtaacaggcggtgggggtgtgggcagcagccacggagtgggtgattctggctgaccccctcgagctgatgtggcctggccccactgccgggctcttccctgctgccctggacccatcctgttggcttcatgtgccagccttgccccaggggagatggaggcaccctcctttcagacatctgctctgggccacagatccttctgtctgtggctccccaccttcccacaaatgcaaagctgtggggaagacccctggggcacgctggggcgctcactgcagtggggagcttgaccctggggagtggcttttcacagtggcccttggcatgggactctaggctctcatgcctgtggtctcagtgtcatctcgccttaggagcagcacagggtgggtcgggagaggggtgtggaaaggtgtccagccactgccccaggcattgtgacactaggaatggactcacacaggacttcctgcctccttgcagacactggggcaggaggaaaggggaaggcatctgaggcaggagtagaggggctgctgggctccttacgggaggttaaaggaggaaaagctgtgacctgttgagatggtgagggtcgaggtgggagccctgaggagggaagcttgggaacaggcaatgtgtaacgtggtctattgctacacttgggcctggggaaaaagtgacagaatgaaaagttgagccactggcctggcagtagcactgatcagagctccagcttaacaggcagggtggagggggatggccctatggaagagcagtgtgttgccctcagtttccttatctgtaaaatgggaatcgtactccctttgttgctggtggttgcgaggattaaacaaaattctccacacactgtgctagcgtggcacctcttacatagcgttactcataatacactaatcacaacaaagcaaaggtcctatgccactgcctcccactcctactcagtccccacttgccacatgtgtgcttggtaacctgagtagcctgggcctggctgttgctacatttccttgcagcatcctgaaagatttcaatgcctgcaagtgtcagagccttcagtgcaaaggtgagccccagccgtcctcccatagcagggagctctatacctccaagtggacagtcacctttgctgctgaccctgaggacatctgctggtaagctcctagaccaaggagaggtgggagagaggcctgggttcctggtgggagctgcccatcacctggagcacaggtgtgacctggcagtcaatggagatctccacacatctgcaattctgtgggctgtgatgctgtgatgtgctcggtgtggcccaactggggtatctgcccagcccttccctccagtgttcctccctagcattcaagtgctacccagcagaaatataatgccagttctgcatctaattttaaatttcctaatagccatgctaaaaaagtaaaaagaaacagttgaaattaattttaataatgtatctcgcccaatatatccaaactgttatttcaacatgcaatttttgaaaaatgtgagatgttttacattctctttttcacacttagtcttcaatatctggtgtgtattttacacttctagcacctctcaattcacaccagccacatttaaaatgctcagtagccgcatgcagcttgtgcagccttacttaggtccagtgtcagcctggggccgtgctggggagctgagctgtgtccatgggggccctggtgagcctccagtgctgtgctgagggtaagggcacccagcgcaagccccagcgcagctgcctgtccagccctgcctcagctccttgcacagaatgagcttgaagtgctcccctctgctcggttctagttctgcctctgacagttttgctctttggttcacaaggcttcctaaactcaggattgctttgtgggtctgttctttgggatgagaggccagggcaggtgcaagctatgccttcactcctttgtccctgccttcctccttcctgtaccccagctacagcccygttgggaagaatgtgtcgttagtcacaaagcattgcagatgtgtctaagaaatgccacgctggggccgggcgtggtgctcacacctgtaatcccagcacttcgagaggctgaggcaggcggattgcctgagctcaggatttcaagaccaccctgggtaacatggtgaaaccctgtctctactaaaaatacaaaaaaattagctgggtgtggtggtacacgcctatagtcccagctacatgggaggctgagcaggagaattgcttgaacctgggaggcagaggttgcagtgagccgagatcacaccactgcactctagcctgggtgactgagcaagactctgtctccaaaaaaaaaaaaacagaaaaagaaaaaataaatgccatgctggagccttgtttggcctgcttgggtgctcatgccatctctttgggtaggttctggcccccagactytagctggggagccacatctgagagaataattgttccctctgagctcttggggacctaagatttggtctttctgtagttgaaggtcagtgcagagaacttgcccccaggctagtctcttggtctgcctaaatctgaccttctgacccacctaagccacgagcactgggagacaagcctcgagacctgtatcccctctcccgctgcaggaagaacctctctatccagggcctccgctggtggctacagtggctgggcatcaacttcaccctcttcctggggctrtttttcctgaccacaccctccatcatcctgtccaccatggacaagtttaatgtcaccaaacccatccatgcgctgaatgtgagtaactgttctgcaaggcccctcccaggatagctggtgagaagagggcttggtgggtggggaaggagtggggacaggagtggggtgtgtgcggggaactaaaccagtgggtcatgttgctcagctcacatccttgcttttaagccctgagcaggcatggccacatttattacaaagtccttatagtaatgccatacacacacacacacacacacacacacacacacacacacacacattatatgtatatatacacacacatgcatacatatatattttaatagactatctaaatactgaatggtagggatcatttgagttgaatgtggtatattcaggttggtagactatcaagcatccattcaaaattgtatagattttgtggcacccatgcagggctcctgacagaagcagggatgtaccagtgaggcatgtctatcatggacactacggggaggggccaggaaggaaggaaaaaagcttcgttgattggggtggcaggatcacaaattatttcttttacattttggttgctaatgaccttgttataaaactattttggggccgggcacggtagctcacgcctgtaatcccagcattttgggaggccaaggtgggcggatcacctgaggtcaggagttcgagactagcctggccaacatggcacaaccccatctytactgaaaatacaaaaattagctgggcgtgttggtgggcgcttataatcccagatagtcaggaggctgaggcaggagaatcgcttgaaccgggaggtggaggttgcagtaagccgagattgcaccactgcactccagcctgggcgacaagagcgaaactccatctcaaaaaaaaaaaaaaaaamaaaaaaaaactattctgtataggtaatgaacgattttcaaaaatcttagatgaatcaatgagataacagccaaacactcactcaactggcatctactcaaaaagctattggtttctcatgattagctttgccaaaccatctccctagattatttttctttttaaatttcactttgcatttggttaatcattccctgggaaagcacacggggcaggtgggcctccttgtcttcactttgccattccctatctgatgaattctgaacctcagtttttcatccaagaactggagttaaaacacctgcactattatacagggcgtgaggctgttgtcatgataatcaatgagctgatgtgtggttgaagctcttatctgactccatagatagttttaaactacctaagtataaattcagcagctttgcttaagatttaaagcaggtattataaatatgcattcctttgccaatcttttaatagaaggacaggcctattcttttgaagatggatctgctgatgagagctcccctttgtctactttacatcaaccacacccttatttcattgttttgtgattccagtgttggtttctttaaagtaaaggaagaatttagatatttgccgagccattctgaatatagaaacttcctagatcgcatatcccttgatcttttatcgttaatttactctcatctaattaacagcgttttgtttttttttttagaaattgacttttattaagtctttccaaagtagccaacttagttttcaaagaaaatttctctctatttttatgttcatctaatcagtgacagtaataagtcaatcagctcatgtaatcccagtaacaaacagcaggattgtggacacacacagtggagccctgatatgctgcagctggacagtgggagctgagcaggcagggcacccccccccmyrcccgccggccaggactccaggccttcggtgttcagtcttgccatggcatcagtcattggttttgtatagggagcagagaaggttatttaatctggttagtcagataagtggagtttactcgtatgtgaaattgctttctttgctgtgctgtgaggagctgtacaaatataaggtgctgttactgattattcagccaacatttatggactaccaactctgtacctggcacagttttggttctggggtcagagatgacaaactcctaccctgggagtccactgagcgaccataccaataggtcatggcctcagagccgygtggcccacggcccctgtgactctctctgctgtggacctttctcctagaacccgatcatcagccagttcttccccaccctcctgctctggtccttctcggccctgctcccctccattgtctactactctacactgctggagtctcactggaccaagtgagtgcccgggagccccraggccctgcccctaagaaggatatctctgaccgctcccttgtccacaccctaaccccccagctgctcaggcagtgggcacatggcaggggcctcactgggggcacatagagcatttgggggactgcgagtgctcacctttgacttcctgcaggtcgggggaaaaccagatcatgatgaccaaagtctacatattcttgatcttcatggtgctgatcctgccctccctgggtctcaccaggtatatgccaccaccttctgctctaaattcagaataagagtcacatcaggagagcactgtccccaggagaatgcaaacggtttggcagcagaagcaaacctctaacaatatctaagcctgtcgcaaccactcggcgtgcagtagggctgggtcattgattcttctggcaatatgattgattgttcttctttaaaaaagaaaaaaacaccatattggtcaggctgttcttgagctcctgacctcaggtgatccacccgcctcggcctcccaaagtgctgggattacaggcgtgagactctgtctcaaaaaaaaaaaaaaaaaaaaccagcttgaaaattttgtggccaggcacagtggctcacgcctgtaatcctagcattttgggaggccgaggtgggcagattgcttgagcccaggagttccagcctgggcagtctggcgaaaccccatctctacaaaagagaaaagaaaatgaaacttatcaaggaccttccacttagggaaggcctcatcatggctttatttatctcaaggaaggaagtttctgttaaagcagactgtgacaggtcatgccgtagtaagtggcatygttgagaacaaaagtcaatctcgagctttggcctgtttttagagcaaaagaaaatgaaagcatgtgtagtgacaatatggaatgctggaaataaactcttagggggttcctttgtttttcagtctagattttttcttccggtggctctttgacaaaacttcctcggaggcctccatcaggttggagtgagtattgccaagttgagttctggagccatggccctgggtgaaagtcccacaggggctggggctgcagtgggatgggtgggggcggtcgtagcctatgcttcygaacaggcatcttcctccccagacagcagggcttggggcctcacctccaccctgccaggtttctggtagacactgtgggagctgacccactttgtgctatgcttgcagaaatgtggttaattttttaggccagaactcaattagcagctgtctcattcattgaaacttactgagcacagagtcacatggggagaaggaattgctgggtctcagtggtgccagggagtggggaaaggagaataataattaaagatggcagccaggatgcctctgggctctggggattatttttgccagaatagaattaaatttattactgatgtatccttgttagtattttaaacttataccatgccacttaatagtaatagctattgtttaagaaggcactatgctaaatgctttatgcatctttttctcactgtatctttacaatgagctatgaggaagatactattattctctccattttacagatgaggagactgaggtttggagacgttgaataacttgcccaagtttatccagctggttaaggaacagagctgggattcaaccccagcccctacagactatacattaggtcttaatataggtccagaggcttggcattgactttcctaaaagaatgtgcttacctgtaaggatggggcgagttattttaaatgagttcttgctgagtaagctgatgagttgggagctgatgactgtgacagacacacatacatacagccagcaatagtctaggttgacagtgactttcagattgacaagtccagtgaccagctcaatcctcatcttatgatctatcagcgacatctgacacatttatccgagccttcctcctcgaagctcggccttgggtctctcatctcgcagcatcctcttgtcaccctccttggtgggttctctcccatctccccaactctagattttggctgcctgaaggctcagcccccagttctgggtccacactgcctctctaggtgacttcagctgaacccacggcttccatgccatgatactgctcctgaattaacttatgcggacaacatccacatttatgcctctagcctgcacctccaggctggtaacccaactgcccacctcaaactctagctggagttttactgggtaccacggatgttacctgcccaaaaccaaactctcgacttttaccctcaaatctgctactctacaactttccccattccatattgtttttctacttgttttggcaaaaaacctcaaagttcaccttgtttcctttctatccctcccatgccatacccagcctaccagaaaatcctgacaactctctctaaagtagatccagaatcccttcatatctcaccacctccatcacaaccgccctcatcccacatggggatgacacagtggccatctgtgtagtctccctgaccccattggaacagatcccttgtcctgggctggcccccagcccctttcagccttgtcttctgcctcccctcgcccactgctgtccagcccctggatgtgcagcagacgaggacatcctcaggtgtcttgtatgttgttccctttccctggaatcctgtcttcccaggtttggggatgacttgctccttcacctcttcacgaatatcacctcgttagaaaggctcctccaacccctgtatgacataggaaccctccctgctttgttttcctctagtgctcaccgtccccagcagatggaatatttgtttgtctgcttgtttgtgcccccagctagaatgtgaacttcaagagagtggcgcaggggctttgttctattctcagtgcctagaaaggtgcttggcacacagatgtgtttcccaaatatgtgctgaatgaacggaagagtatacagccctcccaggggctttctgctcctgcccagcctaggggcccctcctctccctccaagagcggctctcagctcacagacctgggccctggtttccccaggtgygtcttcctgcctgaccagggtgccttctttgtgaactatgtcatcgcctcrgccttcatcggcaatggcatggagctgctgcggctgccaggtctcatcctctataccttccgcatgatcatggccaagacggctgctgaccgcaggaatgtcaagcaggtgccatcccctgggcccagggctgtgcctctgactccctcccatgtcccccttcactgacccgagggcctctcacccccactacccccactagtgggtagcatttacctgactacccactagtgcaggcactgggctaagtgcttctcaaacccgggtccaggcaggcgtggcctcctccagcctcctctctagctcacaggctggaggagagagcttgggactttggcatttgaaacggtttgatcgcacacatacatacatacaactcaaaccaacagactctttttctgtaggcacccatttgcataaattcttagccaaaccccagatgtcaaaggcattttcggcttgtggcatttattccaggattccctgaactggagggtgtggctttctcttttattctcctctgccatggtgggcactgtgcgaggaaagtgggagaagtgctgcattccttcatttcattctcagcccccttatgagctgggcactgctagtatcccgatttcacagaggcatgaactaagctggcccaggatcccctgctagaagggctggagtcactctacacctcttccctgaccacctcttccctccaggggctcacatgcctgttgggtggaacgaagggagcackagcaaacacgcatcaccatgcctcgggagggctgggtgcactgagtgaagcarggcaggctgggagggatgggaaggaccttgggaggcggggagccacgcatctcctatttccaaagtcctcctccaccctgctctcccatcaccacttagagagcacaraagggtgtttgaggtggaacaagtccatgagctcctcaccacctcctcctcccagaaccaggccttccagtacgagtttggagccatgtatgcatggatgctgtgtgtcttcactgtcatcrtggcctacagcatcacttgtcccatcatcgcgccatttggtgagtggccctggagcctgtcccagggtacatgggtacatggacggctgattgcaccaaacctctcggggacagctatcaccagggcacaatggagttcccaaaaccacagccacaagagccacaagctgctaaagactcacgtgacaccagatttcactcatttctttctttttttgttttgagacagggtctcatgctgatgcccaggctggagtggcatgatcttggcttactgcaacccccacctcctgggctcaagccatcctcccatctcagcctcctgagtagctgggattacaggtgcccgccaccatgcctgcctaactttttgtatttttagtagagatggggtttcaccatgttggccagcctggtcttgaactcctgacctcaggtgatccacccgcctcagcctcccaaagtgctgggattataggcatgagccacagcacccggcctcattcatttttaaatgaattcctcccactggccctcagctaggacctctcttagtatttctggtctgaggttctctgcccactgactatgtcgttcatggttgatttctttagcagcaagtaagacagtgccagagtcacaatcaaagctctcgtgctgctttcactctggcagatgcctgcctccacgtggattaccacatttctcacctcatcctacaaggcagttcctgtttctattcccccttcacacaaaataacttcgtatgttgttagtaagcaggagaaccagcctttgaactcaggactgtttaaagaccaaggtcctggccactgaaataaaacatctgcaactggcagattaatgaaaggctctagaaggaaacaaaaaacccaagagactgctggcagtgatagctgagttttagggggaaaagttgttttagttttccctgtatactttcttgtgtagttttaaaaatctacagtatttacactttcaaaacaaaatttattttttaaaaaagaacctggggctgggcacgatggcttatgcctgtaatcccagcactttgggaggcctaggcagtgcatcacctgaggtcaaaagttcaagaacaacctggccaatatgatgaaaccctgtccctactaaaaatacaaaaattaactgggcatggtggcaggcgcctgtaatcccagctactcgggaggctgaggtaggagaatcacttgaactcaggaggcagaggttgcagtgagccaagattgcaccagtgcactccagcctgaccaatgagcgagactccatctcaaaaaaaataaaaaataaaaaaacaaaagaacctggcataatagaaaaggcagcacccactttctgttggtcccctgtgtgctcctgtgccacccctggggtaagacccttgggcctcattctctgttgactgtgatgagggcagggatcagccgggtgggagaaggccaggggtgtgggagcactgacatacaggggctcagcatgggaagggctggggaggaattgaggccaggcatccaactgtgaaacagcctctttccaagatgattctggaatgttagtgttctgtggggacaggatcacagacactgtgactcccttggtgcagggtctgtcccacagaccctgacccagcgacggatgaaagacatacactgccgggtgcggtggctctcgcctgtaatcccagcactttgggaggcaaaggtgggcggatcacgaggtcaggagatcgagaccatcctggttaacawggtgaaaccctatctctactaaaaatataaaaaattagccgggcatggtgtcaggcgcccgtagtcccagctacttgagaggctgaggcagaagaatggcatgaacycaggaggcggagcttgcagtgagccgagatcgcaccactgcactccagcctgggcaacagagactctgtctcaaaaaaacagacagacagacatacactgacagatattttgcctgtcagtgcggctaaggggctctgcagcctgagtctgcagtgtagtcctcaatgccaggcgaagttcgcatttatttagtacagactaaatgacaaaggtctcgagtaaacaccactagagggtaattaacattgccgaccccctgaatagcgagcaatcatgcaccagtggatgatcaaaggttggtcttaggaccacatgagkaaacaagctatttaggtaaactcccccacattcctatgtatctgcaccctaagcttttaagagaattcagctgccttcagccaaaccctttactgaagctatgcaaacctctcggctttccaagaaggtttgtgtctatttcctataactttatcttaaattttctcccaccaccctgaccgatcccctacaccttggggtcacagataagtgaggaagtgggtaggagagagaaagtgaaaaaaaactagtagccagaggtgcaggatgcctcattttgtgttcaggcagtagagcagcagccccagccctggctccttgccaaaatagccgccccggagaggaagaggacagaggtgtctgtgtggccctgcgaggtctccagctcacagccccatcccctgcaggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtgagcagcccttctgacctggggccagcccttggcctcccagccctgcatccccaccagccagtcagatccctcattgctttcacagcatcagcatggcatccagtcagaatgtggtgcccagagtgagggctggttaggtgtcccatcagaacgtggtacccagaatgagggttggttacatgtctagtcagaatgtggtgcccagagtgaggactggttaggtgtccaatcaaaacatgatacccagggtgaggggctggttgggtgtggtgttgacagcctggctcctaagctagcccgagtgcaggtgtaacccttgtgaaggcctggtcaattgtcccatacatccctggagagaagatagtgcctttatcagctgtgcagggactgaaccagaggaaatggggaagctgatccagatttgccctttgaggctggtggttgggcccagctccttgtacctcctggcatggaagaggtggggacgtggaggagagaaaactgacactcctgggggaaagacacgtctgccccggtcagactgggggtgtgggagggtccatcctctctagcccagggcactggagactggagggaacggaccagcaaggaggctgaagaattgccattgacttggcaccccagtgcctgaaatctgaccagggatgatgccagtcattcagtgggtccctctgtgtgttcctggctgtgaagacaccatccttgctgctggagttgaggggtgggggtggggggttaggccttgcctttattttctgcctgagggagaagtcacgggcagtttccacaccaggtgcggccccttcctcagcagggtgagggtaggtggtggcccctccctgcccaccccaaggctagccaccctctatcaccaggtatgaaggcccccgccactctgttcaccttcctggtgctgctgctcaccatcctggtctgcctggctcacacctgctttggatgcttcaagcacctcagccctctgaactacaaagtaaaggcccccgaccccactgcccggtcaagccctgggaggaacagatggtgggacgggctcgctgtcaaccccgcccacccttgtctgtatcaacacagcagcagccttctccagattctgcttctccatgggaaaggcgtgggtggttgggtgccatgtgtagcttcccttcctcccctcatccctgcactcccccaccccatcctctctcgggctgctggggagcttggtgccagctggtactattattccgggtgttaatagtctgtgtgtttggagggtgttygttcacagagatcagttttgtttatcatcgcaagtttttgctgttatctgcagacagaagagcctgcaagtgacaaaggaagtgaggcagaggcccacatgcccccaccgttcacagtaagctgtgcccctcagcctctgagcttgtcgcccttttttttgctttggttgtaacagtcccaaccagatgggccccggcaaatctttgatcatctcttgctaagatcacatggcaggcaagtttgtgaattaatggcagagaaggaatcctggtccccctgggtattttaacctgcatatttgaaactgttgaggagatagagtcttgtctcgattcatggccatcccccttggtttcagttccctgctctctttccttctctgcatatttaatgcctggtgagtttggggctttagtgaaggcacatggtaaggcgctagggtttgacaaaggtttgtcatcagcgatgcacctgcctgtgcgaggtcctccactaggctccaagagggtgtcaggcagacttccctttgaattcaagaaatgaacattgcacctgcttcagaggaagaccccatggtagagagacacagggctccttgccttcctagttctctctgcacacagcctccagggtcctgctcctagggtggggctgggaagggaaagcagagccccagggttccagagctgtagtcaccagccttcctgacagccgtggccaggacagagccgacctcatctgcagggttctttctggtggctgcctcccaggtgtcaggctctcttatcggtgtctgtccttggacaagttccaaacaagggagggcctcagaaggactcattacccagcgacacacctgtggctatgctggccaagcagggaacatgcaggacaggtggatgatgtcaagccctcacagccagggtctcaggaggagtatggcagggctctgtgcctggggtcagtggctggagcctgggattgggaggaaatgagactcaaaatgagactcacacagatatgttgagcatcccaggggtcccagggcagcgttctaagcccccctatataggtagacttgtttcttctacaaagtgagaaatcctcctaggatccagggctaggaagtttagtttcctctgagaactgctctcttgtgcttccttctgtgatcatgagaactgtataactgtgctttctcttttgccctggctgctaggaaattctgcaggtgtcatattttcggtcttaatgtcctaaatggatgtcggtgtttcttcatatgtcctttatggccactgtctgtgtcctgttgggagaagggcaggaggggagggatgcagtgtggaagctcatgcctgtccaggccaagcacaaatccatttgctgacagccctaygtgcctcggattctgaacggcttggcctcggagaggacagcactgtctccgcagcagcagcagcagcagacctatggtgccatccacaacatcagcgggactatccctggacagtgcttggcgcagagcgccacrggcagtgtggctgctgccccccaggaggcctgaggctgggtgagctgctggctgggccaggctcaggggagcctgtggggtgagaagacaggtgaagcggcctgactcccaagttcatgacttcttcccatctgttttaggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccktgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagyggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaagccatgttgcttaccacacggagttgggggttggggagtgagcttggaggggtgagggggtgagcgtgggctcccagcatgggcaggggacggaggcaaactcattcctcagaaaaggggtatcttccccaagaaaagcctggagggcacttgtggggggaggtggcaggcggggggagaggggtgggtcattgcygctccagcaccgacaggaacttgcggatgtcctgggcgagcagctccggctcctcaaaggccgcaaagtggcccccacgaaccatgtaggaataggagatgagctttgggtacttgaacctcacccacttttcaggcgtgtgcartagctcaaaagggaaggcagagaagccagtgggcacatagaccttcatcctggaagtgaaagagccgacggaggggtgaggctgtggccctgcgcccctccgtcctgcacagcagggggttaaagcgcctgggggtgagatcagctggcccacccacaaggagccataaagaaaaggacaaatccagggtctcaaccgctctcccctcactgagggccttctcttttctgggagggccacccaggcaggggcatgggacagcctctaaatccccacctttgagggtttccatgtgagacttggaaatcccagaaccatcagtgccactccagaccagcatcctagactggggagcggtactgagggccgcccgggagccaggcacctggtccctccatgagggctttctccaaacacctcgacctttagtgttcccatccaagggcccctggggcacytgcaggcaaggctatacttatcccaccaccaagtgcccttcgtggagcccaagactggccgtccccctgcctccagcctcagaggcccctgttctcggctcagccaggctcaccgctcwtgcttctgggtcatccagccctgtcccaggttctccttgkagaagcgctgggaggagatgatggtgcctgttgtccagtagagcatgacrttggtcagcaggtcgtccagggagaacttcctgggaacgcagaacacaaagccccactctcagtgccacatgcagttgtgtgacaaagggcagccagaaagtcctacaaatgccaggccctgcccatgcggcttccctcctcagacctcatgcaacgtgtgtggtatcctcgtgtcacaggcaggctgcgcccagggcactagactggagcgcatggatttagttgaagtgtctcttatcaccccaaggtcctccccccacccaccttgcctctacacacctgtcccctctctcctgccactgacctctcctccctcccctcaacccctgcaccgtgaaactgctcagggcaccagctactgtggtgaccacataccaggcagcatgttctaagctccttaccttcttttaattcatgttttcctctcaacagcctatgggacataggtactattatctccattttacttattaagtggagaatccaaacctagccagcttgggtccaggatgcatactccacagcccccaccccaccttccactttccccagagcacgccctcccaaccctaccttcctcactcaaaccctgaatctctagcaacagcagcagggagcagggacagagataaagggaacagccttttcaatgtgattttggtggcaaaatgaaaactggtcaatgaaaactagttccagtatacacatcacctctgtgaactggatttctgcaagttggccaagtgcttccatctccctttcggctctgcccgcagcttgaaaacgaccacgaccaccatttccaccctagtgtattcctgttctttctagaacacagatctgatcctgtctacctcctgctcagggatttggtgctccctgtaacccggggccagagctgcaggagtggcctagtgggatagtctggtggggcctcacatcttgctccaggtatccgtgtgcaaggagcaggccagaccccctgccaaggtggtcttgcagaagctccatcaacccctgtgtcctgctgaatgtagggcaggggaaacagatcccagacgaaggccctgctgaggctcttggaggaggtgaggacctgcctgcaggaatgagtttgcttttgatctggccccagtgtacctgcttcagcctctggacaagccaccctttccaagcaccctttccttgcatttttattgcttttctctttgcctaagtttctctcctccatccagcaaactcctacttatcctccaaggcccaaatcagatacattctcctggtcatttcccctctctgccgcttagacaaagaatcctccttccactggactctcacagtcctttgcgcattcattcaacatctatgtactgggctctcccactgttcacccggcattgttctaggtgatggggctacagcatggccaagacagagtccctacccccaaggcaggattcagtctcattttactgtctttcccatccccagcactgtctggtcctgtgtgtcactgaaggaataaagggatgggccctggaaagggtgggtcagagctgaccttggtgaagcctgagtcaggccacagagctgggagtcaggcatgtagaggatacagcctctaaggctctgagagattaacagcctcctgtctttctgcgaccaccctcctggaacacgcagtcacgtgaccctgatgccaggctctccagggaatcaggaggaaaagcccaggtgctcttgacaataatgtggtgcctgctgccctgtgggctccctaatccccagaggggcctgttcagcaaaaggagcacaagcaggtgagcctgcatcctagtcttgaccatgcactgtgaggctgggaacaacccaccaggccacctcacccaaaaaatgcagctacgttggtcacagggtgaggatttgtaagaaagccaacaatagaatttgctgagtgccccatgcagagcaaccagacaaggggatgaagagggtgaggaggttggctgctgggaccagggtcatgactgcaggggcaaaccagggcctcacctttccaggcctccatcctccaggtatcggaattccgtattggtccaggtggaaaacttctctagaatataggcagccagacccacaggagagtcattcagagcagagcctggcggggagcggggagcaagggagagactcaggcctggggaccagagagctggagcttcaggtgtgatgtgtggcactggccgcagagggcggggctgtgtgcaggaagccacgttcgagcacaggcctgccttaactcctgggtgctcacatgcctcgcttccttaactctgcctcggcatcctcatctgataaacagggacgataccttcccactgtctcccagggcctggcacactgcctgctcagcttccttcaaactgaagggcctacgcctctgcatttggtggggtcccaatgagaagtgctgtttttaaaaaggcggggtttttcagtctatgtgctctgattcatgaaaaatgagaagccacctaaaaaagtctaaaataggggatcagttacaaatattgatatactcataagccaaaatactgtacagtcattaaaaatggctggaacaggctgggggcattggctcatgcctgtaatcccagcactttgggagggygagaaaggtggatcacctgcggtaaggagttcgagactatcctggctgacatggtgaaaccccatctctattaaaaatacaaaaaaattagcagggcatggtggtgcatgcctgtaatcccagctacttgggaggctgaggcaggcaaattgcttgaacccgggaggtggaggttgcagtgagccgagatcgtaccactgcactctagcctgggcaacagagcaagactctgtctcaaaaaaaaaaaaaaaaaaggctgggacagtgggacaggctgggtgcggtggctcacacctgtaatcccagcactttgggaggccgaggcgggtggatcacctgaggtcaggagttcgagaccagcctggccaacatggtaaaaccccgtctctactaaaaatacaaaacattagccaggcatggtggcaggtgcctgtaatcccagctacttgggaggctgaggcaggagaattgcttgaacctgggaggcggaggttgcagtgagctgagatcacaccactgcactctaccctgggcaacagagccagactgggtcttgagaaaaaataaataaataaagctgggacaatggcataaatgaatctcacaaacataatattgagcaaaagaagccagactcaagggtatatactctgtgattctattcataggacttaaacaggcacaatcaaaaccatctcagtcagaagtcagagcgtggtacctgggagagaaccccgaggggcatctggagtgttggggccatgttggtgatatggacgtacttcacttgtgaaaattctcaccaaaatgttcacaagttcttttgaaggagaggggatgtggggagggagaagaggttatatgagattgtctttaatgttttgtactttttgcatttttaagctttttgacaacatgtattttataatcagagaaaaatgctgacttttataaagtgccattattatgattatgagctgcctcgtgtgtgtgggcatgggtttgccatgaaaactatgaagaactttgagatgggcaagacaattcctgggtgtcttctggacaagatctagggagttacctagcagaccttccggactgacgtgatgctacaggggtcccatctttccttgtcattgagctattttacagttctgtgaattgtaaagaactgagggtaatgcgaatgactcttgttcatagaggcaaatgaattttgtcccatggagatttaattgatattactctgtggatgttgacaagttttgtgtctgttagcaaattaatttcagtgttcttatttgtctttgaattgtttctttttaaaattttactggttcctttataaatttacctttttgaaaaagtattgtcctttaacaggaccctggtggcagacatggttgctgggccctccctcactgcctgggaacctcttccccaaggccccagggcaccctctcccctctcccctgcagccccagagctgcccactcccaggattcctcctacctcaccccctccatccctctgcttctcagtgtaggatatagactcaggggtgggagatcaggggtgaaagccactatgaatactgagtcggctaaacagagttgctaaattggcctgggaatctgctgagggtccatcctcttgattctatgggaaaatgcagtttaaagatctaaagagctgggaggtccttacaagaggcttccttctgtgggcagcattggggtggggtggtgaggttaccccgcgggtgtctccctgccccagtggagccggcagtgggcgaggacccctgagcacactcacctacggtgtcaggcttggtgcactggatgtgcatgtagccgctctccctcatcaggctgtaraataccttctccttgacrgggtacagcagctccacatccctctcagtgaggccaagaaacctcccgaaacgctgtcccaggaggagggtcagggtagagaagttgctyaaaaccaaagccatgttcaartgcaggcctttcacgtggctgaaggcagagagaggggccggggtgaggctgggctggtgtcaaggacagggagagaggagagatggcggaggaacaggcctcagggctgaggagcgagcacagagccagcctctttcagcactggccccactggggaggccatgggagttggagaagggaggttgggggaaaaatacagtttctggggagttctgctcagggctgtcccagagcttggtccagcagagaggtctaatgcctgaccttcccctcctatcacaggccttctctgcctgggaacctgacccagagccgcaaccctgggttacagacaggaggatccaagtcaacgtgcctcaggcactgctgagtgacaggtcacactccctcctctcccctggggggtccttggcccaccctgcacacaggtccacttcttagaggacacacacacacacacacacacacacacacacacaccaccccaacagtgacctcacctgggcaccagctgggccatattagtgcagatcagggacccccagtcccctccttgaatgtagaattcctggaagcccagccgcagcatcagcttgtaaaagatcctggcggtggccaccgagttgaaccctggcagtgatggggaaaggcatggagtcacggagtcacaggcagattgctccttgggccctctggtgttctatgaaatttctcaggcccgcctacccccaggtggaggtcagaaaagctcacagaggcaagaaggaatcctggagcccaaatataggggtggcatctccagccccggagggcggtgtgtctggggccggcctctcaggcccctcctttcccagcttcctcgggccaactccctgctcaccccgccggaaggagagcctggtgggaacaccgggcccacccttggcgaggacggggcagttatggaacctctagcagccccgtacccttcttggaggatgcctctgagaagccatagccagggatggaagggcagatgacttcaaaaacgtgctcatcgctcaggccatggttcttggggtcagtcaggagtgggatgatcttataaaactcgtagaaagagccgggccagccgtgcaccatcagcaagggcttcggggtatggcctgcgggcagctgggggggcttcacgtggatgaagtggatgtccagccctggggggacagagcacagtcagggtggagggagagagaagaccctgcacggtcaggctctggcaccccccagagcctagatattgagtcctgccacccttagtgcccccgccsccccttcatggtattgacagtaataagggctgacactggtttcacactcacactgtgctccaggtgcacagatgtcctcactcagccttcacaacctccctgcaagggagctacgattattgcctcccggtttccttagaggtgccccctgacagctgggccaggtctgtacagccactgctgggtttccagggctcaggacagctcctggctcacagcaggcctccataaatacttgttcaataatttaaaatctggagggtagggagaaagccccacgtatccagcaatacaggattaatcaagtatagtttgacagtatactggagtccagtacagtcatctaaactgacaaggtagatgtatatttatttaacatagaaaactgatcagaagatattgctgggaggtaaaagcaaatgatcaagtcatatccattgtgtgacccagtttttataaaaagtcatctatgcttatactgtacttataccatgtattggtgaattttaaaagtctgggaggataaactccaagaatgtaaaaagcagttctcctgagcagtagattccagtgcttttaatttctctttgagttttatgtactttccaatttttctacaatgaacaggtattaaatgcataatttttttcatacacattgacaaaatgtcacctttttctgattaccaaatgatattttctttaaagtggaggatttttgggcctggtgtggtggctcacgcctgtaaycccagcactttggaaggctgaggcgggtggatcacctaaggtcaggagctcaagaccagcctggccaacatggtgaaaccccgtctctactaaaaatacaaaaaaattacccgggcatgctgacaggcgcctgcaattccagctactcgggaggctgaggcaagagaatcgcttgaacctgggaagcagaggttgcactgagccgagatcacaccaccacactccagcctgggcaacagagcaagactccatctcaaaaaattaaaataaaataaagtggaagatttttttttaagtgcaatgctgaaaacatcatcatagccaagggcaggtgaatggattcttgtctcctctggactgacttggggcctctgcatatcaaaagaaggcagccccttcccaggccagtgccctggacagcacctggggccttacggcattcacagtgagggcggctgccatgcttggaactctctgccaccagggctggtgcagtcagcatggtctagctaatgttctgttctgtcgttaatatattatacaaataatacatgtttactgtagaaaacttagaaaacacagataagccaaagggggaagactcacatgtaatcccactctctaaagaaaacatggtgttgtctgtctaaactttattttggaacagttttagattgctgaaaaactgcaaagagtccagaaaactcccatatacctcacacccaccgggtttcctccattattaatattttatgttagcatggtacatttattacaattaacgaaccagactgagatattattaactataaagtccattgatttccttagtgtttacactttttattatatggcgagaacacttaatatgggtcctacccttttaacagattgtaagtgtccaacactgacggcgctctgctgtacagcccatctctaggatgtattcggctggcaggactcaaactttacacagcaacgatcagcaatgccgtttcccctattccccagcccctgacaaccacccttctcctctctgcttctgctgagtttgactatttcagattccttctataggtggaatcatgcggtatttgtcctgtccctggcttacttcacttagcattatttcctcagagtttattcatgttgtcacacattgcaggatttcctttttttttcttcttcttttagagatgaggtctcactgtgttgcccaggctgaagtgcagtggcacaatcacggctcactgcagcctcaacctcccaggctcaagtgatcctcccacctcagcctctcaagtagctgggactacaggtgggcaacaccatgtctagcctatttttgttatttttttttgtagagaaggggtctcgctatgttgcccaggctggtctcaaactactgggctcaagccatcctcccaccttggcctctcaaagtgttgggattactggcgtgagccaccacacccggccaggattttctcctttttaaaacctggataatgctggtatctacacacaacaaaatatgagccagatttcctcagtttttcccctgatatccattttctgttccaggatcccatccaggactcacacaccactgagctgtcatgtctctttagacccttcttggctgtgacagttcaaactttttaaaaagacttagagaacataacttttaacaaaaatagaaccatacatacattctattttagaatctctttttttttaacttaacaatgtatcctgggtgtcctcctatgttgccaaatttactcctattctaaaggaccaaggccaagaacaggcctccagccccgggcagggtgccagaaccacacatgggtaagtccacgatgaattcaatgctggaaactggctcttttggagccgttgtacctgagggaggttttgtaccataaatgcccaatgtcagctgggtgtggtggctcacacctataatcctgatactttgggaagccaaggtgggagaattgcttgagcccaggagtttgcgatcagcctgggtgacatggtgagaccttgtctctactaaaaatgtaaaaaaaaaaaaaaaggaaagaaaaaacaaaggccgggtgccgtggctcatacctgtaatcccagcactttgggaggctgaggcaggtggatcacgaggtcaggcgatcaagatcatcctggctaacacggtgaaaccccgtctctactaaaaatacaaaaaattagctgggcatggtggcgggcgcctgtagtcccagctactcgggaggctgaggcaggagaatggcgtgaacctgggaggcggagcttgcagtgagtcgagattgcgtcactgcactccagcctgggtgacagagcgagactccgtctcaagaaaaaaaaaaaaaaaaaaaaaagcctagtgtggtggtgcatacctgtggtcccagctacttgagaggctgaggtgggaggatcgcttgagctcaggaaattgaggctgcaatgaactgtgatcacaccactgcactccagcctggctgacagagtgagaccctgtctctaaaaaaaacccagtctcatgaagaaccctgaaagggtccagtggggtaaggctggcagctgccaggatggaaagggccctttactgcctcctgcctctgggcctttgaacatgctgttcccctttcttggaccaccttccccacacacctggcaaagtcccactcatttcagcttagatgccacctcctccaggaagccttccctcacattcaaaggaagattgtggggctcatgaagctcccagagcctcctccttcagaacaccgccactatgtgctggaattgcccctgaagagcctatgagctgtgaaggagggaccctgtcctctctatgcgtccccagccccagcagaatgcctgggtacagcaggcgccctgttagtttctgctggatggacactgaagagctgggacaacacagggatccaagtcaaactcaaggaagccaggcaatttcgtgccaggaatcca

SEQ ID NO: 17745 - DNA, 244196 bp, Homo sapiens
  misc_feature (1)...(244196): n = A,T,C or G, or insertion/deletion polymorphism (see Tables 1-2)
aatttatggtatacaaaaacagttatgtaatacttgatatgttttccaatttagagagttatgctttgcaatagaagtccctgcttagtacttacggctttcaagatgttcatgtatttacaaaatattgatataattatgattttatttcacctctttaacacattgaattccttttttttctttttcttcttggaaaataaaacatgactttgggttaattccagcagtattttatctttggaaatgcatataaagctataaagtgattttaaaatcctaagagaaagagaaacctgaggtttggcatcaggataaaaattgctcattattatttatcttttttattcataaaaattcatccacagatataactcgatattttgaaagctttaggtacaatcaatggcattatcttttaattttaagctttatttaagagatttaaagagatttcattcattttaatatttaacttataaaaatataaatcaaattctaaaatgcayaatttataagagcagaattaataatgagagcagatgtgtaaaaatataaatgttttcacatataaaatctgtttcggtattcctagtttgaactttaagtatcccagacctcaacattaaaatgaaatcattaaaattgctacattcctatctcatgaagatgttatgaagactaacaaaaaaccattaagtattttaaataaaaggaattttcctatgctggaaaatgcattttgtttttaacaaaatactcttatactaaatgtttttttttggaacccaaccatttatattcatatgtaattttccagtctttgtaaattagactgtgaaagcttttgaaatagtatctattgtttgtccagcatttgaaagtgcaataatttcaccataccactactggcaaaaagcataatattgggagggttactaaacactgaaaatctgcaaaacaaattaagttgaagttatttaatacagatgttttaaaaatcagatctatttcaatatttaaccatatttgccggccttaaatcttgtatttggcatttgttgtggaatgtataagactcatataaaaataacagaaatattgcatatgtttcagaaaagtatctggtgtgagtcttcagatttttgatgcacatgcatttggtttcagacttaaatgattaggtgcgaatggtggaggcataaaacaattacatacgatgtctagaaataatattcacttcaagtcaagaatactgtcaaatggtatcagggtggatcaatctgtgaagaaatgatagaggtgagaaagaggatcctacttattttagaaataatgtaatgatgtatttggtatcttgttgccttttgttatttataaagtaatgtcaaaggaaaattagtggtacattctcatttaactatgaaaattaaatttaaaaaattatgaaattgttatgaataaattcttaaattatccctttaaagatgctaacatctctaccttcagcaaacttattttgttaggaataaccaatgtgaatcaagtcaatactactcaagtgatagttggaacactatagaaagtaaaatatcttggttatacattagtagtgttgtggtacacttcctttagttaaccatttagaaaatggtttactaaaacatgtaaaatccattcttccacatctaataatagaggtattcctgctgccctatacaacttggtaaaaagccatgttacattttttgctgacacacattcccaggatgccctaagagcttagtaaatgccaaatgcattcatttgagaaaaaaagagatacagagagtaaaggtatgttgacaaaagtccaaaatatatctaagtttttaccttgaattactccattctctgtttcttccttctatctttgattggaaaattatgaaaaggaactctgatagcttcctgtgaatatagctaactaaaatatctttttaacagaaataacatgaacatacaaggccatattccttgtttgtttggtgttcatttagatccaattttattttaggtccttttaaacaggatacatctgtcatctctgagatgtctctttcaacactccaacagaagaaggtaaaaatcttcttcatctgaagatattgttgtataatggaaattgggctaaatttggattcctctaatgttctataagttatttcagagtaatgttgccaaaaattacccaacccttactgtaaggtttttgtgagctaggctagactatggaaataaatttctctgtccctcttccaccaccacgctacaatacaatggcccatctgtgaggtcagagagactaactttacttttaaacagagactaatttctagccactcatgtattagaaaaactrtaaaatgaatgtcagactgcttagtcatttccttctcaaaataattgacctaaagtttagaaaagggcaagaaaggcaaacctttaggcacagtaagagagggattacatgcaaaagcaattttgttttaaacattttaagtatttctggtgtgtgcaagagccctcaccccataatttctcattcaacaaatcatatttgatgatataattttaattaaagtaaaatgtttagagaaaatacctaatttatatctatctatctatctatctatctatctatctatatcaaaaatagggggatgaaacatcagtatgagaaaaggggaatacatgccaagtgacttaaaagatgatgcactgtttataaaatcgtgttacctaatatacttcttctttcccctaattctagctgtagtaatttaaggattgttatagagttctgtcaatattttaatactatttgtattaggggcatccagctattgtcaaggtgtcttcagtctccctttggttgtagaggtcttaatgtttcaaacactggttctgagtccagctcccctgattcctagagatttgtgaagatgtgaaggatggtttatgagctttttacaatgtttcataaagttctgtgggctctgaagattgtttagaactttaagtttccttactttgacctcccaatccattgtcgaattattatctcagtttctctgacaagccaatatggacgaatggttaatttaaaatgctgctacagaaaaattactattttttctctacttttcaaatcctgtttttgaaaatcttgccaataataactaattctacaaagctgaaaaaataactttaaacatcattatttgtaaatgtgacaaaataggaaaatatcaccgattgtgcttcaaactaaagacttatgtcaggaaaactgcctgttttattatattttgaatctacacgtaaacaattagcaaggactggttgaaagatggcccaggaaatgatgccattggaagttcccctgtgtgaagttgaagttagctaaggtgcctctcttctggctttcccctgctcccattgttgtttagtattatcctttctttcactgagttaatctcctgtaaatccatgggctggttcctagggaggctctagatctggcatctagcaacagactacagggcttagatataattattcctcaccatgaatttgctrtgtttccttctagaggcattcattgagacccagattatgcctagctgggcagtggccagaggaattyagaccacaamgtacagagagcataaggtggtaataactctattcacccaagatgctttgcctgaaaggaccctttcacagcagtgagaaggtctgagttgtgaccagaaagtagggactgctagattgactgcatcatttctcaccttctagaacagtatcaggccccagaactctcaataaatttgagagctattaagagacaatttggaacaccatttgtacatgttgctacaagcaccgtaactctctctggctattgaattgatttagaattctggcagcttcacaaatacgtatttctaaacttgcattcatttcactattttacatttgagagaagatgtaaaaagtaatttttaaaatatctgaagagtcgacagaaaaatcagtttgtacacaagtttggaaacagccaatatatacaaattttccatctgtgagacgatgagggataatgaagatggtaaatacatatatttttactgtaagggtcttaatttgtaattgtgcatttcaggttcaaatgcaatatgatattaaattattttaaccaacagtttaaggttgtaatctgaagaactagttgatgatatttctctgcagctgatatgaggcatcccaaacattctgccaacagcattacaaatgtcaagtatttttttacctgtgatctaagagatagcttcttgataaaggagtagttctttgttatggagagtgatatttatattgaaggtattttctagttgctttcttcagtttatatgtctctgttcatgctgttatacccctataagggctcaatctagtctttgatcacctttcttccaattttaaactgcatgaagagatttgatgtaatctgatagatcatgaggcatattttgatgactaatagaaaactgagttcctaaagattagtggcagctgtagaattgaacatatgtacccagtaaacttagttgagggcctttaagcatttaaatgacttaaatactcaaagtaggccctggccaatgcttctagtctttgtcaacagaaaaatgtgttcattcatccaacccatctctattgagtggctaatgtatgctggcaccctgatgggcactgttccagaaaatctttgagagaaacatcttaggaattattaacgaacaaaaaggagtcaatagaatggaatgattttaacgtggaaaaagtgacttgggaatctatattccaggtgtaagaggattactttgaggatgggttaagtagagagggaatttagaaacctgccctcttcattactctcactgtggagtgaccacgtttttggctcccgaggctgagggccagggccaggcccttaatgaggagctgtgggccgagcctcttggagatttctgctagttgctttcctcgccttttctacacactcctcagtaccccctcatccaggatcagaacagaatcagctggaaaattaaattactcaccctcttaatgtcagctcccataaattttttcctccttctccctcagagtacagttcaactcttttaagaggaaagccactgaatgaacctagtgctgaatttaaacgtttaagagataaacctgtcagtttcagatctccaaagaggacttccctacatgctctaggttttgacttctagggtccctccattctatcttcattcctttcttctaattattgggttaaaaaaataaaaataaaaacacttttcagagtaggcagcgcaatgagtccactgkttccacgtctgccatacgaagcagatttttgcacaaggataaggttaccgctgccagcccaggactccagcggtgtggccgatcaggcgctggcctcctcccctctcccgccgaccagcgagaggctaacagacgggtgcaagtagacaagtagctgtttttattgaatacagaagctccttgaaaactccgtgtgctccggggctctcctgcaattcctttcattcccaaagtgctggagccaagcacgcgtcccccgtaactccctcccattttttctcggggatttggtaggcgaggagggaggagaggagtggggagatggggggtggttggtgggctgggcctgctcggagtcctcattcttgggctgagggaggcgggggcgggcttggggccgccccagagtcgtgtgattgggtctgaccctcagcctgcttgtcagtttcgccctgggagggggagctgggagcagggaggggagtgggcggaggagggggctgcccggagccactcgtccagcccactgacggcatgaagcctttaggggcacacagtactctcagcttgttggtggaagcccctcatctgccttcattctgaaggcagggcccggcagaggaaggatcagagggtcgcggccggagggtcccggccggtggggccaactcagagggagaggaaagggctagagacacgaagaacgcaaaccatcaaatttagaagaaaaagccctttgactttttccccctctccctccccaatggctgtgtagcaaacatccctggcgawaccttggaaaggacgaagttggtctgcagtcgcaatttcgtgggttgagttcacagttgtgagtgcggggctcggagatggagccgtggtcctctaggtggaaaacgaaacggtggctctgggatttcaccgtaacaaccctcgcattgaccttcctcttccaagctagagaggtcagaggaggtaagaaaaaatggatttggggaggtgggagattgccgtcggtcctactgcttctgcgcccctccccccactttacccttcytccccgctcttcaagaaaaaaaaaaaaaagcaattcccttaaatacaatccagattgtagctgctaccaggttggaattggaaactggagaaagagatgaatgtaggcgggacaataaagggagacgaggtaggtagcaggaaaaaaagatctgtcaggaggagagcctgctgaaaatgcccttcaccactttccagcctctttgaaaagaggaaaaatattaccttgaacacaagggcagttatacaaagcttttgtttgaggcacagtctttagactgcccttggaacacatctggtttcttcagattctaactaatgggaatatctttttaagggtgagctgaggagaaaatataaagggtataaaatgaaccttgataaagttctttgtctgcaaccaagtgagaagcaggctgttttagttttggggatataagagaaaccaggggggtgaatctagaagattaggaacactctgtgtgtttggggggcgggggagggtcaatctattttaagtggacaaaaattggcagattattaggaataggttcaagatagggagaacactttcccctgaatttcagtgactccccccaccccacccctccgcttcttcttgcaggttggacgtgcagttctcttggagaatgatgaaagtcgccaagcaaatggggtgggggcggaggactagggattgggagggaaggggagggggtgtgggtagggtgggaggagagaggtaaggaacagttcctacgtggcaccaccaaatattcaatggccagacctgctcggaagtctgcaacccwgtcagtacccacggagggagagcgacttcactcctcccctccgccttctccctccctctttcccccgccctttcccgaaaaggcatctggctggagcggtccgttaggtgccttagaatcgactggcaggcgaaagcctttggaggtcagggagcccagacagcttagagtagaaagcaagctttgtgaggagtgcagaaagaagctgggggataggaaggagggtgactgacgaggttgggtcaagggagataaaaatggtcaagcccaaatgcgtaggctttagcagaaacttgagtgtggccctgggtctagatgccaagatctgagctctccctaatgagagtcagccctcccggaggccgatctctgmgaccaggttattccttccacacgcttagtggctttcagcttcccgagtagcaggcagcgctagattattcccttgggtgacttttcctgctaaatacagtgaaagtcctattaggactatatttgaattttgaaaggagttattatgttgattaattatgttgattcattcatttccacattttcaaggatagataagagtgtctttgaaagtgaaatccatcaaaaagtttgtattttacttttggtacctggtcaccggttggattggtcaattctgtcagcagttctgccctctgctggttttgtttattatttagaattcctgcgtctaccgtgggacatgaggcctctgtaagtccctcttaactacagtggtactggaaaaggacctttgattaaggaaaaatggatatgccatttctttttcagcatgtcacacacgcatgtaaatgagaatattgtaatggcagctatttattgaaaattataggaactgagaatttcttcggtgatggatgaaatacaagctccgagagacacttttgcatggattcagggattattttactgaagctatttatttttattttccacattgagcctttctgtrgmgatatgtgaatattttttaatatcaaatttctgtacttttcatgcataaattttctattttcagtctagcaacatacctgaaacacttttaaacagcatcccagtaccacatcaaataaatggtgggaaaacaactttccctatttttatgaagccaagtaatgatagaaatagcaaagtataaggattagattttgttgggtttcttcttcatgaaatgccctgaaagttaagtggtagtttagatatttatattttaagattttgttatgtgttttatcaagctgtttagtgctcatttttcctgggaggccacatattaacataaatccacttttgtaggcattcttatcccttaattaacttcaaaaagggaataatagtatattaatgcttaaaaagaaaacattggctacaaatcctgaatcaccacacaagggaaaaataaacccagtgtccacttctgataataacctttagatttgtggttgaagtaagattttataccaatttctaaataaagatattatatcccagcatcatactatgacattgatttcattgaggtacagtgataagatttggatattaagcacaaagataatttaaaacagatactacttttatataaaattaaaacattaaaaccttaaaacatctgagttcaaaacaaagttagactctaaagaaaataatatagagaaatttcttggaagtgaatggattaaagaaaatttatgacttcatacctagtcatattattttactttgaaaaatcaaactataacttggaaatatttattatactcattaaaaatcaatccttgctgtgatttagaataacaaggttaagtgtgatttttataaatatttatttacattaacttcaattttatgtttcatatatatgtttatttttaaagtaaatgatgtatctcagcgatttattgatattctttggcagttagtccattacttactattcacaggaggtggggtttacctggaattcatagtgaccacactatgattatcttaagatagatgagtttatgtaagggttttaagtaagagttagacttagctataatgaagcactaaaaaaaaaaaatctaattgaatcactttttactaattaaaattacatttaacctttggcagttaagccaatactgtatcttgtaaaaggctgatcaaactgggaactttggaagcttgtcaggaatcgatagtgagccctgaagaagtgtagttttgagtgcccaggatcagcaggtgaaatggtcctggcttccagagtatgtgctagtccaacagtgcaaagagatcgaatttgtccatttggttccttaatcagaaatcagaaactcagatatgcttctgataagaaatgcagtgtttgctaaactcattaatattatgtctttccatttgttttttaaattcaaaattgatcaggactataatagagaaagaatatagactaaagagaaacacctttctgcatgctttacacacatagcttcagtttaggtggcacagattcttttacctagttgtccattagttttgaaattaagtttcttaatatcttaaagtgacaatttgcttcataattaatacttaactgaggggatactttatagaagttattctctaaaaggtatttgtatagttttaaacaaagttatgcagtagcaaagtgagaaatgtatttgcataacataattggtaaaaaattaatattttttcggttttttattttcttcaatttgtgactaaaatagaaccacatggttgttcrtgttaagttatccttaaaatacagcaaagcaaacatctcttttcaaatttatgggttggctttctagctaagaaaattgtataaagagtcacctttcttttctaaaaatttgctttttcctaggataaattctcttcactctgattaatttagtgagatgctggctatttcatgataacaaggatttaaatcaagtttggttgagagtctctgtgtaatacaagctgaatttttaaaaggttaaaaaaagrtgtttatataagatttttaaaagagaatgctagcactagaaattatagaaattgctaatcaatcttaccttctcaataaatgaggaaactaagacacaaaaagttgtcagctgaatactcttcctcataaaaaatattcttgtaatattcaaggtttttctgagtagagtgaagatctgtaatggtgatcaaaagaattttaaataatagaagtctgagacaatggaatgagaggagagaacttagtagtgcaagttctaattaaagttttattttggattgtcaaaacacctgaaactaatgtaagtaccttttagctcaggaaaaaattgacatttaatttatgggaagtactcactctcaatggactaccattgtgcaatcaacaactattacaaatttaattaccatatgtgaaattacaaggaagtaaaagagaaagaattcgatatattatcgctatatttatttccagaagtctgaaattattagaccatatatttgctagagtttagattagtgagaaggtagatatagtgaaaatgtcttatataaagaaatttaaatagaaaatagttacagaatgaattttttaaatactctatttactacctttgaagaaaggtaatttttgatcatttgtattcttaattatgtcattttataagattacatcaaagtagaaggcgtaatactctattcattgctggattaagaacatagttttgtatgctctctaaagttgttaatagaagactaggtccaactttgaatttctaagaagcttagaaaattatatatttatttcaaataaaaaatggcaaatttctgatattttcaggttaatttcaattgattggatgacatatattttatgtatacatatagtatgacttttattaatgtcagataatcattatgacacacttgtgtgttgtttgtttaacagttttttttwaaacaagtggcaaactgaagaaaaaaataggagagaacgtagtagtgcaaattctaataaaggtttttattttggattgtcaaagtatctgaaattacataagtatctgttagcttaggcataaatgggcagttaatgtataggaagtagtcactcttagtaggctaccatgatatctgttgtgttgtcaacaactattacaaatttaattaccacatgtgaaattgcagggatgtaagggaggaaaattttgattttctatytcaaaatttatttctagaagtccagtcttcaactagtattcccaccaaattaagagtctttctgtttttagggaaaagcaatacatggccatagggtcctgaagattatactgtgaaagcatttatcatgagtttttatactcacaattaactataccattttatgtaaatatggagtttaaaaaatgctgagatatctccatcrttgtatacaatttttaatgattatgtttaggtatttaaaagccagaattttattagatacacttttattttctccttacttttggagaagtaatcaagcatggatggcgtgatcattaggaattcaaggcaactgcaagtggggactgagcgttggtcagcatttctgcttttactccttcacttccctcatgtaatactggggaaatgtgacctgagttgggagtggtgagaggaaaccaaactttttcttttttgaccattcaagttttgttccttagcaaagaagagagataaacgctgatgttataaaaagttgcaatgttccctaagttctttcactaaagagtcaactttaaatgcagttttcagtgtagctttcagtatacactaaygcactttctacatgaggacatattccttctaaattctcttgcaatttaattcaaaacctaaaggtattttttttccattttaaaatactttctgttttagaatgcatctaatgtatttctttctccttccttcaaaaccctaatatggttttattgatataggtaagtgtattcttttatatgttcacttgtgtcagaactcaacatgaataatactagcttgtagcaaagatgaaagacaattttaaagtgatttagtgagtaatatctatttatcagttgcagtctttggcctactactaacttggctagtggttctttagacattggctgatcaccagacctactgttatctggtaaaataaactctttgcttgctgcgcatggaattagagacagtgctattaatttaggagaaagaacttagagaaaggaaaggttatcatatttcagagtaagagaccagcttaaatacgacttgacaattgagaactaaaacaaacctgtgtaaaagtgctttagcacaattaacttttgcaatcccctcaaatcttcttttttttttttcttaaaaagcatttctttcttattttaaccaaatttaattgctcttgaatggctctgtactgtacaggcaaatgaagctccctattcatagaacttgagtgcacagagtatcaggggaagcttccttcctctgtttgactggtaaactgacatccgggcttaaaggagtgaaccttaractgtgtgaggtagttggctttccttcctcactcagattttcacatagactccctgaaaggatgactgccagaaagagcagtagctkgctaataagaactctagtgcattttcatacttggtgctcttaggtagctctgcacagaaagaaaaaaatgtaaatattgaagtggtgtctgtctttcctttacttctgtctttagagtctaagagtggagctcaacctactgctgactgttactcttccttttgcatgcaaatgaaacttcaattatttcactggcttttaggataagtttgttgtctaattgggttagagtgcccttcaggatgtggcatatctttatgtccaggctcaagaccagccatttcccacctccccaagcccatttccatttaccttgcactttagtgatgttaaacctcttgcctgtgttctcccctatctttgaacactcaccctggaatgtctatctcattctcttccatcagcaaacaccttctcctactttatacttcgaaatttaagtaaaatatcatagctccagaaaacttttccttatatctccaggtgagccctaataccaaatacatgctcagtatgtacaaggttctgtcatatgcactttcatagagaatcttatttaattgwgacagttttcctggaagtaagctgatatcaaaatactgattttacccatgagataactgaaaaacagagaagtgaaagattttgcctaaagtcacacagctagtaagtagtagacccagaatttgaatgctgccaagctttctccaaggcccttgcttttggccacttgtccatgttgactttgctgggtgttctaatgcttctatacagcctcctaggcttatcttattattatggtgccctggggcctaatattaatgtacacatcatgcagctaaaccacagaaaataccaggtcattgggtgaataacytgactgccttcaaggagaaataaaaagaggttctggtaaaaggtgatgttagaatccagatagctcttcagcctgcacttaagttcagtggtagagaccatattactcttaccattttatggacaaacctcagcctcagtggtagtggaggattgaaaggggagtttctgggagccatcaaatattagttttgttcctttgattaacttaaggagaagctgacagatgtatctgttagtattcaaagttccagttgtggttggcttggtttcattaagtaaaagaactcttatagatcattgcttgtcctaatcaggatccattataaaggtcatcaggacttattctacttttggggattggtgtatggaagttctcttaactgtcttcagcataaaaaatgtcagagttgattatccaaaagcttttttggagtgtaatcaactgagagaatgtaacatcattattttaaaaattactcacttatgtcagtcttcttctaggagttcctgggtgggtagtgactgtgatctagttttatttgtgtccccagtgtctaccatggtgacaaaatacacagcattgatatagtaactatttaggttaattatattctttttttacccagaagactggaacaagattaaaattgagttagcttggaatggtgtgaactgaaagtttgaggacctcctcagattatgctgttggtagtgacatgagtagtgactcctcttttttaaattcatttgctaaaagtaaataaatttcaatttacctctagctttttcatatggaaaacagttctgcattctctccaaaggtgccactgaatatttgtagctacagagtgactatattacctccaaaactttgttttgttaataccttaagatatgtagtggtattgaccgtagcataaatcatcattttacttttctactagtgaacaagaaagtttaatctgagaataatatcaatctgtaaaatcgatcattggaaatagtcctctcatatattcattattgaacctttcatctcagattggtatgctattggggattagttgtctgactttgcttattagctattagaaatagcagtttatccatatataatatatatatatatatccatatatataatgtatggatgtgtgtgggtacatgtgcatgtgtgtataaataaagtgctttatgtttatttcaataaactcattcttcaagttagaaagtaaattatatgttttatgtatattggaattattatattatgaagtaccatctccaaacaagaaatatatagagcttcaaaatgcttaataagattaatagacaatagttgtaaaattcttttggaatatagttacatagtttttatactatattgctatccatggtatattttagttacactaaaatcactggtataggtatgtttatctgatttatttcatctagaacagaatccatctagaacagaaagcatctagaacagaatccaccacatagtaggcatttggtaaaactttgctgaatgaagtgagggcgttgttgacattgctaatgacttgattgtccataacctaaccacctgagatgtgatatatagctatrtgtatcacctactctcaatgtctatggaagtatcttgaaccaatttctgctgatattattgtgatttcctgagactatcagtctctattttggttctargccaacctatgacctctaccctaagcactctcccactttgttatttctgaaagtaaaaatcctctttgcttgagatttagatattgtctccctctagaaataactttcttcaagcattgaagattggggtagttagcctggcataacattataaagcacactatacttatccaaaactcaaatacttatctcaaaatatttttgatggtataatgaaagcaggaaatacatctttttcactgatgcaaaacattctggcatctgtcaccatatctagaggaaaatagatagccagtaaatattttttgaatgaatgaactcataagcaagatattttcaataaagtcaagaggactggggtccgtggcttagtatcataattatttccaatcctaacgctggaaattttgatgaaatagattttgtatgacatcaaagcatagatgctttataaagtttcatagataatgttgatgcagaagcaggggtttacaaaccttctgtaacaggaaaccaatatataaataaatagaaatgtatctggcttgtataactaggcactggaagtcgagtgaaaggctattcatcataatgtacaaattatttgataaatatgctattgctaagcagtagtggctctgcaataactgagttgaggagatcaactaattacaatatagaaaatgctttcttttaatccttctctccagagcatgtaataaactaaatgccaataaatattgctcttctcagtattaaagtcaaatggttatattggaagtataattttagttttataatacatcttttttttaacagccttggctatttgtaaattagaaatgctgtacttttaaaatgtcatactctcaactagtttttgttcttttcttcaccatactcagagttgtgatgccatttttgctttccactttcaggtcaagcttttatgatataaaaaagttcaggattgagtctgttcaataactgtaaaagttaaatgactatcttctatgttaatcactgtgttaagtgctgtggctacacagacaatatgatgatctctattctcatggagtgaaaagctaattaatacctgcaatcattcatttacttattcaacaaatatctattaaatccctattaaatgctcttcctgaattctaaactaattcattcatttcattgccacgttcgacaagtacaggttaaaagctcattatatgctaaaggtagttggtgggcaaagatagttataatcctgcctcgtagtgattatggtctacttgaggagacagtaattaatcaaatagtggtacaagtaaatataaaactacarctatgctagatgctttgaaggagaggtgtatggttcctggagaatacaaaacagaagtttagtaaagtcgaagaaaacttccctgagaaagtaccaattgagcattgattaattaactaaagtgaagaggaaagagcattccaggaagtgatgtgaaggcctttatgaagggaggatgacaccataagggacttgaagaaaggacttgaaaaatggcagtatgtctggagaagmagcagtggggataaaacgtgagatggtgctggggaagaaggcgggggacacataacacaagatcataaagatagatttttctgcatagcatggaaacatgtcactaattaaaaagtacaaggaaactgccaagttagcagggtcagtgcatacttcgatatcaacacataactaggttgtcccagttgattcctaccattggatcctctgacagtcagtgaactggggccatgytgttttttctggaatagccaaccctactgtcaaatcacttggggttctcaacagtaattagtacatttaagtcacactttatatggagctatggtcatgtagtcttgcaaaatatataagtaaacttccacttcataagggagtatgagaaaaatgttaaaataaaatctgctataagacaaaaacataacttagcatttctaaaccttatgtgactgttcttgttattaaccaaagtatatcagcttttagaacaaaaattgcaaacaatgatttttgtttcttaagattaatatatgaggtcatgatctctattttgattatttgagatgaccaattgtttattgtcagcatttttttaagtcttaaarttctctttcagtggaaattattcaaatagaattttaaagtaatcatgtcattgattgattaattgtagctctggatagcattggtaggctgtcaactcctaaagttttatttctatcctgctttaccctgaacttcagacttgcatacttgactgcctactcaatgatttctaacagtatttattaagtcatctcacatttagtatacccaaaactgaattgcagaactcctctcctgaaacctgttcttctcacagccttctccatctcacttaatggcaacccaatcaatcatgatgttccagctacaaatcttgaactaagctttactcattttctctcttatctccttttctacctatcagcaactcctatctgctccactttcagaatatatgtagaatctgacccttactttctgtctcagtctaagaaagcaacattttatatctggaaaattgcagttacttcctcactgccgcctgattccactcgagtgagcctagagtttcttctcaacacagcagacccagtggtctgaaagcataaaatgaatggaaactatctgcaccttcctctcaatttttctgtaaacctaaaactggtctaaaaaaaaaagttgattcaagtcatccttctmccctaaccttccaatggtttttaaatctcatttagaataaaatccagtctccctgaacattccacaggacctatacagcttgttatcagtgtatcctcacttttacttctctgaccacagctctttcactcttgttttgtccatgcagtcaatcttttttatagcagtattcacatattcacatagagtacatagaaagattttggcttttatataatacagagtttaaaataactttacagggaactaaatttcttcaatctgaagttcagctatcttttttttttgttaactttccatgctctctatccaaactgaacaatattttctgttacacaaatttacatgagaaaatatccaatgtacaaatgaagggacctgagcaggaaagagagccaaaatattaggaagtgggtatgggggataattttttgaaaaaagatccctttgttgagacatatttgtctccttgcatttctttcaacattctgggccaactattgtctcgggttctttgcacttatttttccttttgcttagaattctgttctgcaagaatagcaggatagaggaacttcctatgactttctagactttgcccaaatatcattttcttattgaggccttgcctgttctttttatttgatattattttccaggcctttgcaaccctccctataatctttttatgattcattttttccttagtactaatcaaatatttttcatatagaaaatgatggtgcatttaaagatactgagtttgtgttaattttctatgtaaaatgtaaaattagataattttagagtataaatgttgccttaaattatttaagcttttagatgttagcagcatctaggtcatctatatccaataattcccatagtttgttattccattttatgcagtattgacatacatacatagtatagtcaatataagagccaaattctacacagtaaagcattttttcttatttgatggacactatgcatgttaattcaggtgttctgagaaatgacagctgtgtagaaatggtaacggcattttgtactttgttttgttggtttaagagagccatggtgatggctacctagaaagtagtattgcccttaatcaaagataaattcagaatcatgtattttatgtagagttgacttttgaccaacataagagtaagaggagccaactccctgtgcattgaaaatccatgtataacttttggctccccyaagacttcattactaatgcctaccattcatgggaagccttattgacaaaataaacagttgattaatacatattttgtatgttatatatattttatgctgtattcttacaatagagaacagaaaatgttcttaagaaacataaggatgagaaaatatatttagtattcattaaatgtaagtgaatcatcataaagattttccttatcatcatcatcatcttcaygttgaggaggaggaggaagacaaggggctgatcttttctcagggatggcagaggcagaagaagtggaaggggaggcaggagacgcagacacacctgtgcaactttagggctatacattgtaattggtgtctgactttttgcttttttgtatctctaaaaaatgttttcatatggtaccaatccttcytccactgtttgctttaattttagttaccatatcatagaagggtctatgtgataaaagaaggcaaaagcagtcttgaataatcagaccacttctgccagattgtctaatgtcaatttgttttctgacactgcctcttctatttcttcttccccatcttctgacactggtttggaagcattcatcctcatcaagttgtcttctgctaattactcttgtgtggtgtctattagctcttgaatttttccaagatccatatcttgaaaccctttgcccccacacctccacattttttttccatatccacaatctctttcctgatttcctttattggctctgctgcaaatcctgtgaagccatggataacatatggccacagttttcttcaggaggaatttattgcttcaggcttgatggctttcaaggctttctctgtaacaatgatgacatcttcaatggtgtaacccttccagactttcatgatgttctttctatcagcgttctcttccatagcattgacagtgctttccatacagtaccatgtgagtgagccttaaaaatccttatgaccccatgacacagaggttgaattagagatgtactttggacaagtagaccacttgaacacctttgtcattgaattcatggggttatgggtggccaggggcattgtccaatatcaaaagaactttaaaaggcggtttattactggcaatgtattttccaacttcaaggacaaaatatcgacagaaccactccagaaaaagggttcttgtccaagccttcttgttgtactaccgaaagacaggcattcctgtttatcttttcccttcaaggcttggggttagcaactttatagataagggatgccttcctcataaacctgactgaatttgcacaactgtagaatttgcctgtttcttcttaccttaaatcctggtgctcacttttctttcttactaataaatatcctttgtggatttttttttccagaatagggctgtttcatatgcatgaaaaaacctgttcaggcagctattctttctcctcagtggtttttctaatggtatctgggaaatggtttgctgcctgttcatcaacgaaaggtgcttctcctgttatcttgacatttttaaagcagacctctttctaaaattatcgaaccaccctttttggcattaaattcttcagctttagattcttcaccttgcttttgctttaagttgtcatataatgacttcactttttcttgaatcatattgaacttcatagctatataatggctttctcatagccaccctcacccacataaagctgcattttcaatataagattttaaaaaagatgttttgcaaaagttcaaggcttttgcacttactggcatagatgcagtgatggattcatggatttcctttcttttcttttgtctttttctgtttttttttgtttgtttgtttttggaacaatgatccttatgctggactcatttatcttgaaatggcaggcaaccacagcagacctcaatctacagtacatatcaagcaattcaactttgtgtatgtatgtatgtgtgtgtcatgacttttctctgcttcttgggagtatgtgaaacattaatggtacttcagataggttccctggtgcttttcaaggtttacaatatcgcactaaatgtgatgaaaagcacacaagaaacatgagagatcactttttacagagataggcaatttactagagagatccactgctcatgtggaaatgatatttaagcagatacttgccacatttgggttcaccacaatagcaacaggaggtggctaacaaatgattacagtagtacagaatgcactacacttaatcttatgcagttttcatttattgctgcatctttatgtttgtttacatttctctccactatgaatggtgccatgtgtaatggtgccatgtatgatctgtgtttgtgtgcataagatttgacaaattttgactttttatactttatttgtgcctattttatggtagtaaaccataaaagacttgtatctacatatattttgtgcattcatgacatacttaactttttcttaatgtttttgatatttttagcctactttgttcttctggaaggtttctcaaattgtcacaaatctccaaaaatgtgttttaaatttatgtattgaaccatattcatacataactggacctatacatttcaaattagtattgttcaagggtcaactatttctctcaatccctaaataggttagaattataaataggcaacaatgggatgctgatacaattgattttgctggaagtcacactttttcattaattacacttcagaatattttactatgtatttttattgacctttctaattatgaatttcactatgcagttcattttgttttaaactggaattttcctggaattgtaagaaaatacatttacatttgttcactggatttctattttctgaaaagatagtactaataggcttgttatgtgtttggtttgatgaaattaactctaaaattcctaaaactccaggttactgatatatattgtctttcttatgtcattctcagtttggtgctcttcactgtttgaatatgaaatacgcagtttttttcaaggtgcctatcaaaatcttaagccattttatgccaacatttgtttatttatagtattcgtgtgtatattagtgtatatgtggagaaatatattaagtaaacagagcattattaatgacaacacatcttagttgattataaaacccttcggggaaaattgaactctaaataatattgtggaacacttcccatgtcctgtagtaattaatgtaaactatacaactgtaagggcttcatatataatcttacaatttactaatgtattttagtagtttatttctttaattttgcacttgtgttgactacaaagattagattgtagcatacaagtcaaacatctggtaatttcatccaaaaagggttctattgagggtaggaagtttatgtaatttttattggcattatttgtgtgacatcatcatttaaatatgaacttctgtatcttttcaaatatgggagtatttaagtcaatgtgcttaattttctaatattttatattcatatataattcatggttggtatgtggaatatatgtatttacaataaatgaaagaacagtgtcagaggaaagggtctacaatattacatttttaaatctttaataaatagcttagatgaggcccgctgtgtttaagctatagttatatcaatttctatgcaatgcaaagaaaaaataatgaaaagagaaaaatgctaatgatatcagtgtattaatgtccatttgtactactagggggtaatgaagtgctgagcatgaaaatatagatttaagatctatttggttgcttaagctaaattccaggaaacctcctgaggttgtttgcatctggaatacaatatgaacatgctgaagagattgctaagcagtacataatttttatggatgattttgaatggacatttagagatcaaaactgtttagtattctactcaactgcagagaactttcccaaggtagtctgaggaagcagataacaggaatcaatttaattatagctctagggaaatgtggatggtattaaagatgttcagaaaggtagacattttcatggaataataattttagataatatttttattgaatatgtattatgcattagacaccattctatgtttaaaattccttacagcgtttaattctcaaaatgagactaaattgagaaaactaagtcttggagaggtaaatagcttatccaaagtcatagaaataataactactgaatttggattagttgttgggcagttcttactgtggaaactagttatcaattgttgtttataggcttggcatgtcccagtttttagactctttcttaagagccatcatgattttgaaatatagcagaatattagtagtaggaaaattataagaaataatcaattttctatccttttctcttttgtcagtcctacatctcactaccacatgctcatagtagcaatactggttttttgactgagtggaagatggctgagaactttcttctgtattattttatttttattagttccataatggtatgcctcacatatagtctgtgatgtgaggtatgggttgagaataagtgactctcaagaagttgggaaaatatctacattaggaaggctactttattattgttacttattttattttattttattatttatttatttatttatttattttgagacaaagcctcgttctgtcccaggctggagtgcagtggtgtgatctcggctcgctgcaacctctgcctccaaggttcaagagattctcctgcctcagcctttggagtagctgggattacaggtgcatgccaccatgccaggctaatttttgtatttttagtagagacagggtttcgccatgttggccaggctggacttgaactcctgacctcgtgatccacccacctcggcctcccaaagtgctgagattacaggcgtgggccaccacgctgcttcacacctatattcttcccacacctgaatcaaacaatggcaacaaacaaacttggaaacctcttcaagttcttggtaaaggtcacttccaatcctcttcctttcccatctcaaactggtaggaaaaatgcttcaactatgagacagcttgtggctactcatttattcatccattaaacatttctccattgattatttactgtgcttcagctgctatgtctttgcaatttgatagtgaatatcaatagcactgatgttcactgtcagagggtttacagtgtatcaagggaggcagatgttaaacaataaattacatgcttaacagagagagaaaaatattagctgatgtgagtatgtaacaagaaaatcatgaccataatttagacagatgctgtgcctgagagcatacagcctagagccaaagacataattaagcaagcgaacaaaatagtgtagggtgatctaaggggaaatacaagacactgggatcatataaagaggtcacatcatcctcttggatgagctaagaataaatctcctagaataagtcatgcttaggtttacactaaaaggttgactaggtctgaagccaccgagtttcaaccctggctgcacattaaactcatctgggaaacttaaaaaatatggatgtctgtacccaatcattctagtttattagttctggggtgggttccaggcattcataggttttataaactcttcagatgattctattgacaggattgaaaaataagtcaactgtccttaaccaattgaggaaggactggaaaaaatctacagataaagacagcaaggtacattttagaaactgaaaattattccagttctagtaataaatgtcaggatgggcgagtcgatagtttttattggagatggctcttggagtttgtggcagtgaatgcatgatgaagatatgatttttctccagtggtcctcagcagccatggtgcatccagggataatctggagagctaaattttctccgtgtccatgtctccttgggcaagcatggctggtttccttgaactctttactctctttgtatctgtgctaccatatctgctgtttctttccttctcttcttcactraggaactcctatttatccctagggactcagcttaaaagggctaggtagtagatattttagttgttgtgagcacacagtctctgttgcagctacgcaactctgttgcagtacaaaagcagctatggrcaatatataaatgaacgggtgtgactatgttccaataaaaactttctttatgaaagctgaaatttcatatagttttcatgtgtcacaaaatattgtccttttatttttcaacatttaaaatgtacaattattcttayatcatgtaccatataaaaataggcagcaaggaggtctatgggaggtctatacccacaggcacagatttccccaccatcattcgaaggcattgttacaaaaaccaatttagttctgacaaaaaaaaactctttgaagtaaatatttttgttattctcattgtactgatatagaaacggaggcccagagtaattaagtaatctgtccaagtcacacagatgctaagaggcagaggtggacttaagaagcagttttgctctttaacactgtaatgatgcggttcactactggtcatgggagtgtgcaaagaagcttagagaaggaattagagatgaaacaatcaaagtattatgagatgtttcatcagtaatctatatggatggtgaaggcaacaagggagaaaggatcaaagacttgggatcaawctgatcagtgaaagggtggtggtgtttaagaggtcaatagactacaataaaaagtacatattaggacctaaaaaaatttaatttcgacactagatagcctgaggatttcagaggaagttccttccatatattttcacattatcgtgtttcacattcaaccaacattttcataatctctgtgtgtttgtgtgtgtatacctgttccttactagtttgcaaaaattggcaaagacaaggcaaataattttaaaaaagtatgaaaggtgctataatagaggttagcagatctaacccagcttagggagacagagaatgttttctgcagaagatgcattatcaggtatattcttatccttcaggtgaggtggagctaagtgtttgaaacagagagtagggtttataaaggcccagaagcaagccagagaacatggtggattctggaaagactgagtttagtatggtagaacactgaatgaggacagaatgagggactcatgagagctaagactgtacattcagtgagcttagagtggtaggataagtgggagtgtccagatatccaagttgtatattcaaggaatgtggaaatcatctgagagtcagtggggttctttgaaggaatttaaacatcagagtgacatgagacatggatttttggaagcttaatcaagytggtggaatgaagattgatgggaaaaagtatggaacccagttaagtggctattttagtagcacattgggctctgatattctattctcccgtttaataaacctataggtattcaataaagracaggaaaatataattgaacaaaacattgtgctgaattggatacatctgaattgcatacacatggtttgtgccagcagttggcaacatagagataattaaaatattaaggtcatttaagaattgctttgaatatggacattttacttttttcatatatcatatttagccataaaattacttcttttaatctttgaacagttgcagttagcaaaatataaagaatagctttcccacatatatgtatgtatgcgtataaaacagtagaatccatttaatgacaatttattaaacgcaatatctatgaggattatgagatcaaataacaggcagaatttcaaagtagcttaattcattatttagttcacttgaaataaaataaacttaaggacttaattaatggagttttacttttttgtaacttgaaatgcctttttgggaaaaaaaaaaaggcttggttgatacctttattwtatgtctctacttgtattgttttttgaggagtgaacacttggataaggtcatggtgttaaaagatacgttgttgccgggcgcggtggctcacgcctgtaatcccagcactttgggaggcygaggcgggcggatcaggaagtcaggagatcragaccatcctggctaacactgtgaaaccccgtctctactaaaaatacaaaaaattagccgggcgtggtggcgggcgcctggagtcccagctactcaggagrctgaggcaggagagtggcgtgaacctgggaggcggggcttgcagcgagccgagatcgcgccactgcactccagcctgggcaacagagcaagactccgtctcaaaaacaaacaaacaaacaaacaaaatagatacgttgtggactttgcagtccattttatgtattatttacctctgcccaattgtgattatgacagtggggatgcattttgtttttccttttcagaaaaattacagccttcatagatgtgttcatgtctatcctcaagtctttattcagttctactttggagaatggcttcagagcaaaaatataagataatttaagcagataaaatgctgtggttttcagaaacattcttcttcagagtcatttatatactagaacaagtaatgagtttagtttaaaataaatatgaacatcaggaatcaattagctggcccaaataacataaacatattatatgtatgttttaagtttatttttgcagagtttttattttggggtatagcagggtgagtggtgaagtggaaggagcatagagttggtatttacacagatcttaagagtaatcttagtttgttctctggttcttaaatctcaatctgcacaggacggataagaacatatggtttgtgagggttaatccctgtaaagaacttagtccagagactggcacatattaggctctccctggcagttattatgattagcattttcttagttatgaggtaagagaaaataacacatataaaacagatatcctattggcttaaaaacatagccgttgcaagcaggactagtgcaaaaaaatgttctcaaacatcattataatttttatatctcaggcatgctgaatgatatttggccagcatatggtctactctgaatgttttgcttgtttttgaatataggtatgaagccaatagaatataagtcaagcaggtcctcaaatactgttgttttgttcaactcgttcagtgataatgttgataagaaaaaaaaaaagtccgttcccagtcagggccactatgtggcgattacatgttctccctgtgcctccgtgggatttcactgggcactctggtttccttccacatccccaaaatgtgtacagagaattgctgtctctaaatggtcccagtctggttgagtgggtatatgtgccctaccatgagatggtgtcctgtccaggactggttcccgccctgcgtcctgaatgtttgggttgggctccagccatttggggccctgaactgggataagcaggttggaaatgaatgaacaaatgaatgaatgaatacaaattgttatcaaataaaaatctgtaaactctaccataattatccaaatgcacataataaataatgcagtacaaaagcactcagagctcatcatatttgtgattgattctgaactgcatggtgggaggacatgctccttacaattttcacttttcaaacgtttataccttaatttaacccagcactactatgaccaccgtcattcactgattcaccaaaaattggataaataattatttcatttttcattaatctttcttaaatgtatgtgtagctcacatttagttcaatgttcagtatgaaacgtgttttcagtctttatttagaagtttggtggtgtatttgtgatcagaaatagactgtaggaacttaactctggtttatatcmgtgagcctatggtcaaattggtttcattaaagttgatttgctcaatgtagaagtttccaagagcctatcgaggatattaagtgaggacttactgtacattgagtaatatgggttctaaagtctgtttttaaaataatacttgaactgcattattcatgtcctgacttgcttagtgacttaaatatatatgtaattatggaccagacaacttgaagatctaaaaaagataaagtgtttttttttttttttctaaatggcatatttcatgtagtgtactgttttgaaggttgatccgtgttatagcctgtatcaggacttctttcctttttatggctggatacttttggttaatccattcatctgttgaaagaaacttggattgtttccaccttttggctattgtgaataatgctgcagtgaacattgtgttcaaatttttgattgagtcccagctttcaattattttaggcatatatgtgggagtggaattgctgggtcatatggcacttctgtatgagtctacttaaatgaaaattctyraatgagtaactagagacagaaagtatataagaggttgtcagggggtaggaggttgaaggagtgaagagttattgcataatggtgatgaagtttgagttgatgaaaaatgttcagaaatagataattatagttgtacaatattgtgagtgtaattaatgctactgaattgtacacttaaaaaatctaaaatggcaaatttaatgttatatgtattgatcacaattaaarataataatagtacaatataccaaaaaccactgtttgcttttaagtgggtgttttgtatggtatgtgaattataacccgataaagctgtttatacaaatgggtcacacttacaaagggaaagtttaaggttccaaacatattttatattgaccacgtcacagtaactaccaagtacctggaatgaattagatttgggaaatttatgcttccactaaaaagtagcctagttttacataccctaagactacaaaaaaaatgtgaaggggcacaattactaaattactcatctccagggactttcagcctaaataatgaagtatggagtaatatccatgaagtgactggtaagttgagataataaaaatcgataaattacatataggtagatacatacatacacctttgtgtgcatatataagtacctgtatataatttgtaaataactaactcaggaaagcactgaaaaaggcattgtattgtgctacctatttttttaacacctttctttcaacttctcttgtgtatacaaaatgactaagtaggtgcacattttacagagtttacatataacatccattgtacatttgaatcttcaaaatcacctctgtttagattatgaatagtttattagtaactctgttggaaaatgaaatatttacaaatgctggctttcactttaattctacataatgttattacttggaattattaaatattttataaattataattgagatacatatgaatgtttataaatcatatataggaaactttaaattccagatgcacatatgcctatgtacacacacacrcacacacacacacacacasacacagacacasacacacacacacacacagacaccccttctgtgttgcttaaccataatttgattccagatttgagatattttgaatttgagaatgttgttatggtttatattactacctgctgccccactctccaaactcccacctaaatgttagggaagcatggcaagtgataaatagattcaaggtatgaaatgacatactatcctgtgttaaaaatactcattgttatatcagatcgttgttcaattctggttttttattgtttgcttatttttcagctgctccagttgatgtactaaaagcactagaktttcacaattctccagagggaatatcaaaaacaacgggattttgcacaaacagaaagaattctaaaggctcagatactgcttacagagtttcaaagcaagcacaactcagtgccccaacaaaacagttatttccaggtatattcactttattattattattgttattattactaaaasttrttacacttttgttactactaaaactacttttagtatttctttactaattagtatttttatcaggttagataatgtgcarttatatggtaaaatgcaattctttcwtatatcagacaccaaataccttgtggtcaccaaagtaatgtaatgaaaataacaaaaaatttgataattgccagtcttaattcaacacaatcacatttctgtgaaaatattcttatttgaacatttagtacttcattatttgtacataatatatggagacaacattttatatctagcctatttctacttgtaattaggtagagcttattcatcgtgactggggtataggagggaatctttccccttwatgactttctaagttaatttaatgggcatttgaatgtaaacatacttagtgcatrttttcctaacattaaggtaaatgtttctgttgaaagagatactttttctttgcaaataattttgcattattttttcatgccgytcttatctaaaatataagaaaagttagtcacatctcacagttatccctcctgaaactagagatttttttaaaatatcagctggcagtttttcataatggtactgaaaagtacttgctgaatatttgtttttccttccatgagagcactaattgacctaataacactaattatctagaaatcatgataatgtggagaaagggaattgagtggtgaaatgacaattttcgagcctcatattttcaaagcaggtaacttgttaactgtgcttgcctccatttgatacataccagttatctattgattggtcaattgatgggtgttctcatccttatttaacagaggaggaaactgaatttcacagaggctctctgacttgaccaagttatgtgcagtcaatatttaatctaggtctgttctgctctatatattttatatgtcatcaaatggtcctttctggcactttgggatcttctcagcagcaatttatcatttaaattcttcatattatcctatattatctctgcttgaggaaatttgagtttcctatcttcatatgaaactgttttctaacaagagaaaacaagtataaatcaagggattaaaacattacaaaacagcacagtacacttttcatagaaggacattttaaaatatattgaaatacatttattttgattgttcactgattcttccaatatattttctgttttgcaatactttgtggtgaacaagaacaaactgaaaatataaagaataaaatgaactttttttctgactttgaaaataaaaaagttaaagtgattattaaatccataaaacattttaaaaatagatttaaaaaaattaaaagtaaaaaggtaagctgctttttctatttatgtgcactctgctgcatttcctaaagcatccttaatagaaaaagggatgggaattttgaagagagtaaaacaaagaaaaatataccaattaaaaacctttagaactactcagattacaggttacaatttttatactttagctcattatctcagggtcagtgtgttctgcattccaatgtggtagttacttaaaatcattaattttatataactaattttaaatactatatatttaagtgataagagccatataatcaacattatctgactgctttctttatgatacagtctcatataatttccacaatagttccatgggacagattaaattattagcccagccaatggatgggaagggcaagtaggattttatttgccaagaacacatagctaggagatggtgggttgattccatatattggctattatgaataatattgcaataaatattggactgcagatatcccttcaacatcctgatgtcatttacttrggacatatacccagtagtagggttgatggataatataacataggagtgcaggtatctctttgacatactgattgyatttcctttgtatgtatactcagtagtgcgattgatggcactagctctaattttttgaggaaattttttactattttctatatggctgtattaatttacattttcaccaatagtatgaaacagttcctttttctctacatctgcaccaacacttatcttttgactttttgatagttrccattcatactggagtggggtaatagctcattgcagttttgatttacatattcctaatgattaacgatgttgagcattttyttcatatacccgttagccatttgtatgtcttcttcaagatatgtttattcagacatcttgtccatttttaattggattacttgtttttttctattgagttgtttgagttccttacatgtttttaatattaaccccttatcagatgtatagtttgcaaatattttctcctgttctaaaggttgtctcttcactttgttaattttttcttttgctttgtaaatactttttagttaaatgtaatcctatttggatgtggtagggctgggatttgagccaaatgatctgacaagattcagaactttcaattgagatactgtactgtcttccacttaactagtctatgcatacatttatagcataaaaatgtattcatgcctcttgctgttttttcttttgtaatatgttttaataatttccacttcataaaacatctttctgctacattaagtggctgcatacgattctattacataccatacatatttgtattttatttaatcagtttcaatcattgcagcttattataaaattttattattataaatagtactttggtgatttgaaagtacaatacatttacacataagcatcctctccccatacattcttagaagtagaattgctgatctcctacaattgtttgaacttgaatccaagccagacataatcatatttcttttatagatttatactactgcctgtaatagaatttggaatgaatggattgaaaaaggaaggccttgatattaggctagatattgttgattacacatgcacatacacaatggttttgcaaaaagacaacttttcaactaaaggcatctcatttctcaaataataatgcttgytttatttatatgccagagtagtaagaggctcaaataagatatatttgtaaaactattttgaaaaataaaacccgcaacttaatatacactgttttataaaaatataagtactcattacttaattatttgagatatacttagggtaattgtttaactgatatatttatataacagatgcttagtaaggaccaatgtagatcagactgtatgctagatatttggcatatgattgagagagagaagaaaagaaaaagagtctgccttcttgaatttaaaatcaagttagccaattacctaatagttctggctcataatgacatatgcttctttaataagaagcaatatrcagtgaaactgcattgtttgatattaagaactaatcraaaactcttaagcttttaaagaaacaacagaaagaatacgtttgtaaattgggtcattacaatgcctctttaaagtgggcatgtatggctacggactagacaaagacaaaaaatacaaactttasgccaaaattagcacttaaataaatgttttaagagtggtggttatgtgtttgatatttactggtatcataatcctgttgcctaaaccaaatttaatttcacataaacattgtgctttaagtactttaagtgagtgtctttaaagtttgactatagcttggataaaaattgaagagaaaccttaatggaggacccctatttatttattaatctgtttactattcaaagttagttgatttataaaggccatgtagaaatttcaaaaataccacagtgatctaggaataaagtagaaattggaaattggaaatttctaactctttggccttttcytctcaggtggaactttcccagaagacttttcaatactatttacagtaaaaccaaaaaaaggaattcagtctttccttttatctatatataatgagcatggtattcagcaaattggtgttgaggttgggagatcacctgtttttctgtttgaagaccacactggaaaacctgccccagaagactatcccctcttcagaactgttaacatcgctgacgggaagtaagtaacaaaataatacaatgttttagctatgccaaaatcattttttttattcagtcacttaacaaatatttatgaagtgtgataaggtttttctagaggctggtgataaataaatgagcaaaaaatacataaagacataatttatagtgtgtacagggaaacaataaacaatgttttcaaaataaattactaataagtagtatagcaggtggtaataagtgtgaaagaaaaagagagcagtaaagaggttagggtgtggcagtggggtgggtagtttwaagaagtgacatcaagccaaatcccactaagaaagtgatatgtaaagaaggtaaagtgcatgccatgctgttcattaaaagactagtgttccaggagaagcaggaagccaatacagtctctgattccagggtgtggccagtttgttccaagcaacatcaaggataccagcatggcaggagaagagtgggatgatgaggatggagaagcagagggaggccagatggtataacacattgtaggaggtcgtaagcactttggattctactctgagagaaacaggaagttactggaggctttttgagcagaagaatgatctaatttgacttacgttttactaataatattaatattggagatcagaggaagcattatagagtgctgatatgtgccatgtactaargtctttatacattgttaactcatttagttttattgattcctttaagaaagtaatgttaacaaactaattttcctggtaagggaactgaggctcagagagtttaagtaatttgcctaagttcgtatagttggaaagtgatagagatggggtttgaactcaggaagtcaggcttgcactgcgctcttttgcaaatcatgtcgaattctgaattatgtattgtggttgtttcctttcacttatggagcagctaaatakaaattaatgcttattaaatttactcaatattttatcactgaatccagacctctaaaaacagctttatccaaaatagcacatttggttrtagctataagaaggaagtagcagtgatcattgacactcattatatttttgtcaggaccacagagaaactctcaagtctcagttttactgagactttacaactttaggcttttacaactaatttacattattatcctataaacaaattagayataatagcacgttgtgtttctttttttgactgttagcaaactccatgctaaggttttaatctatatttggtaaatgtagaaaatattttgaattcatcttattattcacaccttatttttccttaatcctgctttcctaactgaaraaaaaaaaacaaaaacatcaatttattgcagcccagcccacatcctattcaaaactagcaggtagtgtttactatgaatgtatccttaaagtaaaacatgaaaaaataaaaataaaaaaatggagaatgttcaataaatatttttaattgattwtcaaacagaagttatatttacatatatcacagtagtaaaatattatcttgataatatgttgaatacagttaatacctagtagtattaatttttttcatttgtatattccttcaataacaatttattaaatgcttactgtgtgctaggtaggtcctatacttttacttgagacagttaaaamgtgacatacttgttgagctcaactgccataataatttagatgcaaaaatattggtatttaagcacactstgatgtttttaaagaacaatcatgacattcatcatgagtgaacattcattccataagtatttatctattagccaccgcttggctggcagtctgtagagcacagcagttgtagcaatgaacaacccaggtgaagttcctccactcctggagcttaaatatgcgaagtgctgatagttctttgaacgaaaataaatcaagrtaagagatgtagagtgtactattttagayaggacagtttaatatgaatgaatcctcaaagtaaaacatgaggtttcactcatgtttttttgagtgaggttgcattgagcaaaatcacaaaggaagtgagagaatagccatgtagggatgtggagaaagaacaatcctgcctgggtgaagaacatgtgcaaggggcaaaaaagaggcagccttgtggctgggatgccaggagtccagggggcgtctgagctcatgaggtcatagaaggataggggaccctcctgtgaagcagaataatggcttcagcttttactgtgagtattgtatttgatagttttaagaatgcagatccttgatctgacttagatttttaaaaggtggctctggatgcataagagtagaagcagaggccagttaggagtctagctgtgagagatggcagcttgtactaaattgagagatattggattctgtttatacttttgaatatatgaactgatagaattttctgactataggagtgtgtagtatgagaaaaagagaataattaagaatgcctctmaggctaaatgttaatttggtattttgaatattatatatgacaccatgattatgacatatcattatcatagcctacattaattaaacaaaaatatcaagtttagagttctaatcagttttaattattgaaattgtttttattttctgttaatgaaaagcacatacctataatactgggaatggcttaagtgaagacccagatttcttggcatgaagtatgtgtaaattttactctcactatattaagtagctccttatataaatctttgctcaattcaaaccaagcagacacctatgccagttgaatgttctagtggaaagaccaaagattaagtgtatatggaaatacacttggtcaccatgccaagtcacatgaaacagacattttacgagggctcctgcaactttttgggtattttattttatggatctagtcctagacacttctggaatattaatctagcacttttcatttggaaaaaaaataaaatataaaccagactggcttgcagaattgagtgggcttcatttaatggtttatgttagcacyatacattgttaataaaacccaccattttacagtatggttagggaatgtgcatttccaaagggctggccatgtctccccagccaagcctgtcatcactgctctaaattagctggagcagtagctgcagagtgaattgagagtctcattccacacatgcgttgactatgttttctttcagttttccacatctgccaaccctggaaagaaggaaagatattgtgtctcagtcttggatcctgcctacagtagtgatctataactgtcttgaaattaaagtggaaaaataatgaaagcacttgaaataaatgtgaataaagacagagaagcacattgtgttttacaattaggacgttgacttgctctagatggagcgctcattcaattagtagacataccctgttacagtcaatctcaggggatcactagagcggagtttttttaaatggaattccactttggaagaaagcatttatgtacttggaaactattacttaccccatatcccaccctaatctctatcaaataccttcatcaggacacagtgagattaagcttttgttactacaacacaaagtgaagcaaaggatgggcacttccttatcagcacagacagctaattctactgtgcattttatgctgcttgtgtccttttgggtacctagtactgttgggtaacgagtaagtagtcayctgttaactggctgcttaataaatgagcctacattttttgtatgattttagctyatttttrtaatttaaaatacacagcatttttatgtgaatactgctttggcaaccactgtttctttgaagcttacaaaagaattacttgtcttttttaggtggcatcgggtagcaatcagcgtggagaagaaaactgtgacaatgattgttgattgtaagaagaaaaccacgaaaccacttgatagaagtgagagagcaattgttgataccaatggaatcacggtttttggaacaaggattttggatgaagaagtttttgaggtaaaaataaatccarctctaagctgaatattgacaaatcaratgaactgggttaacaacrgtaaaaatatcgctttatagcaatacgttataaagcaaagttgaaaactctaaagggtgacctagtttcttcctctgtgagtatagtggtgatgttttctattgttcagtaagagaatgaccagacaatggygacmgtaacgcctgggaaacatttacagggattggttgatttgaacacagacatgctattctcctgggaaggacaaacggcttaactcttagtagtttgtattattttctttgcagaaaagaacattttcttcatttcattctatgggaggttaatttagagagatgcgcaagtcatatattttgccttcctctgttctttgtgaatgttttttaaggtaaaatagagatcatattgcaaaatataaattttaagtgtttaaatcactttaaaaaatatgtaaagatcatggtaagatatttccatcaaattatatttcactaattatgataatcacattcttttagtcctccaatcattggatatgacaacttatgctttaactttcatttagtcactttttaaaagaacaaatgacctgaattctgacaccattaaaggatgcactctcgagacattatttattatttctgtgattgtttttaaacaatttgagtcgtttctttgtcaaggtgtaacaaagtaaagctgtgtaatatattacaaattaatagacagtttcacctggagatttgctatattttttgatgtgtgactatacatacacagatgtgtacacacacatatatatatacaaacatacagacagtatgtattttcataaacagaacaatgttcattcagagcatcagctagactatttcattcctgtacttataaatatatcctacagtgtagttttatttaaaattattattataataaacatttgtgaaagttccatrttatttatttgagatgctatcgtttctgacttttatccactagtgtgtaccaaagcctttaattctacataaaatattttaaactatcatatcatgctagattatgtaaataataaactgattcaggtagtttataatggtaatatactctcagatatcccaatatccaacactgattgcatgcacatkatgataaacaattatytattcattaggcaaataaatattaatataatttctaatcttgaaaagcrttattttaaaaataaaactattcataaayataagttgcatgtgaattatgaataaattataatttatttttgtaacccacaccttattttccaggaacataaatgtgtaagacaaaagcacagtatcagtggaatttctttccttttttaaaaattgatgcttaactttgtaaaactatatcccacattctgaatcctrgagtaacttcagctctttagttggagaagctattaaaacattaagaaaagtaatgttgaaaggattctttaatgaaacccttagtgaatatgacagtgagtagtgaaaaataagtttattaagctacttcgcatcctagagtttcatgaaaccctatgaagttttaaataaaacatttatttactattaagtgtagttagtttttaaaatgttaatgaataaagaacttactctctcagtttatcttttacaatctttgaccagttaaaggggaaacaatttttacttaataaaatatttagaagtctgtagagtaggaatctttgaattggatgaaatttagtatttatctaattcatatactcaaacagccatcagatataagattcaggtcttactttctaaattatattattgtatgtatatatgaaatttcaaaaacaatttggtctctttccacttgaaaatagtgcatgaagaaaataagtaattcaaatatatggatgtttagtccaaatttagaaatttccaccattttgtaaaattagttcattctacctgatgttaatatctcttttcttaaaaacttattcgagtatgtttttccttttatttttggtttatattataatacctatatacttatgaatctttgcaagtaaacacatagaatttaaactgaaaatgacaggagatagaaattgtactgtctatatattatgttagtgttttataaatagttgtgatgatgaagataatatgataataccagtgattcattagtctgaaaactagaaatgtcactttttcaggcatagcataagtcagatttagttgcagatttgtttggtatatgtaatttcatgtatacactgccctacattaatagaatggtactactatggtaaaaatattaaacatggtcatatttgaatttcaatctaatgactttttagaattcaactttatacagctaaatgcaaaactgaagatgattttaaagttggaacaattatagtttacatattatgctcatcatatgctcaccacaagaagagcatatagactcataattcagattttataatttcagcatagcagagtgagtatatgaattgatttggggatgacaaaaatccgattttgaatcccagcatatagcttaatattcaaccttctctatwtaattactctatatcagtttcaaatgggaaatataacagaatcttcctcataaggatttatagaaaaaaaatgagctgatrtatgtacagtctttaagatactagtataaatatatatatatatatatacaaacacatatgtaatataaatgtggttgtatgttgaacttaattatccattaatgtgtagttttacaaacattattattacttcttttycttatgattttacaaccatgacatttcaacttttgatatgggcaactaacagtgacccatctgtcagtcagaagtcctcgtgggtccctctgtctgtctgctaaaagtcctcatgggtccgtctgtctgtgttctaaatgaagtacttcttttctggsctactgcaattttacaaattaccttgtagagattagatacatttgtcccctctagacagaggtaacacctgagtacagaccttaataaatggagtgtggtctgattgaatgaatatttccatgcaggcaaaaaaaaaaaaaaaaaaaaaaaaaaagtcctaccaacacaaatcaacagccttgatttttttttcctgctaaataagattcaaagatgtgaggaaaattaaattagaaaagttgtattgcttgtatttattgtcaatacaattatttttggagtcttttaaacaggaaaatttccttattaaatagcaagttatagccattgctcaagttttcaaaacatcattatttctgtttcctaattttttaaaataatcaaaacagattattgcaggtctttcatattttttaacaaatagccatctttggggagattatttatttcgtggaagcaatgagtagaatatgacatatgatggctatttgagtagaaaagctttgtgatggacattttgcatttttttaaactcctcagaaaatattttgaattcaattttctgtggagaaatcaatgaataataatttataacaactatgctatttgataactgtacaaggcctgaaaaaagtaagattagcaaacttttttgagatggcgtttgagatggccaatactaaagccatctcaaaagccattaagagcttgattattgctttatggtgtccatatatctttttaatgcatatattatccaatatacacacttaaaagttgaattttagtagacatggttttcctatagaacaatgttataagatggagataacctttccatttatccactttacccagtctagatgcatttagttcttggtccttgtgattttttttctaaatttattgagttacaattgaatcacaataaactgcaaatattaaaagtataccatttgatcagttgtgacttatgtatacagctgtgaaaccatcatcataatcaagaaaataaacattgccatctcacccaagagattccttatcatcttttttaattcattccttcttccatcctaaccccagacaatcatgaagtagctttttatcactgtagcttttctgggacttttacaaatggaattatactgggtgcactcattttaacttaactcgttttaactcgttttttttcccttgttattaatagtatgtcgaattaygttgattggtttttcaaatatttaaaaacaacttttcaatctttagaggtctatagactgtactggtgatgtagtatgttgtcttatttatattacatacaattcagttcttacttagtataatgatcttaagaattacccatgtttattgtatttaatattattattattattattattattattattttgctgagtargattttaacacatagctacaccaaaattttttcatccattcaccctattagtgggcatttgtgttacttccaggttatggcatctataaagccactataaacattcatgtctacattttggtttgtttggttgaatacctagatgtggaatgcatgggttatttggtaggttcatgattaacattaaaaaaaaagaaaattatcaaactatttttcaaagtggcattaaccattttatactcccttcagcagtgtatgagagttccagtcattatgtctccttgccaacctctgatatgctcagtctttttcattttaggcattctaactagacgcattgtagtgttacattgtggttttaatttacgcttctcccttgactgatgatgtctgcattttgccaggttcttgtgggccatttatgcatattgttttgtgaggtgtcttttcaaattttttgcccatttaaaaaattgagctgtttgttttagtttaaggagttttaagagtatataaaactttatcctgcataaagattttttgtctgatatatgtttgcaaatattttttccagtatgtgacttgcctttttwttgttttcttattggtgtctttccaagtgtaaatgcttttaattttgataaagtttaatttatcaattttgttgttatgtttgacactctttgtgttctaagaaacttttactccaagatcacaaagattttcttctatttttagtatcagaacgttgttgtttcaggatttgcacatgggtcatgacccattttgagttaatatttgtgtatgatgtaaggtaaaggtcaatgttcactgttttctacataatcatatccagttcattcagcacatttttctgaaacgactttcttttcatgayttatattgccttggtctttaaatcagaaattaattgactaccaaytagtgcacctattactgaactctctaccttattatttattcattttttttactactaccataatatcttgattactgtagttttagaaaacattttaaaatcatgtgggtaaatactcctactttttattctttgtaaaacattgttgtagcaattttgggtcattttcatttctacacacatgttagaataagcttattaacttctacargaagttgtggttttaatggggatttcatttaacctacagatcataatgaagacaattgaaatttttaaaaatcatggagttttctatttcctgtacataatataactccatttattttggtcttgtttaatttttttttacaatgttttctarttttcagggtaaatgtcttggacatcttttatttaattttttcctaagtatttttttttagtgctagagtaaatgaatttgtttctaatgtcatatttgaatattttcttcctaatatagaaaacacgattttttatattaaccttgtatcctatagccttgttaaattcatttattagttcagggtttttttttagtgtaaaaagttatataatctgaaagtagggaccattttgcaagttttctatctttatgctttttacttatttttcttacggcaatgaatgggatatacatcgaatataacttttatatatattgaatatatcttgtgtaagcaggtattcttacttttttttctgacctcatgtggaaaataattcagtctttcagcattaagtatgatgttggctgaaagttttcattggattctgtttatcagtttgaaatttactgtttgtcttagtttcctaaatatttgttatcaagaacatgtactaaattttataaaacgctttttctacacctattgaaatgatcatgcgggttttttttcctgttagtatgttgaattacattgattgatttttcaaatatttagaaataactttgcattccttaaaggtgtatagattccactgtagtcatgcagtatgttatcttattaatgtaacatataattccattttgtaaaatatctttaaaaagttttagtctatattaatgaggaatactagtctatgaatctctgtatttataatgtctttgtcaggttttgatagggttatactggcttcataaactcatctgtgcrgtgatctctccttatctattttctgaaaactttcttatattactgatgttatttccttcttgaatactggatagaattaaccagtgaaaatttcagggccctgagttttctttttagaattgttttaacatattcaatttctttactcratacaggttaattcrgtttttctgtttcttcttgtgttgatcatgttaagttttatttttcaagaaatttttctagttcaactaagttgttggatttgttcatataaagctgtttgtagcatttcattattttaaattttaatatctttaaaatttctactgaaaactactttttattctttatattaataatttgtattttccccccagatcaataatttgaacaggtacttgaaacttttgttgatattctcaacaaaccagtttcaggctctgttaattgtcactcttaacagactcttttctatttcataattattttttcctatcatagatttgaaaaagaaaaattgtttctctagcctctcaaagtatagggttattacttcgagatttgcttttttcccagtataaaaatttaaaattacacatttctctctaaacacagttttagctgcrtaacacaattttactatgtcatttttgatggttatttagttaaaataattttcaatttctttttttattttatttccagcccactaattatacagtgatgtttaatgtctagatacttgagcttttcttagagagcttattggtattggtgtctaattctgttgtcttctgagaataaatttggtatgatctcaatccatttagatttattgaggtttgatatatggtctaacatgtagtctatctcagttaatgtaataatgcccttaaaaagaaagtgcattgkgaaattgttcgatgcagacttttataaatgtcacttagatctttccttatatttcttatttttttgtctacttgttctatcagttgttgaggagtgttaaaattttctaccataattgtgtaattgggtatcttccttttcattttgccattttttgcggcatgtattgcattctcaggcatgtgcacatttatcattgttagatctttctgcttgtcactttttactgtgaaatagctctctatctccactagtattttttgccttgacgtctactttatgtgatattagaatggccactccttttcttgttaacctacaatttgaatgctatatatatttttatgtccatttattttcaaattatgtgtctgcatagttaaagtgtgcctgttagagtcaggttactggggggcctttttttatcccctctataaatttctgccttttaattggtgtcatgaaactaataacataatttacattaaatgttatgctaaatgtcattgatttgttattgatgtggctggatttaagtctgcatcttattatttgtattttctttgtactctctgttttctgattctttgttcttcctttcctgcctccagtctttttttttttttttggtgctgagggtttatttgaatattttgtagtattccattttgttttacttattggatttttgctatttttttatttaagaaatactttttataataattgtaaaatttgtaccaaaatgttatgatatatttcttgctaatattgtatcattgtatgtatgtaatgcagaaacatttcaatctccttgtcatactgatctttgtggtacagttgtcatacttattagacctgtatatattgaacataccaccaaatgttatttttgctttaaataatcgtatattttaaagcttttaagataaaaatataattttatatctaagtaaatatttgttatttctgtttatcttttatttctgaagctccatatttttctaggatacacttttccatcagtctaaaaagttttctttaacatttcttatacaacagatatgctactgatgtatctcttagttttcttatatgtgagaatgttgttcttttgccttcattacagaaggatattttcactgaccatagaattctgggttgacagttttattattttaggactgtaaaaatgttttgtctctggtccctgtgttttctgatgcacaactcacattcacattgttgttatcatgtacttgatgtaccactttagctgctattaagattttttttttctccgtgtttgcttttcagtagattgacttcagtagattgtcataattttgttttaatttattctgtttcgggtttattaagcatcttacatctgtaaatgaatatttttcaacaaatttaggaagccttcactctttaaagtttctactttgctgctaaatattcttatattttcattcttttcaatagtgtatcacttgcttcttggaggagagttataatagctgttttaaaaactcttcctgagagtttcaatgtccaccctatctcagggttggcatctgtttattgcctttgttgctattttttttgtttgtttgtttgtttgtttgctttctttttttttttttttttttttttttgagacggagtctcgctcttctgtcgcccaggctggagtgtagtggcgcgatctgggctcattgcaagctccgcctcccgggttcatgccattctcctgcctcagcctcctgagtagctgggactacaggcgcctgccaacacgcccggctaattttttgtatttttagtagagacggggtttcaccgtgttagcygggatggtcttggtctcctgacctcgtgatcctcccgcctcggcctcccaaagtgctgggattataggcgtgagccaccgtgcccggccaattgctgttgttgttaataaacaatctttattttagagtaggtgtaggttcacagcaaagttgagcagaaaggacggggagttcccatatactatttgccccaccccaacatataaccttccctattatcaatatcccatatgagagtaggaatttattacaacagatgaaactacattgactcatcattatcacccaaagtctatagtttacatgttcactcttggtgttgtacattctaagagtgtagacaaatatgtaatgacatgtactcaccatattagtacctaaaagaataattttactgcactaaaaatctttctttctctacctaatcttcctttctctacctattcatccttctctccctgattaacccctggaagttgcgattttttttttttttactgcctctataattttgacttttccaggatgtattagttgcagtcatacagtatgcagccttttcagwttagcccctttcgccaagtaatatkcatttaaggttcttctatgtattctctttttttttttttttcttttttttttgagatggagtctggctctgtctcccaggctgagtgcagtggcgcarcctaggctyactgcaagctccgcctcccgggttcacaccattctcctgcctcagcctcccaaatagctgggactacaggcacccaccaccacgcctggctaattttttttgtgtttttagtaaagacaggttttcacygtgttagccacgatggtcttgatctcctgacctcgtgatccacccgcctcagcccccaaagtgctgggattacaggcatgagccaccgcgcctggccctcttctatgtattttcatgactggtaggctcatttcttcttactgctgaataacattctactagccggatgtggtacatatttatcagtttacctactaaaagacatcttggttgcttctaaattttggaaactatgaataaagctactagataattatgtgcagttttcatgtaggcataaattttcaaatcatttggataaataccaagaagtgtgattgttgtatgaatatgctttgttttatgagaaactgccaaactgtcttgctaaataaacccttttggattcccgccagcaaggaacgagagtttgttttgcttcacagcttttccaggagtttttgtcatcactgttttgaatttgccccaaaacagccctattttcttttggtatgttgtggtttctcattgttgttttaatttgcaattctctaatgacatatgatgttgaacayattttcataggctyactttccatctgtatatcttccttgttgaggtgttcaacatatttgtgcatttttaagtcagattgttagcttttttattgttgaatattgaactttttgtatgttttggataacagtcctttatcaggtatgtcttttgcaaacacatgcacctgctgtgtggtgtattttctgattctcttgwtattgtcttttcagaatagaagttttaaattttaataaagcctagattatcaataaattctttcatggaatatatctttggtgttgtgtctgaagagtcatcaccatacccaaggttatttaggttttctcctatattgtcttctaggagtttcatggttttgtgttttacatttatgaaccattatgacttaatttttctgaacaatttaaggtttgtatttagatatttttttgcatgtggctgtccagttgttccagcactattagttgaaaagattatcattgctccattgtattycatttgctccttttgtcaaagatcagtttagtatatttatatggatctttttctaggatctttattctattccattgatctacttatcagttcttccaccaatactacgttgtattcattattgtaatattatattaagtcttaaagtcagataatgtcagttctctgtctttgttctttacctttaatattgagttaattgactattctggatgtttttcttcttatgaatttggaatatgtttggaaagatccacaaaataacatgctgggaaattaattgtgagtgtattgaatctatagatcaagttgaggagaactgacatcttgacagtattgagtcattctatccatgaacatagaatatttttatttttaaagttgttcgatatccttcatcagagttttgtagttttcttcatatagatcttatatttattttgttacatttatacatatgtatttcttttttgagtgctcatgtaaatagtgttgagtgataaatttcaaattcttcttaagaaaatgattgatgttttatataccttgtatacacaaccttgtaacaatcatttattatttccaatttttttgtcaattattttggattttttacctagacaattatgtaatctgtggaaaagtttaatttttctcttccccatctgaatacattttatttccttttcttgtcttactgcatcaactaggactcccagtatgatgtagaaatgcaatattaacagaggacatccttgccttctttctgatcagtttgagaaaatktccttctgttcctagttttcagaacatgttttaaaatcatgaatgaatgctgtattttgtcaaatgctttcctgcatctatgatatgataatttatttattttttctttagcttgttgatggtgatactaatttattttcaaatattgaaacagcctggcatacctgggataaattccacttgactatggcatttacttattttatataccttgggattcaatttgataatattttgttaaggatttttgcatttatgttcatgagagatattggtctgtagtattattttcttttaatgttttcacctggttttgatattagggtgatgtgacctcataagatcagttagtaatattcctttcgcttctatattctgaaaaaggttgcagagaattggtatatctttttccttaaatgtttgatagacttcaacagtgaacccatcttgttctgatgctttctctttagaaagtttattaatttttgattcaatcttcttattggaccttttcagattttctaattctttatttatgagtttttacagattggatctaccaaggaattgacttatttcatctaatttatcaaatttgtgggcacagagtttttcataatattcttttatcatccttttaatgtccatgggatctgtggtgatatctcctctttttcctgccaataataatttgtaacttatctcttacttagttggcttagctagaggcttataaattttattaacattctgaaagaatcaggttttggtttggatgctaattctatggtgactttctgctgtctgttttattacttctggtgtaatttaattttcttttgttctgtttatttcagatttattttcctcttttttgtttagattcttaggatagaagcttagacagttgattttagatctttcctcttttctaatatattcattcaatgctatagatttccctcaaagaaaagttatattttgatttttattttgtttataatatttttaaattattcctgagattttgtcttcaatccatgtattagttagaagtatgtttttacatttccaattattttgggatttcccagttatctttctgttacggtttgagagcagttattggattatgtatatttgttcaaatttttaagagttttctttttggccatgaatgtagtatatcttgaggaatgtccatgtgaactttagaacgataagtaatctgctgttattggttataggagtatatatatgaaaattatcttttttgattaatagtgtttttagttcaactttgtccttactaatttctgcctgctgtatattttcatttctgttagaatggtgtttaccatttaaatgtaatagtggattcatctatttttccttccatatctattagattttgcttcatgtattttgttaggtgcatatgcattaaagatttatgtctttttggtgcactgacctttttacccttattatcatgtaatgcctcactttatctctaataattttccctgctccaaagtttgcactgtgtgaaattaatttagctactcctgttttctttttattagttttagaatgttatacctttatacccttccttttactttgtatgtgtttttatatttaaagtgtgtctcttgtagacaacatgtaattgagccttggtttttttttgatccactctgacaacctgtctttaatgagtgtatttaaatcattcatatttaaggcaattatatatatagttagaataatattcaccatatatgttattatgttccatttattrccctgggctcaggtgatccttccagtaccaccatgcctggctgattcttttctatttttttgtagagatagggtctcactgtgttgcccaggcttgtctcaaactcctgggttcaataaatccaccagccttggcctcccaaaatgctgggattaaatgcatgtgccgcctcacctggctaggtttttaaatatgaacttacacctattccaagtcaacttttaaataacactatactgatttatgagtaatgcaagcaagtatcttataaaatatttcaaattcctctctcctgccttttctgtcattgcaatcattcattttacttatacataagcatatatgcagtgaaatccattattgctattattattttgaaaaaactyataccttagatcaattaataataataaaaaatattttaccttcacttattcattctctgaatagtttatgtagatttaagcttctcacttatataatttttattatttctgaaaagcttattttaacattgcttgcaaggcaggcctactggcagcaaattcctcaatttttgtttgtctgagaaagtctatatttctccttcacttttgaagaatgatttctcagggtacagaattctagtttggtggtatttttctctcaacactatatatttcactttagtctctctttcttgtatgatttctgataagtcagatgtaattcttatcttcgcttgtataggtaagttggtttttttcccctctgggttcttttaatatttttaaatttatcttagattttctgatatttgaaaatgatattcccagatttttggtctgatatttgaatattatacttctggaattttggtttgatgtctgacattaatttgggcaaattctcagtcactattgcttcaaatgttggttctattcttttctctctttctccttgtattcctattgtgtgtaattacatattttgttgttgtcccaaagcttttagatatcctgtttagttttgtatttcccagctttttttctctttgcttttagttttggaagttttgattatcacctcctcaaactcagattctttccttagcagtgtctaatttactaatgagcccatcaaatgtatgcttcatttcaattatggtgttttttatctacagcatttatttttgattctttgttacagttatcatctttctgcttacattagccattctgttcctgcctgttgtctacttttttattraagttcttagcacgggaatcatagtttgaaaaattcctagaatgataattccaacctttctgccatatctgactctggtttgatgcttattcagtctctttaaactgtagtttcttttccttgcagtatgccttttaattttgtgttgaaaggtgaacatgatgcactgggtaaaagaaactatgttttgtttttttttaataagcccttagctatgtgttggtaaggtgaaacgggaaggactcattctatgattaggtctcagattttggtgagcctgagccctggactgtgaattttatcagtgcttcacagtccctcaccccatgaccttaggtggaacaggatggctgaaggtggctggggttattttccttcttccacatggaagaccagagggagctgtagtagggaatttcctttctttcacactgaaggataatgctgcactgcagttaggcacaacatacattgttatatcatgcttttctttatgctttgtggatattgctcttgttacaaattgaaagtttgtggcaaccttgaatcaagcaagtctgttggcatcatttttttccagcagcatgtgctcacatcatgactgtgtcacatttcaataattctcacaatattttaaactttttattattattataagtatggtttatgagaccccaaarcaattacaactgtaacattaaagatccctgatcacagatcaccatagcagttataaaaatgaaaagatttgaaatgtcatgagaattaccaaaataagttacagagacatgaaatgagcatataccatcttatatataataataatgtacacaataagatggtaaacttaagtgataaatgttttgtgtgttctgactgctcaactggctcaactgaccagctattctcaaattctctcctccttgaggctctctattgcctgagacacagcaatattgaaattaggtcatttagtaaccccmcaatgacctatgtgtgttcaagggaaaggaagagtcacaggttcaagtgttcaagagtcacttgagatcaaaagctagaaatgattaagcttagtgaggaaggaatgttgaaagctgagataagccaaaggccaggccttttgtgccctgtgaatccaagagttatgaatgcaaaggaaaawatttttaaagaaattaaaagtactactctagtgaacatatgaatggtaaggaagcaaaacagtcttattgctgatatggagaaagtttgagtagtctaatagaagatcaaaccagccacaacattctcttatgccgcagcttaatccagaacaaggccttaactctcttcaattctgtgaaagctcagagaagtgaggaagcttcagaagaaaagatcaaatctagcagaagccagttcatgatgtttaagaaaataagttgtcttcacaatataaagtgcaaagtgaaacagcaagtgctgatatagaagctgtagacaattatccagaagatctagctaaggtaaattgttgaaagctgctacactaaacaacagatttccaatgtaaacaaaacagccttctgttggaagaagataccatctaagatgttcctagagaacagaaatcaatgcctggctttaaagcttcaaaggacagcttcaaactctcttgttaggggataatgcagctggctactttaagttgaagccagtgctcacttaccattttaaaaatcctgggacccttaagaattatactaaatcaatcctgctgtactctataaatggaaccacaaagtctgaatggcagcacattcatttgcatcatggtttactgaatattttaagcctacagttgtgacctactgctgagaaaaaaaatgattcttttcaaaatattactgctcattgacaataaacctggtcacccaagatctctgatgtagatgtgtaaggagattaatgttgttttcatgcttgctaacacaacatcaatagcccatggatcaatagtaatttcaactttcaagccttcctatttaagaaatacttttcataatgctatggctgccatacatagtgattcctatgatgaatctggacacagtaaattagaaactttctagaaaagattcaccattccagatgtcaataagaacatttgtgattcataggaggagaagtttgtttcaaaatgagtttgaagcattcaagatgtcagtagggaagtcaatgccgatgcggcagaaatagcaagagaactagaattggaartggagctcaaggatgtaactgaactgctgtaacctcatgataaaacttgaacagatgagttgcttcttatggataaggaaataaagtgtttttttctgagatggaatctacttctggtgaagaggttgtgaatattgttaaatgacatcaaaggatttagaatattatataaagttagttgataaagcagcaacagagtttgaaaatactccagttttggaagaagttctattgtgggtaaaatgctatcaaaaagcatcacatgctacagagaaatcttttatgaaaggaagagtcaattgatgtggcaaacttcatcattgccttattttaagaaattgatacagcaacctcaaacctcagcaaccaccaccctaagcagttatagacacagaggtgagaycctccaccagcaaaaataytacagtttgctgaaggttcaaataatcgttagtattttttagcagtaaagtatttttatattaagatacatacatttattttacactgaatgtttttgtacatttaatagacaacagaatagtgtaaacataacttttatatgtactgagaaactgaaaaaaatcttggcaatattttctttattgtggtggtctggaactgaacatgcgatatcttcaagttatgcttgtatttccctttctcaagttaggttaaactatgatgaaatcccagcaggttactctgagggcatgctttttttaagaagaacagaatgttctggtgttttcaacatgattccttttctcctcccacttccagaagcatgagaggaagtctttatgatattcacttacaggccttatagagctcttccaagtaaaactcacaaaagtgcaggattcccccatgactgagtctccttggtgtttttaactcttggaagttttaactgtcagaatattggtattttctctctcacataacataaattcagaagctattaggagacctcatataggtagttttaatttcagttcaattccttaagtttttcctcaattggtttgggtctgttacacatgcttaattctggagatagcctgaggtttttatggttcatacaaaaattaggcaattcccctcttcatttttctcatctcagattcccgtacactttctaacctgcatttttcccctagttcctatgtccaaaaacacagggtttctttcaaagttttaggcagacaacagttgttctgctcagctactggattccacccttgggacaaaaccttgataaaatatgaaacaaaaacaaaaacaaaacaaaataaaacacaagtaagttatacctgtaggctaatttctccaaattttgactctcttctataatctgcataatttacagaattgtcagctagttgtttattgcattttgttcagagtttatagttttcaacagcaagagagttgggctgtagcgggctcacacagtcataggagtattggctttcccaagatacgaacgtttgaaaagtgttcatttcttatgaaaaatgtataccagaggtgtccaatcgtttggctttcctgggccacattggaagagaagaattgtcttggggcacacataaaatacactaagactaatgaaagctagtattttaagaaagtttatgaatttgttttgggccacattcaaagcctcctgggcctcatgtggatgtggttcatgggttggacaagcttaatgtataccattaaagagataagcatggtacttgctcttgcctcatcttccaaatccctaaaattggtacaattctattatctcacagttaagtctgaatcctccttgctctgtcttctctgtggaacttctttaattaagaaagaaaacaaaataagctatcactatttaaaaaaattaacattatatgttttctatctggattttaaaatataaaggtgtgttcactaattatttctctaaatactatctttgtaaatgtgtagaaggtcttccataaaatatgaacttaagcagaatgttggatgtgagtaggcacagatgataacataatatttattgtttaattgagaaataaaagatgaaggtaaaggtatcatacagtatctaacaagtacaggtatggttgaatgaraaagattataataatgatgaaatgatgataatttaagtatttgcattttaaaatcacacacatggtagttaacaatgttgactctggagtcagacagccctggcttgaattttggttttggaaattaaccagctctgagattacagacaagatatccagtctccctgtttccttcctcatctgtaaaatggaataacagtgctatgcatcctatagagccgtttggaaattaaattaatgtttgtaaaatactttaatctgtgtgttgcagtattgagtgttttatgagtgtttgctttttttctttttaattttttttgagacagagtttcacttttgttgcccaggccggagtgcaatggcatgatcttggctcactgcaacctctgcctcccatgttcaagtgattctcctgcctcatagtccagagtatctgggattacaggcatgcaccaccatgcctggctaattttgtaattttagtagagacaaggttttaccaygttggcgaggctggtctcgaactcccgacctcaggcaatccatccacctcggcctcccaaagtgctgagattacagacatgagccaccgtgcctgacctgttggctttttttttcttttttttagaaacaacaacaacaacaacaaaacacccttttttcatttattattgctgaatttaagtgaaaaacacagatatggttaacataggagccacatttggctttgtaaaagactcaggtttatagtttattattttaaagaagccttcaatacctgaaggcaaaagcaaaatgccatttgaacgtggtactttatcatttactcttgttagagtagcatagagtcagcaaaagagaaaagcaaggaagctttgagtttacttatgggtgttaagtttaattcttgtctgtagatctttggttcgcatgtgcatttcgcaatgtagctgtggctttttaattattgaaaatattgtctggaatctgtttcatgattcattttttgtataatgtattaaaacaacaaaattactttctaaaatcagaaattaatgtacaattttaacagaaataaactgtggacaacaaacattaggtaaaaatgtggtagacttgatattcaaaaacaatccaattccaaattcagtgtgacacacaaattcaatgcacattagtgtgaaaatctcaggggataccacacacccaggtaaattagagttttgtaacaaaaataatataaagcctcactgcattcacaaacatgttgaatttctttaatatagaacaatatatgcagttgttctttctaaaaggaggttttatagttttcgtgaagaaatagtcaaatgtatttacatgatagtatcttttagcagtatttaaaatgtaagatgtttttatggcaataagttgagcatttgttagattttattagactattattaacaaattgagattccacataaaaatttttctcttttgatttttgtttttaggagatatttaagttccactactgaccacttgtataagagtagacagagccacaactttgatgtaattcttttttgagagttatccttagccaagactcaaaagcgcatctgtttttggctgttttatgtataattacattctttattgctgcacactgaatttgtctgtcaagtgtagtgaaaaacaacaaacaaaaatgtgccacattatttatgaccaagcttcagtgattctgtagggctgaatttgaaatggattttctcagttctcctttctagatgctactgtactttactatacaacagcctcaaggtatcctgttgccagtcagaccatctggaatcagatcagcaccattgtattgtgatatgcaaataaagtcccatattttgggactttattgaccttttgttataattttatatttagtaggatttgtggctaaaactgtttcaagaagctcaatgacgcatttaaggcaaatttagatttctgagctctatagagatccaaagtaccacagtttatataggatgctacttgtcctctaaaaggggcattgccctgtttaatttggatttctattttgctgattagtgcgtcattggattagctactgccggcaatgcacaatagtgtttcatacattttatgtttcctcttttacaaatattgtctctgtattgatgaccttagttttatttcccccttttaaggtctattattagcctgcagtactttattaactttttaaagaagaaatcatcttacatttgcattcttgtttgtctgtaattaccaggttgttttagaattacctattaatgtacagcttccttattggactacgtatttcttgagtgctagatttttatattccattactttaccattccaggagcaacatcaatcccaaagtttgtcacggtgtttatagttaataaagattagtaaatgcatgaatgaatgctttacccagaaatggctaaggctttgttagaagtatcagggagaataaagggttgggaaagctgtaagatagcatatgttattcaaaagctaggtgttcacttaagttgattattctctgttgaaataaaataaayattatgtgtcaattgttgtgcttaagtaagggatatagaaacatagttgtaataaaagacttgtgttacataataaagacataaaaatattcaaggggggaataataactaaacctagagtagtaaaaataaaaggacatttaaaggtgagaacacatgtaaaagatgaagatttgtaataagcccagcagttctgagaaatgtaatgtggtttgggggcatttgggaggagacctgggttagtgtgtaaaagcccatttgtcttttataccatactaaggtggttgaactttaaactataggctatgagaacattccttaagtagaggaattaaacattaaggttttttttagaattctttttgtgacagtgaaggagctagtttagaattggaagaatctgacttaaaaaaaagaaaacatgaattgttgaatattggttcaaataaaaggtacttagagtagagayaaggccatagcagaataaatggagaaaagggtcttattttcaatatggaatagaactggtaggtcttggggactgttaggatatgagaggtaatgggagggaggaacttaatatttttggcctttagcacataggtaacaaataggtgatatttactttttacatatacaaactgtttaaatttgagctgaatgtagaggactttaactatctttcatattacttatgaactatgtgttttaaaccatgctttaaactagtaaaaggctgtggractatcctgagccaaagaatcatttcaccatcttttctatacttcttgagttttatagtaaacacacagttaatgtgagattgttattagctaaaagaagtgtaataagaatattgatatagggaggagccaagatggccraatgggaacagctccagtctacagctcccagcgtgagcgatgcagaagacaggtgatttctgcatttccaactgaggtaccgggttcatctcactggggtgtgccagacagtgggtgcaggacagtgggtgcagtgcaccatgcatragccgaagcaaggcgaggcatcaccttacccgggaagcacaaggggtcagggaattccctttcctagtcaaagaaaggggtgacagatggcacctggaaaatcaggtcactcccaccctaatactgtgctttcccaatgggcttaaaaaatggcacaccaggagattatatcccgcacatggctcagagggtcctacgtgcccacggagtctcactgattgctagcacagcagtctgagatcaaactgcaaggtggcagcgaggctgggggaggggcacccgccattgccaagacttgattaggtaaacaaagcggccaggaagctcaaactgggtggagaccaccacagctcaaggaggcctgcctgcctctgtaggctccacctctgggggcagggcacagacaaacaaaaagacagcagtaacctctgcagacttaaatgtccctgtctgacagctttgaagagagtaatggttcacccagcacgcagcttgagatctgagaatgggcagactgcctcctcaagtgggtccctgacccccgagtagcctaactgggaggcatcccccagtaggggcagactgacacctcacagggccaggtactcctctgagacaaaacttccagaggaacaatcaggccgcagcatttgtggttcaccaatatccactgttctgcagccactgctgctgatacccaggcaaacagtgtctggagtggacctctagcaaactccaacagacctgcagctgacggacctgtctgttagaaggaaaactaacaaacaggaaggacatccacaccaaaaacccatctgtacgtcaccatcatcaaagaccaaaggtagataaaaccacaaagatggggaaaaaacagagcagaaaaactggaaactctaaaaatcagaggacctctcctcctccaaaggaacacagctcctcaccagcaatggaaaaaagctggatggagaatgactttgacgagttgagagaagaaggcttcagacgatcaaactactccgagccacaggaggaagttcgaaccaatggcaaagaagttaaaaactttgaaaaaaaattagacgaatggataactagaataaccaatgcagagaagtccttaaaggacctgatggaactgaaaaccaaggcacgagaactacgtgatgaatgcagaatcctcagtagccgatgcgatcaactggaagaaagggtatcagtgatggaagatgaaatgaatgaaatgaagtgagaagagaagtttagagaaaaaagaataaaaagaaatgaacaaagcctccaagaaatatgggactatgtgaaaagaccaaatctacctctgactggtgtacctgaaagtgacggggagaatggaaccaagttggaaaacactctgcaggatattatccaggagaacttccccaatctagcaaggcagggccaacattcaaatttaggaaatacagagaaccccacaaagatagtccttgagaagagcaactccaagaaacataattgtcagattcaccaaagttgaaatgaaggaaaaaatgttaagggcagccagagagaaaggtcgggttacccacaaagggaagmccatcagattaacagctgatctctcrgcagaaactctacaagccagaagagagtgggggccaatattcaacattcttaaagaaaagaattttcagcccaggatttcatttccagcgaatcaaagcttcataagtgaaggagaaataaaatactttacagacaagcaaatgctgagagattttgtcaccaccaggcctrccctacaagagctcctgaaggaagcactaaacatgtaaaggaaaaatcggtatcagccactgcaaaaacatgccaaattgtaaagaccatcaaggctaggaagaaactgcatcaactaatgagcaaaatagccagctgacatcataatggcaggatcaaattaacacataacgatattaactttgaatgtaaatgggctaaatgctccaattaaaagacacagactggcaaattggataaagagtcaagacccatcagtgtgctgtattcaggaaacccatctcacctgcagagatacacataggctcaaaataaaaggatggaggaagatctaccaagcaaatcgaaaacagaaaaaggcaggggttgcaatgctagtctctgataaaacagactttaaaccaacaaagatcaaaagagacaaagaaggccattacataatggtaaagggatcaattcaacaagaagagctaactatcctaagtatatatgcacccaatacaggagcacccagattcataaaggaagtccttagtgacctacaaagakacttagactcccacacaataataatgggagactttaacaccccactgtcaacattagacagatcaacgagacagaaggttaacaaggatacccaggaattgaactcagctctgcaccaagtggacctaatagacatctgcagaactctccaccccaaatcaacagcatatacattcttctcagcaccacaccacacctattccaaaattgaccacatatttggaagtaaagcactcctcagcaaatgtaaaagaacagaaattataccaaactgtctctcagaccacagtgcaatcaaactagaacccaggattaagaaactcactcaaaaccgctcaactacatggaaactgaacaacctgctcctgagtcactactgggtacataacgaaatgaaggcagaaataaagatattcttagaaaccaacaagaaaaaagacacaacataccagaatctctaggacacattcamagcagtgtgtagagggaaatttatagcactaaaagcccacaagagaaagcaggaaagatccaaaattgacaccctaacatcacaattaaaagaactagagaagcaagagcaaacacattcaaaagctagcataaagcaagaaataactaagattagagcagaactgaaggaaatagagacacacaaaacccttcaaaaaatcagtgagtccaggagctggttttctgaaaagatcaacaaaatagatagactgctagcaagactaataaagaagaaaagagagaagaatagacgcaataaaaaatgataaaggggatatcaccaccgatcccacagaaatacaaactaccatcagaaaatactataaacacctctatgcaaataaactagaaaatctagaagaaatggataaattcctcgacacatacatcctcccaagaataaaccaggaagaagttgaatctctgaatagaccaataacaggctctgaaattaaggcaataatcaatagcttaacaaccaaaaaaagtccaggaccagatggattcacagccaaattctaccagaggtacaaggaggagctggtaccattccttctgaaactattccaatcaatagaaaaagagggaatcctccctaactcattttatgaggccagcatcatcctgataccaaagcctggcagagacacaatcaaaaatgagaattttagaccaatatccttgatgaacattgatgcaaaaatcctcaataaaatactggcaaactgaatccagcagcacataaaaaagcttatccaccatgatcaagtgggcttcatccctgggatgcaaggcttgttcaacagacgcaaatcaataaaggtaatccagcatataaacagaatcaaagacaaaaactacatgattatctcaatagatgctgaaaaggcctttgacaaaattcaacaacccttcatgctaaaaactctcaataaattaggtattgatgggtcatatctcaaaataataagagctatctatgacaaaccacagccaatatcatactgaatgggcaaaaactggaagcattctctttgaaaactggaacaagacagggatgccctctctcaccactcctattcaacatagcgttggaagttctgcctagggcaatcaggcaggagaaggaaataaagggtattcaattaggaaaagaggaagtcaaattgtccctgtttgcagatgacatgattgtatatccagaaaaccccatcgtctcagcccaaaatctccttaagctgataagcaacctcagcaaagtctcaggatacaaaatcaatgtgcaaaaatcacaaacattcttatacaccaataacagacagagagccaaatcatgagtgaattcccactcacaatttttacaaagagaataaaatacctaggaatccaacttacaagggatgtgaaggacctcttcaaggataactacaaaccactgctcaatgaaataaaagaggatacaaacaaatggaagaacattccatgctcatgggtaggaaaaatcaatatcgtgaaattggccatactgcccaaggtaatttacagattcaatgccgtccccattgggctaccaatgactttctacacagaattggaagaaaactactttaaagttcatatggaaccaaaaaagagcccgcatcaccaagtcaatcccaagccaaaataacaaagctggaggcatcacactacctgacttcaaactatactacaaggctacagtaaccaaaacaacatggtacttgtaccaaaacagagatatagaccaatggaacagaacagagccctcagaaataatgccgcatatctacagctatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcacgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaatttttgcaacctattcatctgacaaagggctaatatccagaatctacaatgaactcaaacaaatttacaagaaaaaaactaacaaccccatcaaaaagtgggcaaaggatatgaacagacacttctcaaaacaagacatttatgcagccaaaaaacacatgaaaaaatgttcataatcactggccatcagagaaatgcaaatcaaaaccacaatgagataccatctcacaccagttagaatggcaatcattaaaaagtcagggaacaacaggtgctggagaggatgtggcgaaataggaacacttttacactgttggtgggactgtaaactagttcaaccattgtggaagtcagtgtggcagttcctcagggatctagaactagaaataccatttgacccagtcatcccattactgggtgtatacctaaaggattataaatcatgctgctataaagacacatgcacacgtatgtttattgcagcactattcaaaatagcaaagacttggaaccaacccaaatgtccaacaatgatagactggattaagaaaaatgtggcacatatacaccatggaatactatgcagccataaaaaaatgatgagttcatgtcctttgtagggacatggatgaagctggaaaccatcgttctcagcaaactgtcacaaggacaaaaaaccaaacactgcattttctcactcaggtgggaattgaataataagaacacatggacacaggaaggggaacgtcacacaccggggactgttgtggggtgggggkaggggggagggatagcattaggagatatacctaatgctaaatgaggagttagtgggtgcagcacaccaatatggcacacgtctacatacgtaacaaacctgcacgttgtgcacatgtaccctaaaacttaaagtataataataataaaattaaaaaaagaatattgatatattatttaaattattgtttaagtaagttttttaagaccttgatgtttttaaagcataaactactctatttctgtttatgatttgactgtatatagttcttagaagagtggcaggtatatagtgagtgccaactaagtattgtctattattataactatcagtattacttgttccttggataattgcaagagcctttaattgatctttctgcttttgccatttcatctgttctctaagcagcataactagaaaagcaagtctatttctttcaagtagcacctggccaaaagaacaaatgaatgaatgaagtgtgccacctctttgctcataatcttccagtrgcatttcatttcatttgtaaagttattccaatagtctgcaggaccttatgtgacccatrccacaccctctgcctctcctgttagagtttatcagtgtctcctctccatgttgctacctgtggattgttggttcacaaggtgtccctcacttgaatatattaattaatctcttgccttggggctgcttgtgccatggggcctggacattcattagtccttctgcctggaaagctctctcttagatatagcattttttatttcctcagttcctcaagtgtctctgtctcagtgtctcttaatcagtgaaactttccatgattgcactttataatagagtatcctactttctgacatatattcgctatcctttcttactttatgttctttacagcatttattactttctggcatactacattattcttattttgtttctccctctggaatataaactcctagaatgcaggagctttgtgctgtgtccacaaaatctaaaatagtacctgacatgtaatactagtattttttagtgaatgaataaatatattttctagcacttattaattcaaagggtataggtcatctatagcagacaaggaagtgggaagcaagatctgttacctttttataaccttttaattaattaaatttatttgatgcaatagagccatattggtagttatgctttagtaagaatccttgtttaacattgataacmtagaaagtataagataaacgtacagttttttcatagtgttttatccaacttttggcattttctgtagtacttggtaagcagatgttgaattagaagtacattcaagtaatataagacactgctaattttctcaaagctggtttcttaagttagttttgggattctgcgcaatacaagggctgtgtgggaagtagttatgtctgtgattatatggtttccctcattttttcctttgaattatggttcaaatgcaatctctgatgcrtttttcaattacactaaaattctaagcattttggcaactttcctttaccacagaaaacagttgagaaaaaaaaatcattaactgtatggggygtttgaaaaaaaaaaaaactggtgagagttaatgccttggcaaattcagaattctaagtagacaggaagcataggttttcattaatcttctgattatggtagttacttcttaagaattttatgccacatttaagatttaatttcagccttgtatatgcaatcaaaaactctgccaagagccaccagacttttcctgaaagctctaatatcaaatgtgagcagaagttttagggtctaggggctatcttatgaaaatattatagaatgttgttaggctatttattttacactggcacatacaaggctacttacctaaatgtatttttattttctttctattacatttttcctcatgtgtttgatttatagaataatgactttaagactcctgaaactggaacttatttttagaaaaaktataactagaagtctgccacttaaaggtttgttttcctttaattgactccaaacactggaataaaatatcttatatttgtatatactttacagtttataaacagcttaaatctatattagttgtgtttagaatttctgaggaaatacaagtaatagtattcttcatttacaggtgttgaaataaagtctttcaatggtgaataaattattggccaggagatccatttattgatcatttattgagtactcactatgagaaggcctagtccaggaattgtgaaaatctctgacaacaaaactgaaaagtccctgctctcatgaagtttatattccagtgaatttaattgaacaaaatagattgactggttaagtaaggagcccaggctgtaaactatgccttttattgtcttgtagagatgctataccttcctgacatgtgacacacatactggttattcaaatccttaaacttactgtttggtcatccagatatacatataaaatatatatttcatatatatgatgtatttcatatatacattatatatatatttcatatatatgatgtatttcatatatacattatatatatttcatatatatgatgtatttcaggtattcattatatatatttcatatatatgatgtatttcaggtattcattatatatatttcatatatatgatgtatttcatgtattcattatatatgtttcatatatatgatgtatttaatatatatcatatatatttcatatatatgatgtatttaatatatatcatatatatttcacatatatgatctatttcatatatatgatgtatttcatatatatatatatttatatacatgataccaatttctatattaggtcttcaagtagatggtgtttccccaacttctcatattcttttgggttcactctgagttcccacagaaaacagaactctcttcaggtagtttcagaagtttgagcagggaggctgggaaatctagtaattagcattaccttcctgaggactaaaggggcaaggggcataaatactgatacagtgctcagtgaggagctgtagttctgtagaagtactttctagcagtgtcaatagtgataagggtcccagactactgtgacaagctaggaaagtatgggggtaaacaatgccaacctttttcccttcccaacttccaaactcctggtggtagcttccatgtctgtcccggaaaccaacctgcgggagagtctggtgatgcagactttaggggtcagattcttgcaggcacagagtaagagacagaaatgttagtaataggaattggggtgccaacagtgaataacaagtattcctttatttaaaagaaaaactgaccactttcacataaattatgccaggaaattctagataaatcctctaattttctcaggtgaaagttatttcaaatttcttatatcttcataattggaatatagcaggtagtaaagaaatatgtgtctcatatcttatttatttgtgtataataatctgaataaccagtctataagtatttgagaggaggtttattttcctcctattcatagtgtcrgcatgatactttgcctccataaatatttattgaattaattgatagatgaatgattggtaaacagtcaaagacaaatattctcaaagtaacctggctgttaaaatccttgtacaagttagaattaaaagttataggagaaatataattactatcttatttataatatatcttagcctattaacttgttataatacatacaaaagaaaacattttgttttgggaacaaaatatagcttttcctaaaataacgaacctatattgttatacaacaatgttgtataacagattgtttttgccttcaaccaaaatacagtttttccaaaatatacccatatcagtagggaattctcgctttcaattttgagcaagccttccatcgtttactgttcaacagatattgcatgttcaaggcacaaactgactatattttgtagaggaaacaggttttcacatttgacaccaaaacataatttttgtttcagaatttraaaaaataaaggtatgctgattatattatatatatgcatactttaaaagtcctctccraattacatactttataaagtagccgatttagatttaaagagacttcaattctctaaagaatgaatgtatcattcattgttatagaggattgcaacagagcaaaaataagggactatttttaaaagacctgttatttctgggatagtaccactttatataaaattaaaataataaatatatagaaatrcaattaccaattatttatttttattctctgacaggtattttctctgagggacttagaacaggcaccaaaaaaaaaggatgatgctaaaaattgatatgtaaaaagctgatacccaaatatctggtattgtgttggaggaataaacgtgtcagttcaactgttaactctttatgaaatagtgaaaatagtctataatttctttcatattccaaaaataacaattactttaaaaataaatctaaaatttactgccaagttaaatactatgaaataaaatgtaaatgtcaaattctaatgctaactytgtgaaacaggcagtgaaagtactacctaatgcaaaggccatatttgaccttcacaatgatattaattatatgaacttgtcttttgagtctaagtgttaaaataaaagttaatcattatgtgtcaattcaaaataaaaatataaaaattaaaaagcacattaaaaataaatactgattaagaatttatcattgataattagcattcaaattgagatgtgctctaaatgtaaaatatacataatctttcaaaaacatggtaggaataataattaatagcttttatgttaaatacaaattgaaattatatgttttgaatatattatgtaaaatgtatgataaaagttaaagaaaaataaaaatattacatacttgtttccttacatatgaataatttttctcaaattgattttttaaaaagaggtctcaaaatgattttcattttgttttaaaatcctctttagtattttaaatgttaatttcaatcatattattttggacaacaaatgtttttaaaatgtatcagatgaatttattttgggagggggatcaaactgtggtaacattttaaatgttaatcatttaaagaaacattgatatgaagaatccttttgtaatctgagaatcatctctaagtattttttagaattgtaatttaaatttttacataagagtttccttaaatcaacaaggaactaaacatgtttagtcttgattcatgttaacataaactgataaaatgaaacaaagaatacaaaaaagtatataatctgagattatcagaacatatactttaatatatattttgagattaatatgagaatatgtactttttgaactatatatttgaactctgtctatatataatatatataattggaatatatataaatgtatacacacatagttcaaatattaggggtatgtttttctagcattttttgttttctattgtcgacatgaagtaggattacaatataactttattaagatggaattaatgatacaaacaaaattattttaatcttttactagcacaataaaatgtattttaaaaataagactattttatggatatttcttaaaaatttgtcctctttaaattctttatttgtagttggaatgatgcttttttacatttcttattttctattttcttcagtggactgaggggtgtctatgatgatgatactgtcaggtgtataacttctgattaccctgtattctagctacttgccaaattaaatcagccaatatttctacagcatctacttaataccggaccctggatatagtcagttattacttttgttataaataaacaaatatccattttgtattttttttcaattgaaatgacctttgctctgttacaaagacagaacttcagacgaataaaaaaaaaaccctagtattaactgatttatattagttttttagggctgccataataaattgccacagcctcagtggcttaaataacagaaacttattttttcaaagttctggaggctaccagtccaagatccaggtgttgacagagtcgttttcttctgtccgagcgttcttgccttggcttggaaatggttgtcttctccctgtgtctttacatggtctttcctctgtgtgtgtttgtgtcttactcctttcttaaaggagaccagtcagattsaatcaggaccatactagtggcttcgtttaaccttaattaccttcttaaagaccctgtctccaaatacagtcacaatgtgaggtattgggaattaggatttcaacatacaaattcgaggggacacaatttaacccttagcactcagtctgggcaagctcatcctgttcttgataaacaatgaaaaaaataggtataagattgctacagaaagaagtacggactgtcatatcaaagggaaattttctgccaattattattgattcttgaaacttggtttggtttcaatgatgcagtctgatagtctgcaggtataggagagatacagttcaaaaataaataaaagtyactgtcttaagtgataaactgaccttactccagaaatgactgttagttattattctacttcttagacttaagagattgaccctccaattttttccttttattgtagttctatttgagtaaatggctttgccatcctaccattgcttacttgagaaactgcagaattgctctacgttcctctgttaacactttgctccatatttccttatcattctygtctcactccatcatcagcatccagtcagtttccaaatctcacagatatattttttactaatatatgtactgtctgttccatctaytccattcctagtatggctgacttggcttcaattctcaacacttttattgaaatcaactcctaattgatttatctgactccaaactggctgcttccaaattatcctcccttttgctgtcaaagtgatttttttaaaatacaacattgatcaatctatttcatttatcagagtcctcaaatgacactcaaatgacatcttttgagtttcagttcacatgcaaggcttttcttaaattggttcctaacttaaaaataaatatctactctttaccctcactctttatcatcaccatgtaagtccttccctctaatgtgctgcactatatatacttctctctctctctctcgctctctctctttttggagaaagagtctcgctttgtcgagcaggctgagtgcagtggcagtggcgcgatcttggctcactgtaacctccacctcccgggttcaagcgattttcctgactcagcctcccaagtagctaggactacaagcatgcgccaccatgcccagctaactttcgtatttttttggtggagaatgggtttcaccatgttggtcaggctggctttgaagtcctgacctcaggtgatccacccacctcagcctcccgaagtgctagtattactggtgtgagccactacacctgacctacgtctctgaattcgtcatacagtttcatccctcaaaagttttgtttaagatgctttttatgtttaatgctattttacctccatccccttcattaggcyaactcctatttgcttttaacaaatcatcaagatttttccaagaaccgtttcatraaaatgttcattctcattgagatacctgtatgttgcaagttaatggagacaagaatgaactataagaaatttggaatctagatgattttatggaacaaaattatagctgtgtgatttactctagcatttagggagatgaaatatctaatcttagatatttctgtagttcaataaggtatatagtcaatcgttacagtgttattttccagatcttacaaaaaattgctctcttagaataaaaaactttaaatgttaatattwaaagtttagatcttgtgagattcagagtagaattgaaagccttgtggaattgtgcagtcaccagttgttagattaaaatttaagagagaagatcatttttcaattataattgagcactgattcaacatctgcattaactgttttagttatatctaaatttcttctgccttttttgtgatcctaktaagktccaaacacataatccatctacaagtcacattattcaatcagatggaattgaacaagacagtatcacaggctggtttttcattgctcattctctagaggcagctgctttgctgtgcaattcagtggatgctcaggctgagaactaacataaaccaatcactggttggcttcacataagacaaggagttcaatctgaaattcagatccttagcactaacacattgacatgtgaccttaagacattagaccaatattatttaccatacttttccaataaatgtgattctttacacacacacacacacacacacacacacacacacaatctaaatgtatctttacttgtgtatttcatagaccattatgtaattacattyatagcacagaaaattgaaacagctatgccttatatagactttatatatatatatataaaattatatatatgcaaaccaaagtaaaaaaatgaacaaaaaaagttagcatatgtgcattatttgtttggttttaaaagtatgctattacttatataatttgattttgataaaaaaaatagtgagatccttttgcaatgcatgtgacattcacaagaacatcatctgtgtagacagtttctatttagttttcttacattttatttgctttcactctatacccatactgtctataggcaaacactatagtataaacccagttgacacagctggagatcacaaagtaattgcatcaactgtaccttaatcttggttttgtggaccattaaaggaggaggatgccttgtatgctaaagatgccagttttactcaataactttaccttttttagctgtgaaaatktttatggcactattgaatctaaatatttatagttcattcaatctgtaacaatgagcttgtttacagagtgtcttaaaacatgtcatacgattaacataaaacactgtaaaatgccttctgggaaaaaataggactgtaagttttttattgaatttttycagtttctttctagtatattttatgactattaaacacctgaaataagaatttatattggaaaagttggcaggattccatttagtcaagttaggactgtaaatagaatagtaactacttaaaccagcattatttaaaaatatatattatttaaaagtactataaacatacatgatgcatatatagatatatatttatattatatataatatatatttatatacataagtatcatatatatatatatwtatatatatacgatagcaacttttttgtttttcagcaatagattcacttgattcattataatttgtatataattaagtatggcattctagaatttctatccctggaaaggaacttagctattatctctcagtgcattcattttacaaatgataaattaagtgatgcacaattccaagtagttaatggcaaagctaggagaaaatttaggaagcagagtttgtaatcaaaaccctcagtgattccattactcagtcatattgtcatgtactcaatagtgcctccttatttgttttaaatattaataattttgtattcaaatttctctttgctttttttcatttataacaattcaggtatggttactcagtgttctgaattgttcagttggaatttgagaaatactatcagtatattttaagaacttgtatttatttgctatgtgtctatttaaaattagtaggtattaggcaatattagagatgctcctacttaaaaataatttacaaaaaaactcagaaactaattttattatcagttatttatattatytcatgacatgtaaaaataaatattttcaagtttagaagtactaataatacttatgatgattttaaatatggttgtctagatgaatattttctacttctgctttatgttatgcttcatcataaattaaagaagatgtttccttatttgggtgttactaggacatactagcatattacatgtatttttaaagcactatttgagagagtgaatgaattaaaaacgattaaataaaatgagtaaaaaacttgcataaatatagcacaatctgagatatcagtggagatatttctgaagtccacaaaatttatcrtgaagatgaataaacataatatttcatttatgtcagcacaatttttattagtggatgtgtgtttttgagtcatttttgtgatgtaatgttgctcatttttgtggtgataatgagacattctagatgaagattaacaggtagttggcaataagaatttaaatgtcaaaatatggatcaaaaggggatcagcttaaaacactaaaaagaagatttaaaatgagatgcccawaaggagacttgaaaggctcaaacattaatctgatcatctaggatacctgtgtgactgtccaggaaagacctgaggagaaggccctgctatttcaaatatggttgactttgaggatctacctagcaaaaagtgagagctaagacagtgttgtaaactgtaggagtgttgaaagtgtttgccaaggcacwcagaaagtctcttgggatactaattggttccattcaattccaagatttaaggaaatctcactctaatcatttactgatcattaacctaaccagagacctcattggccacaggcagcaaagactacttacttagagaattacttcaaggaaatcactaaatgaacaagcaccaacaactacaaagaaaaataacagtaggcctggcggaaggggaggatagtatctgatttcagggttgttatttaatatgttcaactttcaacaaaaatactttcaacatcatgagacaacaaaaaaaaatgaaaattaagtgccatacaaagtaaaaagcaaagcaaaacagttaagaggatctgtccttgaagaagcacagacattggacttccccaacaaagacattaaatgaacaattatggttatgttaaaaaaaacgtaaaaaacatgactaaataactaacagcaagtatgacaatgttgtcttaccaaatagaaagtagcaataaagatatatactactaaaaatactaaattgtagtactgtagttgaaaagtataacatacaatgaaaaattgactagagaagttcaacaaagaatttgagctgacaaaataaagaatcagtgtacttgaagacaaatcagttgatattatctacaatgagaataagggggaaaaatacattaaaaaaagttgacagcctcagtgcgggacaccamcgaacattccaaaataggcataataggagtcccagaaaaagtaagggcagaaaacatatttaacaaagtaatgactgaacacttctcaaagttgatgaaacaccttaatctacayggtcaagactctcaacaacttaatcygataaacttgtaaaatctacatccagatacatcataatcaaacatcaaaaaacaaagactgtgagagaatcttcaaaacttcaagagtgaagtgactgataacatataaaggattctcatttagattaatagctgattccctaccatatactgtggagggcatgaagtagtagggtaacatattcatagttctggggggtagggggaaagacttcatctaaaaattttatagccagcaaaactgactctcaaacgcaaaggaaacagccaggtgcagtggcatgcacttatagacccagctaattaggaggctgaagtyggaagatagctggagtccaggatttcaataccagctttgggcaacataataagacaccactcttaaaacaaagaaaaattaagacattcccatatttaaaagaatgttcactaataaagttccctttcaagaaatataaagtctctcagattgaaatggaagattactggacactaactcaaataaagaacactggtacagttatctgggaaaggtaaatataaaagattgttcttgtttataatatttctctttttagattaaaaacaaaattgcataaaacaataattataaaactgtgttgataggctcatagtatgtaaagatgtaatttatacaacaataatagctacaaggtgggaggagggattagagctacataagataacatttttgtgtaggattgacatgaagttagtattaatttgaaaaaggttgtaataaagtaataataattctaagagtaaccactaacgaaacctataaggctatagtaaaaacataagataagtcaaattttaaaatagtaaatatctattcaactcaaaaaaggcagtaatggaagaataacgtaatattaatacaaaggcagaaaacgtagaaaacaaatagcaaaataataaataaaaacaactcaaatttccagaaactgatagataaactgcggcatgtccataaaagggaatgttacttgaaaagaggaatgaagtactaacacatggtacaacgtggatcaatcttgaagacattatgataaatgaaagaagccaattgaaaaaggccacatgttgtatggttgaatttaggtgaaatgcccaatttttacaaggggccrggaaaagggaaggatagagagtgactgccactggttgcagggtaacttttaggtgtcatgaaatttttctgcaattagtagtgatggttggacaaggctgtggctgtactaagcccactgtattgtaaattttaaaagaatggattttatatgtgaattaattaaatccattataattgattttatatgtgaayrgtgtgaacagctcaataactgttatttttaaagaagagaaatgtaagcatagaaatataaatttttgaaccttaaaaataaatcctaattctaagggtgagaatgaacacagttttagacagaagaaagaatgatacaaataaaaataagtgccaaccacaccacaggtagtaaccacagtatttactaagaaattgcctgctaggattaaatatcttaattcttattaaataacttatactcaattctaattaactaattaacttattcctttcttggcacttcttacactatttgattatatcttttcaagttattaattttattccaccttatgctagagtttaaatattcttaaccactaatttgcactctcyaaagtgcaaagattatatcaartatgtgtttctacacccacaggttcaatattttgtgtataatactttctcaataagtatctgttaataaaaaaatgaatattgtggtataaatgtagaatgaattatttccacattctttaatttttaaagatttttgtaatttaatttccatatttttatcaagttctaaataatccctgttgataagatgcaaagaaagctagcatgacttttaagttattaaatatggagtcgggagttttatgaatcagatttatgtgctcaaacttacagggaattgaatgctcaagttaaatggctatcagcccagatattactctaggcctgagtrtaattctgaattaatatggtcatgacacacagatttatattaaattagtttcatgatgaaataaagtccagatggaagtagycacattacrtcaagagcagaatatttggatttttctcttgtttgcmgtttccaaaagctcttgaaattaaaactctttaggtaattctattattaaatattactaatgttttgattttattgaaatcatacaaatttattgataggtgatgtttaatgtatccttaggaacwcttttttttttcttaatataaatgcatcaaactcatgytttttttatttttaatctggatttttctggtgtcttcatttctcattcatctttgtaggtagggatttcttttgatactaatttttctaacagaacataatagttggatctatatatttactctaaaaatttcatataaatttcctaacaataattccttttaagcttattgagctttttacttatttrgtattactattacattactgtctttatatatgcacagtttttaaaatgtgttgacttttaaaattagccttttgctcacattttatttgttctttaccatgcagtataaattaccagtggagtaaaattgagttttgaaaaatgaatgaatgtagtatagatttcctgagccagaagataacatagaataacagcctaatatttacagccgatttgtaaaataggtgtttctctttcaatcctataagactcttcttaacattgaaatataagtaggtcatttttcttcttcaaatatttaaaaataaaccacatctcgctttggtatatgtgtactttaatatgctaactgaatctgtgtctgtttgtttttgtttttttttttttcccagggggacatycagcagtttttgatcacaggtgatcccaaggcagcatatgactactgtgagcattatagtccagactgtgactcttcagcacccaaggctgctcaagctcaggaacctcagatagatgaggtgaggagcacaagaccagagaaggtcttcgtatttcagtgatatggacatmgcagtgcagtttttgaacttatacttatttattccattttaattaagctatgctttgtattttaattgtgttgtaatatttccaggaaaaagtgacttgaatatatttggtacttgttttcttgctgtttaagcatttgattacataaatttattagcaataatggtgcttcacttgtatactgtgtatatgcacatattccattttggagggggtgagaagaagataatatgtaatagcgatatttcgaccattagcatttaaataattaacagcctcaagatagaataacatattttctggtgtacatgccatctccctaggcctttggcaatgcatacaaatgagaaagtgacattagaactatcttaaagttttcaggctgtgttgaacaattagagggtttttaaaaaaaawtttctcataggaaaatktaaaagcatgtgaaatggaaggaatttaagcctcagttgggagcaaaactatatttttggattttttttttttggattttgaatttttaagacttagagttttaaaaaggaagtagaaatttgaaaatatcaaaactgttctaaaaatgaatcaggtagtatttttcttcccttttaaatgtactattaggtgccaccatttgagttttactgtttacaatgggtcaaaatcttttatcttaattgttagttctgcatgtgaattcaggtcggatttttcactttcaatgctagaagtatgtttttgacactactttactttttaaggtttaataatgaattctgttgcactgatattttccatgacttaatgttagtttttgtttaaaaaacagggtaaaattttaagaacctaacaggaaggcaaatrtgagagtgtaaagataaattactgggatattttatttacctgtttcacagttatcatgtacttcattctttttattctctcatgattcaccaaatatgttttctgtgaattctgaagtgatagataaaataattatcaggtttagtgtttttatatctaagaggttatgtgctgacttaatattaaaatttatagcatttactgtatattttcaaggttgatgagatctgttttgctcctttataaagaaagataaggcatattattctttttagcaacagatatggctctgatttttggaagaagggaggtttgcattcttaatatatcactttgaggtgttttgttcccatgttgtaatgctattatgtcaggtaagctgttattttatcaaggtaatttgtatccatcttcttaagttcatttaaaaatgaacttgccatttactattttagttgttgacatgtatatttaacattctgttgagatgtcaaacttggttttactagaagcatttgatgagaaaaacagcacattgttacagtagaaactgcatgacaatcttgttgggtaatgcaataatatatagcatttttacctttttttagattgagtaagtcataatgaaaaagttttttctttaagaaagaattagctttcccttttttctctaactctaaattatgttgatccttcaataataagataagcatctataccagcatcaaaaactacttaattgaattagtaagtagtgcttatattaattttaaactatatctattaatatgtcattatatgataacgcatatamataattcatcttcagaagttctacctatataaattaataatgcaatgttggttgccaatgaataaagaacataaagtgcaatatggagcatcagccatacatgtactttatattacttacttgttcactaataaacttctggcattgcatgtttattattctaatttggattaataaatatgtcaatttattttataagtcaaccgatatgcttttttcagcttataattttgtctacttagtatcctctaagtagcatatcctaatctattcttaagattcacattgttatatgcttgacataactttacaaccatcaccatggagaaagagatctataatgtagacagattttaatttaatcataatatcatcacattttaattttatttgaacctacacagtgccatttaaataggtgacaagctaatattaaaattatgatggagttgggattttcttatcaagtgaaattatcttcctatcttataaaaaattagatgttaaatctatatgattccttttgatattctttcttaaaaaaggatgaaaacagaaaatgaagtgacaatcttttataaaggaatttacaaaacaattagcttttcaaaatatattatcttttcacttaatatgtatcatacattcattagatgcacaggtttttactgatgtcaccagttttcttacaaattatgtaagaacagacattatgacatttctggaagatcctttctcctaacctactctaatttctgttagaataccgacaaagttgaaattattccattactgcctgtctttttgcatatatttgtctgattgattataactagttcttttttctctacttgtctcaagccatccttagaattccataatgaggggagagaattatctccaaaaatatgttatgaggctttacgtagcaatgtatatatattgcgaatatactaagcaatgtcttgagtatattcatgaccaccacacggaggaagctgtgcagataaaggagaaccaggagtgaataagctctaaaagaaagatgtgccggcggggcgcagtgactcacgcctgtaatcccaacaatttgggaggccgaagcgggcggatcacctgaggtcaggagttcaagagcagcctggccaacttggtgaaaccctctctctactaaaaatgtttaaaaaattagccgggcatggtgtcaggcgcctgtaatcctagctactcaggaggctgaggcaagagaatcgcttgaacccgggaggtggaggttgcagtgagccgagatcatgccacttgcactccagcctgggcgacagagcgcgactccatctcaaaaacaaaacaaaacaaaacaaaaaacaaacaaacaaaaaacagaaagatgtgctgtagtgtctagggcagttaacatgttatttcctccattatttcaaaaccagcctggttagtcaacatttggagagtttaaataaaggacagaattatgaaagttagaagataatttgtcctataagagaaaaaatgatataaaattgactactttggtacaggtctgtatatatccttgaatagcagatttcaattaaaatacgtttaagttgtccaggtttaaaattggccctttatgcatttacttattgtttttgtaattcataactcctcttaagctactagagcttattattagaaggcactgtgatcacaattttctaaaacatttgtggtcaacagttcttttgctggaagattaaaagggaatggttaaaatgcaaagagagatccagttgagacataattggaatcgtatcaaatacactacttaaggaattatgtgtagattgcccctggaaaatatatattaagtatacatattatatgtattatcatatatgtttgccctaggcaattatatataaattgccccggcatgcatgcatatatatatatatatatatatatatatatatatatatatattttagagttttaacttgttgagtttactgctttttatgctacatatgacttagtgtatttagttatttttattaaaaactgaatttaacttatgtttaataatatctatatcttgattgaaaattaaaatttttataaagatattgagctttggatttgagcacactattttgctcattatttaatatgtacaattgtcttttaactccctctattaagaaacatatctctccttaattaaaatcttttaatacagaagaaattagtataaaatactatttccagtgtgaatttattataagtattttaagaaagctaagtgttatgccttttttaatagagaaaaaggcagtgattttaaatattaaaattatgtattaattataagcacatctaattttgaatcttttaatgtctcacaaggattttgtgctctttttgatcttaggaaagtctaaaggaaattaggaatttcttaatacattttagattttattttcccattggttacagtatttyaatacagtatatacttatttcatattctttgtattccctttccctcctcccctctttcccgtctctcaatagatatgaaaatcctttcatacttaggaagactactctctacatttttatttttagatatgtagcttaatttaaaattcccattgaaattactgtagcgctcttatagagaaacattgcatagcaatttttacaaatcaaaattaatgaatatttgacatctatgtccaagtacataattactgtgtttcaattaacattccataattaagagtttgaattattattccaaattttttgttttctcgtgatactaactactattctgctcataggaaatgtgctttgtcactcctatgttattatactctgtataagacagtataatacttctatgtaatamaaaaataactcatcaataacattaatttcttatctcttaacatttacactatgtaaaagttaagatggttctcactttgtgaatagtattttgccactaacacaattgcctgatattttttcctttgcaatgtagtatgcaccagaggatataatcgaatatgactatgagtatggggaagcagagtataaagaggctgaaagtgtaacagagggacccactgtaactgaggagacaatagcacagacggaggtaaaaacaaagcagtgcctgtgtatgtggtgtcctgctgttcgtcatcctgtggttccttatgttgactgttcctcaaacttaccataaacctttcattcatcttatttctctgaaccaataactgtgatttttatttgacagtagccgttttgaagaatgatgtccatttcacttttgcttagccttcctttcatctrtgmtctatatttccctcctcgtttatttatgttttccattccatctttcaccacattttacagaaaaagaaatccaatttcaaaaagaagatgaggacagtggctactaamtcaaaggaaaaatccaaaaagtttacaccccccaaatctgaaaaattttcatccaagaagaagaaaagttatcaagcatcagcaaaagccaaactaggggtaaaggtagcgaagaaaaagcaatcaagatctatcctagataagctggaagatctctgatcatgaatcatagtcttaacccaactagataaatactcacttggctaatactataacccaattaaatcatgatttccatacatttgggatcaccttacatgtttactaattctcttctgaatttaccattaggcaaacrtcgttgatgattttcaagaatacaactatggaacaatggaaagttaccagacagaagctcctaggcatgtttctgggacaaatgaggtaatacgtatagacagtattaaatcacagtcccactttttaaatatgtaatttattttgatatacttyactctggaagaatctataatttctcaaacatctgatgtttttattcttttactaaagtaagagaaacaatagcaatggttcactattactaaaagcagttcatctgaaatcaatgccaattcaggttttgcgtgactctttgcttcatgcagatgctaaattgatcaaactgaattggccgctattattttcttaattgctcctggaattgagcaagcttttcaacatgttgtgactaagggtattcacaacatgtttcttctgtgagaagaatcctctaaagtgaaaattgtatcatcgaaggatacaattagaattttactccctctgatgaataatcatgcattttatgacagcaagcattttgagaaaatgtagtcttagtggacttaaataactatttacattttcaaacttgttaggaatgtaatattaattcttattaaactaatatatcttaatctttccattattttctatgaaaatatttaagtacatgtaggtaaaaattaatcttcctgaaattcatatttcacatgcattctgatcatgaagaatacaattcagtttaactttgttaaatatctggtatacattttggtataattttatcaggaaatgaatataagaaatgtaatttagttttargaaaatttatgtaaaatgtctctcaattaggcaaatagatttatgtgaaaacacaaaattgtgaataataaatgtttagggtgagaatggattttaactttcttttagatgaaattaataattttcaaaaaaaatgagtattttgattcaagatgtccatttacctaaccaaattcatccagcattttagttcagagctatgattatagcaatattctcaccatagatattatgcagtctctgtagacagcatatactccttatctaagaatmcaaaaaaaattacggttattggacatttaattttagtgaaaaattactcatcatttatctacatattttcattcacaagattgtgtaatactattatctaatattaytctatcatctagatttactatggaatagaaaatgagttacttaaaaatgaaatttacaaattggcaagataagcctaggcaatacaataagatcctgtctttacaaataaatcaatcaatgaataarctgggcatgctggtgcatgcctgtagtcccagctacacaggaggctgaggcaggaygatcatgtaagcccaggagtcccrggctgcagtgaggtatgattgtaccactcractccagcctgggtgacagattgagaccccatctcaaaaaataaaaagtagcaagataagttatttaatttgagcctcatcatgatcataataaaaccaaatattcacatgataagtcggattcaggtttattctactagtaaggaattatgagaaaaaaaggtatcagtttttrtctatgtctctgaggaagtattattgacataattcttacttktaagtattaattaatatttattccttactcttcttgagaattgtacagtgatattttatatttcattgtcytaaatgttgctagctatcatttattttatttgctttaaagaactctttggtgtaatactacttccctacatatgagatactctrcataatcattgtaatgatacatctctatttatactgatattggcatattattattttatttatgggatgagactcaaacttatatggcttatccttttagcaaatgtatttcataatgatgttctgtaagatttaaaaattaggcaaagctgccrgggtgtggaggctcgcacmtgtaatcccaacactttgggagaccaaggcgggtggatcacctcaggtcgggagttckagaccagmctgatcaacatggagaaaacccgtctctaccaaatatacaaaattacccaggcatggtggtgcatgcctgtaatcctagctactcgggaggctgaggcaggagaatcacttgaacccaggaggtggaggttgctgtgaaccaagattgcgcccttgcacaacaagagtgaaactccatccatctcaaaaaaaaaaaagaaagaaaaaaacattaagcaaagctttaactccataccttttttattgttcaaatcttaaactgtgaagtaaatatgaaattgactaacatgttttttccaatggaacaagcaaatacacatgttaattccatgtgaatatttgcagtttattggagaaagtgctttgaaagcaatatctctttgtacatagcaatgtacaaatatatttctttcaatgatactgaaagcctactttccaggtgtttagagttgcttgagtagtaacaaaatcgcatcccatcacacgctatcaaattgtaatttaaatgcttaccttgctttactaacaataaacttcatgttcctcaattccttgcaatttaaattaatagccaaatccagttgaagaaatatttactgaagaatatctaacgggagaggattatgattcccagaggaaaaattctgaggatacactatatgaaaacaaagaaatagacggcagggattctgatcttctggtagatggagatttaggcgaatatgatttttatgaatataaagaatatgaagataaaccaacaagcccccctaatgaagaatttggtccaggtgtaccagcagaaactgatattacagaaacaagcgtaagttgatactatgcactgtgtcattgtatgtcttatttatgggatatttttatgtccatgtccatcttaatgtcttttcaggtttaaaatgcaggttgaatttttatgtaaattatgaatgyctattaccactaggacaccttgttagattctttcacatgggaatcttcagcagttgtatctttggccatacttttggagtcattatttgaaagtaaaatcttgaatagaattgcatcagaaattttgtcattgataagattaaaccatagttgtttttattccaagtagcaagtctgattttttatttctgatttttagactattttttaaatttaatttgatgacatttcttaatgcctgggaataataactgacatctatagatgtcattataaaacatgtttataagaggcaatcgttcaatctcattttaagattcagtattaatgcttcttatgcctctcttttaatttttgccatatttaagccttcaataggtcttcatatttaaaaatatattttaataggttgttttaaatgtgtttagtttactaaattatctttttaaaaacaaatggccggccgggtgctttggttcacgcctgtaatcctagcactttgggaggcagaggcgggcggattacctgagctcaggcattctaaaccagcttgggcaacacggcgaaaaccgatctctactaaaaatacaaaaaaaaaaaaaaattagctaggtgtggtggcgggcgcctgtagtctcagctactcgggaggctgaggcaggagaatggcgtgaacccggcaggcgagcttgcagtgagcggagatcgagccactgcactctaacctgggcaacagagggagactccgtcttcaaaaaagaaagaaagaaaaaaaaaagaagaaaagaaagaaagaaagaaatggtcttacagacatttaggctgttttgaatatttcattcaacagataaatggccatggtgcatatggagagaaaggacagaaaggagaaccagcagtggttgagcctgtaagtagtagtgtgaatrcactttaaaggttggtaaaattgcttatgagccacgattatgttaaattattatgtatgttcgtgttttaccaatgataatcttgatgtccagatgtttgcaattcaccacaaataagtaagttaataaggtcttgtctagaaaggagaatttcaataaaacaaaacattatagagctgcagaaattcagaatttgaaagtagctgaaatttgtcttgtctaattctctcattttaaaactaaagaaccagagatctaaaggacttaagtaattttcctgaggtatcaaatgtttgatcaatgagatataataggacttttagctttcctactttccaatccaatgatatttttctctaatctctatgacttcacattatttgaaatatataacatatatttgttacatatccaaattgtgtcatatgatattttttacttccttttcatctacagaagaatctctaattcactccaaattaatcttttaaaatttatatcaatattattactaataatattgctaagaaacagattcttacttggaagcggttttgccattgtttcctgctaataaacaattcagaaaaactaatgtattagaactgaaggtagaacaacacgaaaatcatttcagaaattgtaaggacataaaaatttcaaaaaaaaacagagaaagaaaaatgataaagaataaaaagatagttgtagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatctatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactatttcaaccattgtggaagtcagtgtggcaattcctcagggatctaaaactagaaataccatttgacccagccatcccattactgagtatatacccaaaggactataaatcatgctgctataaagatacatgcacatgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcggtaaactatcacaagaacaaaaaaccaaacactgcgtattctcactcataggtgggaattgaacaatgagatcacatggacacaggaaggggaacatcacactctggggactgttgtggggtggggggaggggggagggatagcattgggagatatacctaatgctagatgacgagttagtggatgcagcacaccaacatggcacatgtatacatatgtaactaacctgcacattgtgcacatgtaccctaaaacttaaagtataataataaaaaaaaggaataaaaagagacaattttaaggaccttgttggccatctactcattactccaaaatcatgcaacatgctcacaaaaagtgttgaaaatatttttttcagaatgaatcagtccttattataaaaagttttaaccccctttttaaatgacattatagcttttcagcagtccaaagatggagtggaatcataaatgttttagaactgagttcttattctgaatagctctttattcctttgcttataaagagcttatatcatatttattcattttccttttgcctggatttttctgtaatttccctgaattaaagtgcttattttccattctttcatttacacagcaaatatttactaagtttctgttttatgccaggtattattctgtgggctacaaacaaacgaaaaacaaaaaataaaaaaccttggtagattgttttgtctgtactcttcctgggagcacttagcatattctcctttgtaatattattcatctaaatattcatttccactccacttaattcacacattctctgagggcacagtctatatcttctataattttgaatttctttccttccctgtgcaaaaacatttgtaattaatttaagtggtatgaatagataattcactatttaatatgcaatgatatagtgttctcttatattcatgtaattaagaggttgggggttatatttccctggtagagatgttctcttttcctgttatagggtatgcttgtcgaaggaccaccaggaccagcaggacctgcagtatgtaaatgttttaagattatttttgtctatttaaagtaatcatatataagatttctattaattactgaatgagaacattttagactaattagaatattgaattatagagaaaaacatttgttcagaggagctggtgcctttgaactgccttctgatttgtctatccaagtaatactctttaaattttgttttaaatatttttgtggcttagatacctctgcatcttctaaactcattttcgtctttctactgaaatatatgaaagtaaagaaaagtcatccttattttcattgcagaggtataattgtatcttaacaaatggaatctcaacttctaggtagactgcagctgccttatctatacctctgtgtggagtaattatcagattccattgtggtatcctgataaggctgatgttactcagtgtgtttattctcaggtgattgcactgataagaycttgtaataaatcctctgtcttttgtggaattaattaaactcttgtcgtctaaaataatatatgatactgatgcatttaaatatgtttacccataaaaggaaacataattgcctctaacctaaatgatttctacatgttcaacttggctatcaaatttttgagatctaattttatgagtgttccatttcttcagttagaactgggaccaaatatgaccttagagactttacattggcatattcttctttcctgtttttccttgaaatgtttgcctccaccctgagagcagctgaactagctacaaattggtttctatatgttgtcttttcacaggaagataaatagggcaactgtttagaactctagtgtatatttataaaatataaacgaactcttcrataggactagagtgaattcatctaaatattaatgagattaggaatctgattaagatatggtgtgtttctctatagggtattatgggtcctccaggtctacaaggccccactggaccccctggtgaccctggcgatagggtaagtgaatggacatgwtatctcattacaaatgcatgtcatacagrcttaaataattaaaatgtattctacaagtataacatgttatcttactgcgtgtgggaggggtaaaggcagcatgaattcagtgctgcacaacattttagttaacattttaaatattattttgaagtgaggaaaacaatgtgcatttatctatggcataattagtaagaaaacttttatttcacccaacatccatattgatatgaactcattacattagggattctggtcttcaaatttgaattccagtcatattttccagatatttccatttatatttatttggatgctgacagaataagttaataaatctaaattctactttgaggatcaaaccctgggttacatgctgaaatatctcatttgtgttaagtctctccaaactcttctcataaaataaccttcccttttttccccacatccttgagtagccaataactttgtactttctttcttttgttctttagaggatcagagatgcaaataacttatacttttcatataattacaatttaaataatgtaaaaactttttaatttaaatttaatgaaggaagatttttaactatttcagaaattctggactgagtaacagctatttaaggtcagaggacataagaagtgtattatgcaaacattatgaaactttttatttaaaataaagttcataaagttagttcttacatgctctgcttacttaatttgatatgtccagtttcttggagacatttatgtgtaatagtcattttagttaatatttttaaatcccaccatattttcataagacctttttatattctgtaatttactcaccttaaactctatatcaggtgagaaattcatctctttacactgtgccttataaatagagacatataaatgatctaaaaatgtaggaaatattttagtaataggaaattataccattcaagctagatttgttaggattttaaaaaattatttctttatagaagccattatttgaacttactttaacagttccttgaaacttgtacagaatctattgaaataatattctaaataaaatataattttgccaatctagaatcaatgttaacactttcctaggagttaactttttatgagaaattcacatttgaaaagtgctgctgcatttttttatatattggttgggcgctttgagttatagcattttgtatctagttatttattaatttttgaatttacttgcttccctgacaagtatgacatggctatgtagaaatgtctccttatattgaaagcttatggacatataccttatatstatgagtcacatacttatcaacagatgtatatattacatatttaatattttctatattcatatccatatcttggatttctggacagcatagtcacacctaaacttctaaatgtacatgtatgtatgcatgcacacatacatacactgagtatatttaatcagtaaacatttaaaataaattagtgattatgattaacattaacatgctaaaattagtcattatctatgttaaaaagtatctctcttgaagatagtatctattgtctattaaaatatagtatgtagttaagtattctacaaaataaatactatttatgtatctgttaaagaatactaaaatataccttaaacctagtaatttttaaataaaactttcattatttacttaaatctgtttttatctaactgtaagaaccaggcttgtactacttgtttttctcacattactttcccttaaaatatatgtgaactcttcatcttacacagttttaggctgtgaacaaagtttgagcaaaatttatagcttaattggattatatattaataaccgaacattattaaaatcatctaaaactagtgcaacagaatagaattctgtctaggtatacttactaaaaacagactaaataaggtggaaagggcaaatgcaaattagataaagtagacttacgttataagttattctagttctagtaaatattattttgatatttatttattttggttatttcatttatttttctagggccccccaggacgtcctggcttaccaggggctgatggtctacctggtcctcctggtactatgttgatgttaccggtatgttcttttttatgttatagagatgacttgatatcttgtcatcttttttctgaagtttattgttgaaccatattgaagagcaatcaactaaaaaccattgtacaaggtagaaatacttgaaattaagcagcatttggaaattcagggaaattttacaaaacaaaattatggtatcaatctctgcattaaaactaagaattcattatttgattacactcttagcaacagagtttttgacaatatttccaattgtggtttatcctgagtcacagtattaacatgtttttcatatgttatttaacataacattaatatactatttaccatctattatctatatagtcataaatagtatttatttgtagtgttattattcattgctcaaaaattatttgctttactgtaagattcctttgtaaagtttttgttgccctggtgttttgggaaaaaaatgcatattttatttatcaatttmaatgtaatgaacaaagtttcaagaaataattacttagaatgaaaaattgactcctactgcattttgagttaaaatggagcaaattttatagaggaatattacagaagatctgttttataacataagtacttaagaatgggtgaacaaaataaataaatcacaaggaaaatttcctgtgtattaatggatattccaaaaattttgacaaacaaaatagagattgagctgtaactgtcactgaacttggtatatttggaattttatacaaatgaatcaataaaatgggtaacatttgtgcttaaaaaaaagtcacaatggtttattccagaggtatagaaattatagcatttaaaattgaaacagagtttctagtttcttcttctacaaatggtaacctgtagtgtaaagaacttccagaagaaatggaaagagcaaaaacaatacaaactagatctcatgattcattacggagttactttgtaattttgtaaaatcccaccattttaataagtggtttttatctaatgatcaaagcacgtaattcaacatgtttgacaaagctaattttgaatttcttaatgttatctcttccaagttccgttatggtggtgatggttccaaaggaccaaccatctctgctcaggaagctcaggctcaagctattcttcagcaggctcgggtaagacaggataaacttgcattcccacaagatgactgactctgtatcaagtatatatgtgtgtacatacggaagatgctaccattattaatagaatatttacttccgaatactgtgttaaacttacttggaaaactgctaaaattttatttgtttttctagtagtaatgtttattaattgaaaattatagttaggtagttgaccaatgcaatgttgccattatataattctagcagtttcccaccataacacgcaagatttctatttttttttcccaagagtattgatatatttacacctagtgcaccttatctttcacatccagttttactctgctaacttataagtcaatgattggttataattaagagaataaaatttgaaatacatttgttcttaattttctggattatttaacatatcatggataacacagaaaattaaattttttgggcatcatatataaaaaagaaaccttcaaatttcttaccaaccctaatctttataatctgtagtatttttaaaatttcaatttatgttttttagtttaaagcttccactacttgtagacttataaaatatagaattacatttatgttttttaattagtttcattgaaattagwatatacacaagaaaatcaaaaggatagaccaggaaggaaatggaattcatataacatttttattcatagtattggttttctttttaaggaagaaggaaataaaggatttttgtttggtatggatatggttacccactttctaaccaatataaatcacttctgtgataaaatttttatgcatcatgatgaatttatgcagcwtgtgtaaaaatatctgaaaacatgagtaaaaattgtaattcatcctcaatatttgtttatgtctttcctaagtctattaatctgaaaatatatcattatttgattgtatcatgtttaaagataatgaaaaattaaaatatttgtttattagattttggcataatgcaaatctaaaattatttaaaataatttactaaagatttctataacttattttataaaatatattcttttgaacgattttaaggtaattatttgaacttaaatattttatgaggtcattgaattcctcattttattagtcctcttaacctacttgaaaaataggtagcaagcattataattcaatttttcagatatttaatctcaaggattaagaagtatattgtcaaaaatctcatggtgagtcagtagtgattttggagatcctactgttttcatctcgtgcacttttctaatatgattttgcatttatttctgttgtattatttttgatatctttgtgataaatctaagtgttcatctgttgagctctctaatattcaaaagtagcacacaatactaatttaacatctatcaaatttttatcttttgtactgtatgtgtttcagcttttcaagtatgctaatttcacatttctaatattcagtgtaacaatagtgcatgtaatcagtttattatgcgtatgattatacaaaataaaacattcttctctatagcattatatctgagatttgttaaaaggcacatattatcataacacttcctgaccagttttgttttatggtgtctggctttggttatcataatttttcctaaaatattgctaaaagaattttatttaaagcctctcaaattgtgcctacacatttaagagaaaaaggctatgcattattcttgagtaaattcagaatagtaaattatcagatattagttgttctaaaatctagtttaacttttatttttgattaagtcatagcaatatatattacaagattttatatgttaaaaagtttttaaaatgtctgatatttacctcttttgtcattctagaaatttgcagttcttcagtaacctgacactctttctagcatgtagttattaaatctgtgttgatcatgtattacttaagggcagcttgtgcagattcatattgtactttaatgtgctcttccaggagaatattactgaatttgatatattttgttttctagattgctctgagaggcccacctggcccaatgggtctaactggaagaccaggtcctgtggtaggttaccccaacaaagataatatatgttaaaattttcaaattagcagtwccctgtgcaacttcttccagggattgtgcatatctatggttggtgacaatagggtatgttttcatgcttgctgttgtttccattaaaaaaatccttctcaattcagttttctgtacattttgatcaaaaggtctcagtaaaaaattttaaattgaataaataaaattaaaaatgtaattgagtcatatccaactattaatttcttaaactataagtatcattcatttgcctaatattcagcttccaaaattatgttttacattaaatccttgagccttaattttatattaaacaaaatgtttgttaaaaaagaaaaatttatttgaggccaatgaaaattatgacacaatcttagggcaagcaagatactttttaaaccgcaggttgcctcagtattccacaaggtgcttcaactattagagagagtattttctcttgtagaaattctwggaaataacaaagtattatttttttctcactagcgtgatagcaagctaagatatttcaaatatttttgtctaaaaaatcttcaaatacactagaatatactaatgttaagtggtgtagcagttcacaggattcaaaccaggattctcattaattttagaatagatggataaataatttatattttaaatatttgttttttgtataaattttttctgctatttacagaacgtattattctgamagttaaaatcttatctgtattgtacatagtagacacttgcagcaaaactattgtattcmaatttaaatcaagtactttgccttctaattatttagtctgttttactgattatattaggataatagtttttcttcatgtattttatcgaagattttattatgtagatttccttatatttatatttaccataatttagtcataaaattttatatatattttgcaggaatatacattcaatcatataagctcacggggaacacatattctgatactatgtttcatagaatttaaattatataatttaacacattattaaatgtttatcatgtattttatcatgctttgcctttccaaaatacagtaatatggcagattctatatcacttaaccaatgaaatagagttaatttttaattatttgttaatgactcaaatttacataacaggaaagtaagtagtatgttagtgtattatgaaatttggggtcagaagaattaacctaggtattttattaaaaataaaactttctgggactctgaacttaagactgtaatgttgtagattcaggattggaaccagcgactgtaattttaatacgtgcaccaggttgattcctatggccaaagatatttgagaaacagtgccatatttgatttaatttacaaatatcaggctgggcgcggtggctcgcacctgtaatcccagcactttgggaggccaaggcgggcggatcacctaaggttgggagttcgagaccagcctgaccaacatggagaaaccccgtttcwactaaaaatagaaaattcgccgggtgtggtggcacatgcctgtaatcccagctactcgggaggctgaggcaggagaatggcttgaacccgggatgtggaggttgctgtgagctgagattgtgccactgcactccagccttggcgacagagctagactccgtctcaaaaaaaaaaaaaaatttacaaatatcagtcctaggatatctaaaactctattattcaaataaatttcatttattatcttgaaaaacacaaggaaatggattcatagaggctaacggcagcaatgagcagaaacaagggaggcacattatattagcagttcttattttcattaaacaaccattaagagccagccaattttccagagactgttggcaaagagaaaatattgacacccataaacacattctcaaagtcataggcaaaattaattaattttatctacttatcactttgatatgaaagttttagcttccttaattattgaaggtaggtattgagagaaaaaaatcatattgtttctttttaccatttcaaaacatgcaaatttgatgtttgcatcaaaacattaaattattagtcttccaaatatctcttaattctatagtctaaaaaagtattcactagattaagatttagaaaagaaagtctacatcgatattttgacatctgtacatttttcctatgaaaattattttaaccaattgtttacatctagttatctttatagacaaatggaggactgtatcataaaacattcaggaagtgtagaaaatctgttttttccctattattttatagtcaatgactgtgtgacattttttagaataaatgttggagcaaaagaattataatctgttgagtaggtagtgcttatatacagagaatgtaatacagtcgattaattaaaaatagtccattctataattgcataattgcattcaattcagtgattaataatctgatttaatgtagaaccccagtttttttcttgcagaagtttatttgcaataattcttcattggaagcttgaaagtcattattctcttaattttaaagattagaaaattcatgttacttgactttttgtattttgtgggcatcgttaatatttcttttactttggagtcaccaggagactataaattgctaccatttttcagatttagcataatttaaatctctgtcatactttatacgatgtagtatttaatggaatgtgtatggatttaaataaattagaatcttttagaacacacagtatttcagcatgaagtaactataatcaccatgtttatttttaatgttctgaaggtttttggggatatgtgttgcctagtgtttaattttaaacctcacaacttgtttataaagcaattttatgttttgtttatttattttagtacacatgccaggttgttgttacaccttttacattttagttatttttatttatttattttttgagatggagttttgctcttggcacctaggctggaatgcagtggtgctatcttggctctctgcaagctctgcctgtccgtttcaagcaattcttctgtctcagcctcctgagtagctgggattacaggcacccgatgccatgcccagccaatttttgtatttttagtagagacggagtttcactatattggccagtctggtctcgaactcctgacctcaggtgatctacctgccttggcctcccaaagtgctgggattacaggcgtgagccaccatgcctggtcaccttcttaattatgtaaatgtatttaagagatgtttgttatacagacttattctcatgggaaaaaacaaaccaacctgggaaaaatgtgttaacactatttcacggcaattataatagtatcaataacaccaggttcttgccattttattatcatacaattcagagtctaaaaaaatctgaatataaaagcagtaacattttgtcaagtccttacagtataaatggattacatgtatatctgatttggtaataatgggttactctactactacatcacagtgtagtcataaataatgctttgtgtgtcatcatatgagttctgatagtgcacacacaaaagacaatttcaatgtgatttcatgaggttagcttctgtgtagtgctacataaaatatagacctttattgctcacaaattggaatgtaatcaacattgagaagagatatatttcaatgcaagtgctggaaaattttactgtgttaattaataagttaatgctaatatgattaaatatattttgaataatgtttaattatttcaggtgcaattggcaggataaaagtagttaggaaattgctaaattaagtgaaatatcttcactttttctctatagggggggcctggttcatctggggccaaaggtgagagtggtgatccaggtcctcaggtaaaaaataaaaatttgactttttattcttgactggcttctttgatacagcataattccttcgagaatgcatcaatagttaattttttttttgttcctgagtagtattccattgatgtatgagggtttattttgaaattaaaaaattcagagaaaactgattacgatatttgggtgattcaagatatagtagccttcttttttatgttgggttaactttgccattaaaaggatggaaaatgcagcttaactgggaatcgtgtaaaaatactgatattagactatatgaaaatgtagagagtttattttttcccaaagtttgtgaactttttgctcaacactttctttttataaaatagatgaagctgaaaacatattgcagtaattgttttggattttagttttccttgactcctttaatccaaaaagagaaatgtgttatcaaaggaaggattattttcatttaaaaactaaaaaaaaatttgtactgttattgttggcccatgccttcagactggagttcasagtacagtcttctcattacaaagctacatactctttaacctgtagacaatcttttttttttttttttttttgagacagagtctcactctgctctgttgcccaggctggagtgtgcagtggcataatcttggctcactgcaacctctgcctcctgggttcaaaggatcctcctactttagcctcccaagtagctgggactacaggsatgygccaccatgcccggcaaatttttttgcattttttctagagttggggtttcaccatgttgcccagtctggtctcaaactcctgagctcaagcaatctgccctcctgggcctccgaaagtgctaggattataggaatgattcaccgcgctgggtctttagacagtcttaattttatatttctagaatgaacatttcacagtgattataaaaattatttatattttcaaatttgggtttcatttttttctaccatgtttattatatgcatattgtttcaattaactttaaatagtatatgtagttagttaaatatgaaggcctatgtaatatttatagtgaaactacatttgacctattattagctgtacacttttattttaaaayatgtatatcgatccccacgaaaagtatatattgacacattatggtgtactgctactgaagaaaaagataatgagaattttaaacctttaatctgacatagtatggtgccagtcaataatttgcttcagggattggcaaattgtcctccaaaattttgtagctaattaaaagagatgtgtaccaggcactgtgctaaattttaggagtatagtggggaaaaataggttaaagactttagcagttcacaatctaaatgggagattcaaacatgagaaaagaccattacaatccaacattataagcgcaatgaaaggagaaatatctagtaaagaacatccaacaaatgagagaaagtgaaagaaaggggattggaaagagaagagaaatggaatggatagttaagagtgtgttccatcaagggaaatgtaaaaccccaaggtttggggaataaaatgtgtaattatttcttttatttaaatgtaacctcatgtctacatatataattaataagtgataagggccgggcgcggtggctcacgcctgtaatcccagcattttgggaggccgagatgggtggatcacaaggtcaggagaccgagaccatgctggtgaaaccccatctctactaaaaatacaaaaaattagccgggcatagtggcgggcgcctgtagtcccagctacttgggaggctgaggcaggagaatggtgtgaacctgggaggcagagcttgcagtgagccgagatcgcgcckctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttacatggaaataattttcttgtgtttgaatgattaaggtaacgctaagaggatattagtttctgaaaccatctctcttgatgctattgagtttattgatcaagaattctataatatggtttaattatgatgtcttgatatagggccctcgaggcgtccagggtccccctggtccaacgggaaaacctggaaaaagggtatggcttattttcattgtgcattttgaaggcatctgccatgatcattagttttatttatttatttatttatttatttatttattttacttccttgctagtaataaaagtcacttcgcttaatcatgctgttggcattattagggtcgtccaggtgcagatggaggaagaggaatgccaggagaacctggggcaaaggtcaggagctcacatatttttatattcacatcctgtgtcagttcactctggaaaattttatatttaaaaatccattttctgaatctgagagaatatttcgcatttaaattgcagtacatatctagactggaattgtgtgatgatgatgatgatgatgatgatgatggttttacagggagatcgagggtttgatggacttccgggtctgccaggtgacaaaggtcacagggtaagatacatctattcctttttttccagggaatgttataaaatattttagaattgataacaatttgcaaaatcagaaaaagaagaaaaattaattttaacgtttgtgaatccacttaataatctaatagatactagaaggaaaataggtaaaattacacatgtggtatcagtgtaagttctttgaatatttttagacattataatattccttttatgcaaacataaattgaatcagaatctttatatacatttacctggaaaatatcacataaacagaagagcaatgtggacatttaattttacctctaattttttaataattccttcaaccttttcattgctttttgcctgtggacatatactcaaaagaagacatctgtaggtggtttgtcattaatacagtaatatactaggcactatattattttttggtgatggtaaaaactttcagtacaaggcaagaacttgtaatttgtgaaggctaaagaaaccatgattctgaacagtattccagtagataattttagtaggaaactatgcagacaatctctcagaaaaagatcagctttagatcttcacatctttctttaacagcattaataatgagaataagataagctttaagtaaattggagaagaaaaaaatagtaawaggaaagaaaaccctatgaatgtctgacagaacatatagtatgtgtctaacatgttaagatcaagacataattgtatccatttaaaaaataccagatttctttagtcacctgagttatgctgatttaatataaattacttagaagtagaaaatatttaagtcaaaatcaccaaaatatatccatatttaatayaatcatcagcaaaataagtttctgaacaatttagcttaaaataattaaatgtctgaaaacgatttaagatacttattttacataactcttttgtattgaaaattgagagaaaatattataattataaaatattattagcatactaacatgtaaagccagttaaagttgttaaattatgatttatctgcaaaattttttgaggagggtaaataaagcatatattttccctgccaaatgtcctgttttatttggtttggatagctacctgatagacttgtaaacattctacttctttccatatgctaatcttatttgtattgatttaacagggtgaacgaggtcctcaaggtcctccrggtcctcctggtgatgatggaatgagggtatgttaatacttcttttcttaagaaatatttaaaattaaaacataataaaacaaaatcatgttgaaatgatacattgtccaaatgttctatactctcattcattttgtcaatgacagggagaagatggagaaattggaccaagaggtcttccaggtgaagctgtaagcaactyactttttatttttaagtaatatttctagtttttaggactagtgactggtgttacacatataaaaacaatgataaacccaggtaaacattgcagtcttagctaagctaaccagataattgccatgcgaaaaaaattaaaaaggatatatagagctccttttgttacagagaaaatcttagacaattgagggaaaaatctgtggaatgtaacatttccagccaaaaaagttaccttacctagtttttgttgctgtttctttgttttgttttttgtgctgtcatcaatagctccgaaatttatgtactgagaagaaatgaatcctattaccagaagaaaaaaaataatatgtcacttggaatataccagacatatggawtatatcacttttctccaccaaatattacaaatgaggaaactgatctgggaaggtttacttgaagctagctaacaaaataactaaactggaaataggcctcctaattttggttttaaattgctgcattctaccttgcgccacattttagatccttgtcaagtaagttcaagcaaatgggagagaaattagattattttattggcttttctaaagaaggaaaagaaggtgagcaggtgcaggagggggaaaaagaagagaaggagaaatcaagtgtgaataataataatttaagaaacctcgaaaaatggtttctgtaatctgcatatatagttacacagatgatcgttttctttcctcagtgaatgctgtcttaagatgaaatttacctaaatgtacaataaatgagaatcaagactcttctatttatgtagtatatctgattgaataataaygttcgatgctgtcaytgaaatcaaaaaatgacacaaaagtgtcttatagaaaatattaaactgtttcctattttaaaaattccccaagtgattcatatgtaatattatagaatcaaagaaacacagtttctgtactaaaaactgttatttattctggcttttggatcagtataaacactagatatttatgttatggacatcactttcagtgtgttaataaaagatgtccaaatatttttattctaaaaataaccttaggatttcttcattgaaagaggcatgttattaggacattttttttttttaataaaggcgtgctttttctttttctcctagggcccacgaggtttgctgggtccaaggggaactccaggagctccagggcagcctgtawgtattgctggaaacattgaagattttctagggaaagcttgttgccaaccttttagaggccataaaagccctcagtagagagccaagagtttattgccttgttatgtttgaagatctattgttgctgcctttcactttaactcatcattccctcctttccttctatcttccttttgattatctatcttagtgttttcatgatacatccccagcatgcagaggaaaatgttgctagattgtctccaatgtggacatggaaaagaaagtataggtcttgtctcttcttcgtttccattaaatcctaaaatgatttttagttgcttagggtagtgaatatcatgatattagattagtctttttgattttctgttttagcatcaaaacatataaacaaccataaatactttttcttcattgcagggtatggcaggtgtagatggccccccaggaccaaaagggaacatggtatgtarcaaatagtgataaaataactcatatttgaatataagccctaagaaaccattttttgttgttaaatctaaaatataatgatttattacattttgctaagtatattagatacagcttgcattaatattttgaaatattttccagaatctcatgagggaaaactgtttgagggtggrtagaggtattttccaattgagaagaacaaaaatctattgtgtaatatagcccattaaaaactttttatattttcctctggcagggtccccaaggggagcctgggcctccaggtcaacaagggaatccaggacctcaggtaagtctaagccactgmagctcctttgaaataatggggggaagatgctatctttctataagaaaatmgacagtctcacaattttctatgtagtcctagcaatatttaaaatgtgaatgtaggaaaatacatacttttcttttttyaaaaaaatttgagcaaacttgcagaagcccctctcttcccagggaaaaatgactcattcaatgtttagggaatgccaggactaatagccacctgcaggagggttctgaataggatcgcattatagtccctttgcaaaaaagagcagcttgtgtaaaactcctcatcgtgttctaaaattccttggggtgtatgggaatatatacagattcttataactcactrtgtactatagtgagctaayaatttgctgttttaaaagcatattaytgtgatttgatatctgatatatgaaataaattcttttaaaatagggtcttcctggtccacaaggtccaattggtcctcctggtgaaaaagtaagttactctgttgttctcgtaaagcctggtgaacatgtttgttttagcaatcttaggcaggtataaggtctgccttctgtttttgttaagatatctagatagctcagcacataaggaattaatctggagtcgacatggaaatatagtgtggggagatttcattcatgtgttcttaaactgagaatgataaaacttcagttaccatttaaacagcttccaaatgtggcattctcagctatgttaatttcaggaacataacggtatgagtgaatattttctctttattttaggtctccttttctttctcattattttacaaaaaagtaattaagtttgcttgtgacaaaagatttgtaggaagacatgatgaaaggaaagttgtgaagttgtcattgccattatatctcatatatgaatagcaaatgatgttcttgttaataactcaatgtctggatcaaaacaagaataaatctataattaaacacatgtctttttccctgatctccactgtgagattccttgagtaatattttgtcccctgtagtcatagcacatttctakctggctctttccaacaccttttttctttcattatttttgttgatttctacaaacatattaattaaaaaaaactaatagctttatcgaagtgtaatttaaatactataaatattcccttgttttaagtgtacaagtgaattatttttactaaatttacagatgtgctgcaatctaagtttcggaatacttataccactccagaaataatcctcgtgttaatattcagtccatgtttccaccccctcagacctagctaacaattaatttgctttctgtctctgtagatttgagttttctgaatatttcatgtgaatgaaacttatgaataaatttatgatttaatcatatgaatgtgtatgtgacctttatgtctgacttctttcattttaggttcatccatgctgtagcatacatatattagtactttgctccttattttgttctcatagtattccattgattgggtataccaggttctgtttacttttacttggcagttgatagaataggtgtagtttatactttttcgctattctccataccggtgctgtagtgaataattgcatacaagtctttgtatagatgtgttttcattctttttggtatatacttagaagcagaattcttgtgttatggtaaacttatattcaatattttgtgaattccactcttttccatatcgattgtaccattttcccttccaagtaaccatgtatgaggatagtcatttctgcacattctcactaatgcttgttattgtctgtcttcttgattacgatcattctcgttggtgtgaaatgttatctcattgtggttgtaatttgcattttcctaatcactacttttgttgaacatcttttcacrtgcttattggccatttctataacttctttgataaaatagctgttaaactcttttggttaatattctaattggattatttatcttaatattgagttgtaagagcagacatatcagatttaagtggttttgaaagtacttttttctgtggatgttttagacatagctgcacagcactattggaaaatgtcctattagttatgttaggttctaaaggttatttttaatatttagatcagggagtttaatctgggtcactcatattttagattagtgcattaaaaatatactatatttattttgtattgcacttgacacatgcacctattaaattttctaccatgattttatcatgtatgtactagattattaagaggaatttgctcttaggaaaagttgttatatctgaattacctgtgccaagccagataaaatgtataatctagtttactgcatttcyggtggtaagaagagagctgttttatgtaatactgcttctgcctctgatctgaatatatccagcctgtaggttcaaaatcaatctcttaccatcaaaaggagaaaggtactcaaaaatatgaggaaaacactttttaatgataatgtatttacaatataaatgttgtmttacatctatattaaaaaagtagaagctattacttttgtttttaatgataactatgatttatttattctggctcaagagccttcgcttcgaaaatttggtaaatagtaatgtttaattgtatcatggtataatttaacattttaatacaatttaactaatgtcwtatgtttttacaatccaagagcaattttttgtactaacttatcatagcctgtgcttttatttttggtaaaaatakttcataaaatttaagttaattaactaaaatagataatatattatatttttctgacatttttgataaatataccaaatacatcctatgataaattgtgatawctcctaaatatttcctgtgatttaatttctgagttcactcatataytaattgcttagtagcaattgatgttacataactctctgagtccagtataaaataacaagacacaaaataaatattagttaaagggaggaactttgaagacgtggataggaacctaagttcatccagattgcaacgctgccacatttggttaaaaaatcttcacttttcaatttaaaggttacttttaattcatttttgttctatgctgatttggttgaaattttcttgtaaaactgcaatggcaggcaatatgaatacaatgattgtactttactccctgagaatggaaaaagcccaaaaatatgtccagcatttaggcttgctgatatgtccttgaccttctcattgattctgaatcctggacaataacttgatgtgtcaataacgatgacctgggctctgggaacttgataaatttaatattcttagaagaatgtctacttttctcccaagaaaaggtctgattcttgtagtagtgattcttaccatgttccaaatttagaaatggtcatgttcaatgtgatttgaaactctgtgtggttaaacagggattaatctgttgaattattactttattattatcttattgggtacctattaggatatgttctttttacattaaaatcgatttactttccttcatttcctatgaataactatcataccataacattgcacaaaatattttaataatggtgtttcatcaatgttactatgtaattttttgaattagtacttactaatattattgagggaaataatacaatctttacctctttaatgatatgaatcaatatatttctggcctatattgctttcctttttgttctctragcttcagtttattgtggtattcaaaaactaatttgctaatttaaaaaaagacctatctaagattataagcaggctaaaacctagcatacctttgacatgttaaatttagttttaatttatctttacatggcatttcctccaaataatwtatttaaaagttatttaaatggttattacttatgaattgaagccagtgactcaggataagaatttcattcatagtatatgtacamgttaaagctttttaaaattatttttatctttttaatattttttttttctctataagggaccacaaggaaaaccaggacttgctggacttcctggtgctgatgggcctcctgtaagtaacagctacctggtcattaaaatttctttacattatctttaaaaatagattttacatgtgttttagaaatgattatatgaggttagtaataaaaataaattgagccagtaattaaacattgatctctctaaaatacctttcatcatatcacttccatattgcaaaatctttaatgarctcacggtggcttttgtggaaactcatttggcactccaagccagaacctccccagaatctcatattttttttcatttcctccttaaccattagctccaggtaagcaggtccactcacatattcttgcatgatctaaattttctatcaccttacctttcccaagctgtttcctctcctagaaagcccttccatcttctcctccttttcaaagtatctgtttctatgagtccaggtgaagttcctcaccattcataaattttctcagacatctttcatgaaaatatctcagccttcacagatttctttcttttctagaaatatagtaatatttattatttccctttaaatagtaataaacaatgaaattatgtaatctctacagttattatattaaaacatttgttatttacagatttttttcctctttaaactacatatgcagattttgtagtactaggatataagatttctcatcctacctttccttgttattgggtataattgtgatatggctatacatttttatttactgaatctcaataagttgattattaacactgttagcatttatgatctcgctgtattttcagatgtctcatccacatgtcttagtgcccctttgaaggtgcatgtatgatcatttgattaatttgctaaatataaggcagatttaaatacctttatgtaaggctttaattgaggctggggttgaattgttaatgaatgatatgtattattttrtgtgctttttctaagctctctcaaatgcattatgtatttgaagaaacttacatccatcaaatataagcttgtcatgtttacttccaaatgccatagtttccaatttatttaaagccatacacactgatgcaaaagtgttcaatgtttttgaaacttaaagagtaagatcttagtagatttaataacaaaagaaatactttcgtagtattatcaactatgtttatattacatcttatcagtgtatgtttttgctaaatatagggtcatcctgggaaagaaggccagtctggagaaaagggggctctggtaggttccaaagtatccatttaaatgtcctattaataaatttccaagagaaaatgccttaatttggtcatctcatatatataaatcaygttcatatagttattttgggtataaaaaagatatcttagactacttttaattttatatcagtaattttagaaaytagactatgttctctctttttaaaaaatattcccatggctaggaatacgtgcatatttttcatgtgtattatatatggagtaaatggtaataatataaacaatgaaattgggcaagaattactcaatattactgaactgcttatgtaaccccaattttattattacttattactttctggtaaccattatctaattaaatgttaaattaagaccaatggctattaaaatatcaaagtgaaatgtaatatgtgcatattcaatgttagtactttagattacagtagcaggggtaggatcattttgtttacagttgtttttaattattttaaaacagcattaaaatttcagcattactgaggaaattataaattatgattgatagaacattttatctagatagactagagaaaaaaccagcttttggaagatatataattttgattatattcttgatgaagtgaatgctactaatttataattttctatttgaaattatcaatcttgttagtttttcaataactgtcttttatagacattagtatagcatattttaggttaaaaatctagttattaatttttgaattgtttacattattttacatgcttgtaagatttgccttattagtccatttcaatattgtatttttagtatgaatatatgacataataaatttggagtgagtagtgctagttacatgtttttctcatcatatctgtttctagaaataaagagtaaactaccaaaaagtctttatcaaatattagcagtagaaaaaaaccatatccttgtagattagttggtaaaattatagtatgtaaatgagtagcactttcaatttattacacgtataagtggtaattcatctatttcagggtccccctggtccacaaggtcctattggatacccgggcccccggggagtaaaggtaacgttaaattgttttcacattatttactttcaawgtgaaatgttatattcacttaatacttctaatttattccacagggagcagatggtgtcagaggtctcaagggatctaaaggtgaaaaggtaaaatttaattgtttagatggtattaatttctgtgtattatgttaayatttaaatttattcaacagacattttatttcttgaatatatgagtgattactacatactacgcaatgctagtataattttgtattctttatcctcacaacttaaaaacaatgtcttatatcttgtgataagggttaaataccagaacagaaactaaattatgttacctaagagaattaattctgcatcctttttctttttttttttttacatgtgcttaagttttgttaatcatagggttggccttacgaatggatttgctgcaggatttagatgttatctagttagatgcataacatatgaatatttattccttttttccctactgaaatccccaaaatgtttaaacaaattcagcacaaaacaggaaagttagaagtacactaaattaattggggaaagaggaagtctttctatatagtattacacacaaatcaatagtgttaatgagagagataaaaattacaaccagacagaagtgaatgaaaaaatgtacctaaaactatgaatgcatatggcatcttttatagggcatttataggtaattggcttttgctgaagaacatgacattcagatttttttcaaggatacatttagcaggcctgcaaagccccaaatccttcaaagattatgatgaaatgcaaagggaatgacattactcagtgatagagtttagctgtatgcccacccaaatctcatcttgaattctaatccaaattgtaattcccacctgtccagggaggcacatggtgggaggtgatgagatcatgggggcggtttccctcatgatgttctcctgatagtgagtgtgttcttaacaagatctggttgtttgataagtgcctggtacttcccctttctctctttctttttctcctccaccttgtaaagaaggtacttgtttctcctttgccttctaccatgattgtaagtttcttgaggattccccagccatgcagaactgtgagtcaattaaacctctttcccttataaattacgcagtctcaggtagtatctttatagcaatgtaaaagcggactaatacactcagaatcagtattgaattaattcttactacaaaatttcatacaaagttaaaacaacacatagttgcatagcataaatattggtaggtttggtaagatatacatggatattaactattgttaatatcatactcataagaacatactctattagactgtccttgcactgctataagaaatacctgagactgggtaatttataaaaaagaggtttaattggcttatggttgtgcaggctgtacaggaagcatagtggcatctgcttcttggaaggcctcagggagcttccagtggaaggcaaagagggcacgggcatcctatgtgctgggagcaggagcaggagggggtgaagaaggtgccacatgcttttaaacaatcaaatctcctgagaaggcactcactatcaggaggacagcatcaaggagatggtgctaaaccattcatgagaaatccacccccgtgatcctatcaccccccaccaggtcccactttcaacattggggattacgtttcaacatgagatttgggtgggtaaatatccaaattatatcacatgctaatattttttcaaggacagtcatttattttcatggttacaatattatcaaaaggcttatgtgtggatttgataccaatagggaatggataacaaaaagggatggatttattatatccattatactttatctggaaaaagctactgttatatactaaaagtaaacaactatgttgtcagatttattacatgaaaaaggccatgcatttcgcattagctcacctacttaacagtaatctcagttcatcctgatcacctagatgaacttcagagtaccagttggctctccctatgggttctgcatccatggattcaataaaccatagatcaaagatactagaaaaacaaaaaattaaattaaaaaattataatatgactgggcacagtggcacatgcctataatcccaacactttgggtggctaaggcagtagaattgtttgagcccagtagttcaagaccagcctgggcaaagtagtgagacgtcatctctacaaaatacttttaaaattagccaggtactgtgatgcgcacctgtggtcccagctacttgggaggctaaggagggagagttgcttgagctcaggaggtcaaggctgcaataagccatgactaagctactgtactccagccagggtgacagactgagaccctgtcaaaaaaagttatagtacaacaatatacaataatacaaataaaaaaataacaactatttatatagcatttagattttcttaggtattatcagtattctagaggtgatttaaagtataaaggagaaggatgtgggtaggctataaataaatactatagccttttatatcaagaactggagcatccacagattttgatatagkaagttgggttggggtcctggaaccaatcacccctagataccaagagaagactgtatagtgtctcactgaattgacaaaggagcacagtggtgagtcaggtagggtttaacatgtaatttgtaggttgcctatacgaaaaataatgtctctgtttagaatttttcttgttaagaaatgtaagtaaaaatgcaaatgtttttctctggaattagtatccatcaaggatttttagaggggctaggcagtgtttaaaagaaaattgcctgactggggtggggatgttgttractgctgaaacttgctaggagagttgtaaagtgacagaggcaaataaaattataaatgactagatatatatgaggacaaagccatacaggaaaaaaaaataagatacattttttgtacataggaaagcttattaacaattgctcattgtttttagggtgtatggtctcagaagatgcaagtatgtatagaggaaaataagtaaaattttaaattgggaaccaaaagttctgkgttattattctagtttttctagttactttttctgagcctcatttgaagtctgtaaaataaagaaaattccctaaaaaaatttaaaggtatttttcagctatagcttttattctatctaatataccaatcaagtagtaaattatgttttattatagattacaatttagttttctaaattatagatttagagaaactttgtataaatatttgtagaatttttaatggtaagaattctccatattttcaaactctgtgaaggattaagccctgatgactttttaatatgccttatttatttcatttttctgagtatgcaagataattgatcatttatctcttacgagatagaagaaaatggaaaatattttatatataatgatgttaattgttaaccaaaggtgatatagcaagttagtactctaattatgactaaaattmtctcttttttagccttagatttgtcgcttaagtctggagcaacacagctcaataaattaggtggcatagatgaattccacttttatacatcttctaaaactatgttttcttctttttttctttatctgataattttaatactagaaatcttaataacttgatacgtcacttgctaaaaaatgacatttgttataaggaaatacctaattaaatcatctaattgttttttaaacgtgaatatgctgaaaactaaaacatgagaaaaatagcctccctgtagactgaattctcactttaaaaataatttaaaaataaaattctgtctatagtcagagtctataagtgatttttagacatagagtgcagtgttctttaaactaagcatggcagctgtgtaattatgtttttctctagggaggaggtaatgaagacgttgtcaatagcaagttcagtggtcatttacagctcttaagcctctgccattgcccaatcacrttcagtacagagagcatcctgggcaggatggtgaaaatggcatgactttctcttgaaaaaaaaaaaaaaaattcctggcatgctagagttctttgagtatgcaagataacagtttgaatctctttccagggttaggtctcatattcacaagtacccagtatttggtattttctggactttaatataccttgctaaactcacactgaggcatttagtaaatgtttattgaacaytgtggttactgaaggtccaaaacatgtttgacactggagactcacaggttaattaggcaggattcttgtgttmggccatttagcagaaggaaaacaacctatgatctagaaaatgcaggacggcatattgttgcaataataattattcagtgaaggccacaagatggagaggttaattttaggaggagttcaagacaaaagactgaagaagtgaagaagggctagatcacgtggtgaagggaggtgccttatattgattattagcaatttgatacgattaggatattttaaagtaaaaattgatgtgaccagttttgtattttaaagagatcattttggcagcgagatgtggaagcatttgtgcctatccttcctagctttgttttcatacacagcccaaaatgttcttttctgaaattatcaaatcaaattcatttctaccaactgaaataaaaacccctccatcaaaccctccctattaacctcctgcctcaccacctcctccacaagcaccatacatcatcatcattatcattattttggcattcttctccagacaccctttctacttcatctgtaccaaaataactgcaaatgtcccactttcagttgtttgtttgttttgttttgttttgtttttgagatggagtctccctctgttgccaagcctggagtgcagcggagtgatcttggttcgctgcaacctctacctcctaggttcaagcaattctcctgcctcagcctcccgagtagctgggataataggcacccacaaccatgcctggctaatttttctatttttagtagagacagggtttcaccatgttggccaggctggtstcgaactccttacctcagatgatccacctgcctcagcctcccaaactgctgggattacaggcatgagccactgtgcctggcccacttttagattttactggtaaaacaaaaacctcaaaatactccrcagcactttgaatgagtaattgctcaattaattttattgaacacatgaatgactatttcttagtaatttaatttttttttcttgaacttaagagataataaggttgtttatgcaacttacttaaaaatctaggtttcaataagaatgatagaaaatatttccgtagcccaaatcgttcctctcttcattaaatgacttcattttcagcattgttgctctgtgtgtatagtgctacaattagcaattctacctgtaaaggatattattaattcctattttatataattaattttacctgaaagaagattgtaagatacagaacccattgagctagaaggcatttatctaatggacatgatttaaaaaaaaatacaatataaaatttataggcataaattagtaaattaagggaaaatcattttattcattctgtgtgctactccagagctcttgtaatacaaagttaaaatgataattaagtgtttccttttgttgttgttgttcttgttgttgttgttggggggagaagttcttgctctgtcaccaggcttgagtacagtagcacaatcacggctcactgcagccttgacctcctgggcttaagcaatcctcccacctcagcttttttagtggctgagattacagtcatgcacccacacacctggctaatttttgtattttttgtagagatgggttttgccatgtggcccaggttggcctcaaactcctgggctcgaataatctgcccgcctccgcctaccaaagtgtggggattacaggtgtgaaccaccacacctggctaaatatttactttttatttgtttaaccagtatagaatacatgttgttatgggagaatggttatttccctcataaaataagatttaatgaacatatttgtgaaaaatgtcctagggtaatttatagccaataaatgtgaaaatatgagatgatattggggatcagaatctgtggctggagttggaaaagggaggaggaagtttcacaactaccatgcacatttctcaaaaataattttccctcrttatcagcacataaatttttatagcartattttaggttactccaaaggactgattaaactcctatttaattccttttataatgttttagggtgaagatggttttccaggattcaaaggtgacatgggtctaaaaggtgacagagtaagtatagagaaaatgtacaccagtacacaaaatttaatatatatatatwttttttcctttgcttatctttaaatatagtaagcatatgataaataaaatgtttgtactacctaagtctttactcatttaagtttttatacaaagatttaaggattttaatttttgtggagatagtgtagtatcaattgtcttttagatgttayatttccataggttccataataaacatgagcatgcacgcgtgcacacacacacacacacatgcacacacacgtgttagtatttatacacaggacattagaaagttagatcaaattactagaagtaatttgataagtttgctctaaattttgttcatatataatgagctatgctgcctggaaagtatacgtctgtaactttcatgaattttcattatatggtggtgttcaatttttgaatgtaaaaatagtagttttttctagtaatacattatagaaaacaaacagaaatattagttatctaaagcaaattaaatgctttattgggaagatttatttttaagtaatatactagtacctaatacatctgaataaagaagcattctatagaaaatatttcttttcctaaaattcaaatgaagtctgcatgcaggattgggggcaataacatccatatacaagttcttaaacgttaaagataaaagccacgtacaaaagagagacatttttcttgtgttccaaacagtaatttccaaagctgctgaacaatctttattattatttttccctctctctataacacaggtgcattaaaagcaatttaatgtcatatatgatatgattcagcttttgtagattttcaaatatcagactatattcagttgtttattaaatatgaaaagattgattaagtcaaacactttcaagcctctttttcatgaacaaaaacatgagtaaacacaccaaagttgaaaactctgactttcaacagactgtaatttatgcctttcaatctccaaatatatttttgtaactgcctgatgggtttatcttgcctgctgcccagacagggcctatttatccagacaggggaattgcaaactctttctctatgcatacagttagctgaataggagactrgagttttattattactcaaattagcctccacaaaaatttggaggatagggttttttaaagatagtttggtgagcaggaggctaggaaatgagaactgctgcttggttgaggatgcaatcataggggtatggaaaatggtccttgtgtgctgattcagcttctggctggggaacatgaggccagttaaatcacgaatcatgggtctgagtggagtcagctggttgtcagaaatgcaaaagtctgaaaagacatctcaaaaggctaatcttatgttctacgtagtgatgttatttacaggagtaattggggaagttataaacattgtaactttyggaacaatggctggtaattttttactatgactacattttagtggaattcacacccctctcataattctaaccttgtggctttgtattagtttttataaaggcagatttgtttggggaaagactatcatcatttaaactataaagtacatttctcccaatgttagcttgctccatgcccaggaacgatcaagggcagtttgaaggtaaaaggcaagatggagtttattatatcagatctctttcactgtcataattttttccctgttacaatttttgtaaaggacgtttcactcataagaatgttgttattctgtgcctcagggagaagttggtcaaattggcccaagaggggaagatggccctgaaggacccaaaggtcgagcaggcccaactggagacccaggtccttcaggtcaagcaggagaaaaggttggtaaatgactttaaattcactggtactcytgcagctgatgtttcattatcatttaaatttctttcaataactggtgtcagaaattgagttcttactacattaaagataaaatgtttcattatcattttaaatttgcaaccattacatttacgtttcagtgtaatattaggcaacattaaaatttgcctccagaaagtatttagtgacaccttaaattttctataatgtactgtgaagttaaatttaaaaaaaaaaaagcaagaaatgtctatgacaagtgttatcacattatatacactaaagcaaaatataatatcttatggatagaattaaaatgattccttttctttcatatacatacatatatatatatatatcctacatgtatatgtctatattaaatagggaattctgttaaattcctattaaatactcctaagaggtataattatgagatgaacacttcttttgtcacttctccttattttctagtcttctatgccctcctcggccatgtggaatcagctactcttagagttcttccacattagatgttgagaattaaaggatgtgtgattaaaggatgaaagaatcaatgaaagagggtctacttaaggttttacaccaagtagaatcatcttttattttttccacttaaacatgcatttcacataataagtctattaaaaaatactggtattcaggcccaacttcaagagattttaattttaatctgggcttgacacaatatcaatatgttttaaaacatccccagataattatcatattcattgkttgagagacacggggcattatgtgttgcgtcaaaaagatttgcaaccattacatttatatttcaatataatattaggcaacattgaaatttgacttcatgttataatgtaataacatttgtctatgatgacaagcaagaactgtctatgacaagtgttattacattatatacactaaagcaaaatatcagtaatctcttgctggtataattcaaatgtttccttttctatatgtatatgtctatattttctacaacaaacattccataatttctttattttattttttactatactttaatgcacaacgtgcaggttagttacatatgtatacatgtgccatgttggtgtgctgcacccattaactcttcatttacattaggtatatctcctaatgctatccctcccccctccccccaccccacaacaggccctggtgtgtgacgttccccttcctgtgtccatgtgttctcattgttcaattcccacctgtgagtgagaacatgcggtgcttggttttttgtccttgcgatagtttgctgagaaggatggtttccagcttcatccatgtccctacaaaggacatgaactcatcatttttatggctgcatagtattccatggtgtatatgtgccacattttcttaatccagtctatcattgttgaacatttgggttggttccaagtctttgctattgtgaatagtgccgcaataatgctatttaagaaaattacaaatagaagcccccaccgttctatctcagaaagaaaatatatgatataggtattagatagagagtgtgaatagtcaaaaagaaaattcctcatgtccttatgaatcatctaatgtgacagttcttatcggktttcatactttgcaacttctacagtttcacactttgaaaaaacattgctaattgtaaattaatgagcaatgktatagtgatttggcagcaaaagaaaaagatcaggggaaaacaaggccttatggggcgtttaaaccctttcccttaaaatgctcaaggccagtggttaaaagggtatcctgggaccttcctgtcttcttaggctctatcatgtgtaaacagtcacacaagctattgtgataaatcaggagcttaaactaccccacagttcttttcttctttaacatttcattagtatatgttagtttattgaagttgcctatcatcctgttgaaaatacaaactttctgccagaatttattttaaaatgactctaaaatgaattagagtatatacatacattctaatgtggtaattaccaaagaaaacaaatagcttgtgatcagaattagataattttacttatcctgaaattgatggtgtaaaacaagctgtgataacttaatatatccaagggaacatcattataagtatgcttcttagggtttgtttgatattttccatctgaagactacttatctatgtaatgctgatcatgacttggacaactctttagttcaatctgtactaacaaggtcataaaccatgttcttaattttttgccttatttcatccagtaaaatacttatttttatttataagcttctgttcatcttttatcaatgcacatacaaatttgaacttgtgtttgttttccatttttagttgttcaatgtacattgaaaataatgatacattatgctttctaatgtttaagacattagtaaataatattttataaatgaagtgtgcttttgtaagtatcttattaggtaaatggatgcacagtaaaattccacatacatattttattcaattctttttttatctttttacctgtgtttttttttaattaatgttttgttcagatagaaatcatagggaagtaaattgtttaggataatatttgaaaccatctggtatttgttacacattgttggacttcattataacttaaattttgttttagcactttcagattgaaaggtaaccttattgcactggaacaaaatagtatattcagttccctgcttggaggaataaacactccacaaaaaccatcattattagctaaagctctcaacacatattatatttattagtccagatatttcagcatgttagagtgaaagaagaaatttgtcttaaaatttaattctgaatttctttgcatatctaggtttacttactcattgagaaaagttaagtaactcatgatcccttgttttatrtttagactggggtaaatgaaataactgtatcaaaaagatttactctggttgaagggataaaatctaaatattgtgccagttacatcactaatttaaaatagtatttaatgttgaaaaagcttagaagtatttttaaccatgctttagaattcacaaagaagtgcagagttctctttaaaacctcagggttcatgtacctaaagaaggcactaccacttatataataaaggttaagttaggcaacattataacattagaaatatgttcaaagcaacaattttcttattcacgtgaagaaatataatgaaggtaaataatgacaaaaatctgcaaatmttccttttgagtgtacaatatgtgattctaatatttaaaaaaaattgaaatcattatttaagcttaattcaacttaaaatattactttgattattatatattttaactktagggaaaacttggagttccaggattaccaggatatccaggaagacaaggtccaaaggtaaaacagcttgatatttatagtttattaacatttcgtgaagataatattaatcacttatgattaccttacaatttgtaacatctctatattatsatgagtacttaaaaataatttcacaaggaaaatcatagagtgtgtggacgcctggagtgcagggagctcaaagagcttaggtgattatggattgcagtattttaggagaaggaatcatgaaacgaaggcataatcggtaattctttgtaattggaacaagaaatatcctagtatatctggaagttttaacatggaagacatttgatgcataacggcttttgatttcctttctattatcctaagggtttaaattaccacttgattttttaaaattaatacacctttcacactattaccctcatttccatgagtattttttttccagggttgctatgacaaatctccacaaacgtattaacttaaaacaacagaaattcactgccttacagttctggaggacagaagtatgaaatcatggtgtcatagggccatgctccctccagagtttctagtaaagaatctgtccttgcctctcccagcttctggtggccccaggcattccttggcttgtgacttcatgactccaatctctgttcccttcttaactggccttttttctgtgtgtcttattctcttctgtctcttgtaagaacactcgccattggatttagggaccacctaggcaatccaggtggatcccatttccttaatttaatagcatttggcaagacttttttttcttttccaagtaaggtaacattcacagattccatagatttgtatatggatataaattttcaggagccaccattcaattcgctgcatcactcaaatctcatttttggctatttgaaatatacatrttttaagcataaaaaatatggttttcaaaatgcatatttacctcggtgtactaatttttctcaaacctatcataaaactttgttaaggatgcacttgatgcattcagtagttaagtgaatgcacttgatgcattcagtagttaagcctgttaagtgaattaatatataaatgttgattattaattacagaatggttatgatacaggagggagacagagaagtgcgggatagtttcagttttatcattcttttagttatatgtacatgagattatatcaatctatcagtttattgagtttgacccattcaggcataacagaaacaataggtatggcaaatcctgtttctgtaacattcttaaacgtgtgtctattcataagtttcacatgtaattatgggagacaaaaatatccttctccctgaatatgtaaactgcatgtcattgtgttccctcattgccacgtgataacactgtcttaggcttgctatacagctttgtcttacaattttttcattgagtttccccaaaaatacttccttgagtagcaggggmtaaatataatgcttttgaacccttctaaaataagatttacggcatctgtgatttaaaaataatacaggcataatttaaatattttctggctgtactcaggacactgattaatactttttatcatttaaatattatctctaatatactgctctgtctcccagttagcttcctttcaaatgtcaagcattttcacaaatattatcagtaaaagaagccattcactgcataatccaggacctcaagctatccttacatcacttcatgcattcttgatctatttattaagttaaattgcaattgttttgttttgatttaaaaatataggaatctgtcacaatattacatgaatgagtagaattttattttatgaatttatttaaaatcccgttttttccctaagttctctgatcaataatctttgaattgtttttattaacaaaatgcaacagaataacaacagaaatgtttcctcctagaggtatccaacattttttaatccttttactgaaatgtctggaattttattctttatttcttcatattgcttctcttcataactcatttattatttctatgatcaaaaagctttaaagtttctctgttctaaaatgaaaaactgggacatcaaaaatgaaaaactgggacatccaaaatgaaagatagcttcgtattttttcctatgtgtaagctgatgaattttgaataaatttaaattttttttttactaaaatgaaatgcctttaccagtctctttcaagcagattaaggcctgtaatttgacatcttattaattgcttagtagcaatataaaccataaaggtattaaaaagatgtagcaccacatgtgctataaaatgatagctgtttctaaaataaaatctattttaaggtaggatacctttatatttcagacagcattttaaaaatttcacatttttagtttcacatttattgactgagccaatttcacaattaatctttgactttatggcctttgtgtgtttccatataaaaacgggtaatactgtttcatagaaattatatattttggtgataattccttatatgggaagcaaaaaataacatttccatatattcaactgattaattgggtaggttggtcatttttctgtgttttctatcaatttcctagagtagaaactctacgtaagtatatacatttatgaaaaacaaaattggtgcataatatctctttgcttaaatgaagtatctataaatatgctgttacctcttctagtcaggacagaactgaatatttgtcccccccctcaaaatttttattttcatactgtattataatcatttgtccaattcctgtaatagtcacatagtaatactgtgctagacgtagctaactgattctgtgtagagaaagaaaagagattttgaaagctcttcaaaatgtaatgtgcagagatttttttccccagtacgtgaatattacacatcctaataattgttctcaggttgatcacaagttagctgtataggcatgtattgaaacatacaggaaaacatgttataaaaaacagcttagcagtgcatccttcaggttattattttgactatcagctgccatagggcatcacatacaattttaytgacctgctttaatagcatcatgtaggaaatacaaattgctagcatcttaccttcctgataagtgtgtaatattcactgctttcaaattgggaatagggccaaatagttacctcctgtgagtaggtaatactctacacctggctattccaactgtacatgcctgagaatacwgcttcaagacttctaagatttcacagtacatgtgaccccgagaggttggtaaaaattcagattcctggacctcactgccagagagtctgtttcagtttcagtagatgtggagtgtgccttagcaatccatatttttagcaactactctagattattctgatacagaggagccatgtatcacttggagaaacattatttttaggggtatttcaatgcaagtgagtggattaaaaaaagaaaggagtgtattcaagtcaaacaaggctttgttatatttcccttaatatatggggaagtttgtaaaatttgatgtctagtattctcacagaggctagacattttacgtattattgcacttaatccatacagtgatctaaacaggaaaactctccacttcttccttttcagggtctcataattaacaagttgagcagcaaggatgtgaacactaatcttctctattttatgatacagtgatgagggaagctaatcacaatcatgatcaactaaatgagaagataaaaatttagatatatgtgcaagatcatatgggaaatttggttattggggattatattgtattccatctgtaaaatgtggccatttgtaaatgaaatagtgtttttataaacatttcattttaaaataattattaattatacattattattatttttataccaagcattctttttttcagtcccacaaatttcaaattacctgtaaggtgtgtattactgccctcactttgcagaagaaaaatctatacttgatgcgcataagtaatgtaccaaacttacttagctgatacatttagctgatgcataactaacataaatctcaaaattatgtcttcagaattctaaaaaacagagttttaatgcttgggtgcctgaaatagactttcagctagatatagttgtattcaaataccaaatcgaaaaagtggaggaaggtttttagtctatgaattgatccagttttaaaagtgtaaaaatactcaactcaaaagtggtaactatagacatatgataatattaattcaggaaaaacattttctaaaattcctattttaatatttgactattcctgtttgtgaaaataggatttttctttagagttgaagcaaatacaaagaattttacattgcaatacattttctataaaatgtcctataattactgttttataacaagagatgaaataatacttgattaattcatttactcagaaggttaaaaactaaaatgttttatcaatttgtgctttcaatgcttccaggatttcagatgtcattgtaagttcattttcaattacttcgatgatatcttaaaatttctatatttgatttaaatattaacagctgtgtgaaaatcactctgttccaaaataaattacatcttgtgactgaaaatgttaattgccatgtttattcattatttacttttattattgtagggttccactggattccctgggtttccaggtgccaatggagagaaaggtgcacgggtatgatatataaatatgttttgaactatgtatataagtgttcttagctggacatagtggtgtgtgcctgtattcccagatatttgtgaggctcaggtggaggattgcttgaatcccggagttccaggccagcctgggcagcatagcaagtctgtctctaaatgaatacgaatgaatgaatgaatgaatgatgttcttgcatgactactcagtctcagcaccaggctcataatttactgtgatatactgcatattgaamttgaactgtctttgctagggagtagctggcaaaccaggccctcggggtcagcgtggtccaacggtaggtgccttgatttaaaatsatgtacatttttcatattgaatttagtgtatcaagataatttatttttcaaaaataaaaattgatttagtgtctttggatttgtctggcattagttygggttcatcttttgttctcatctgcagggtcctcgaggttcaagaggtgcaagaggtcccactgggaaacctgggccaaaggtatcacctgtactttttctgtttggatgttactgtagattttttttmcaggcagatgctatgagaaagaattcaaactgatttttcttttcttttcttggtgccagggcacttcaggtggcgatggccctcctggccctccaggtgaaagagtacgtatgatacagccacataatataaaatgaaaattagtatttctgcaagtatttagatttcagagraaagatatatgtctgctaatacatgtgcatgtctatccacaaaatctagtctgaatttaaaaacgcttaktttttaatttattcctcttcaccaataaaaaagcttaatcaatatgttcwactaattttgttatagaaatgagaaaaatgtgtgtaactggactaagatatcactcttatagtcaagacaaaaatagatattttttaaattttaaatacacttgaaacatctttgccctcttctccaatcagcttgctttccatattgatactcattttgttcacagagctggcagcaaaattatgctggtaaaaaacaagctactagtagccattaagccagaatcaatatacattcaactcaagataaaacatctattccagtaaatagaatagctatttagtaaattgatttttaattgatgtaagatgtagccaaatacatatgaacaagcatgccctttgtttggattttttggmaaaatataacatttttgtagccagatttttaaaaaagctatcctcctgatataagtttaagtattataatctgtattcctttaaaaaattagaatcatttcttcatattctataataattttcagtattatggagtcaggttaatatatttttgtatattatgatttgaaatgtataataggcattttacacaagacagaaataccttgcaatgcataacctaaaattgaaaatgaataatttttatttgagtaggagcaatgagcaaaacttgagtttttatttgtgacgaaaatgggagtagataacacacaagaataaacatttaattagagttgtgttaagtctttggctcatatttaattaattttccgctaaatgtttctcactctcgatgaactgttcccaaattaagtctatcctgtaatttttgagctcataaataatacattcatttgaagtattttatggtcagtcattttaataagggacatttaaattaattaaaawggctaaataattaaatggagtagaacaatttaacaaaaattagcacaactgtgagttttgtttttagagcaccactgattctctcatgcatttggttttgtcttccaaaatgttatgatcaataatatttccttacaagtgaatatgcttttgctgatactgcattttaatttgaaaaacagcaatactgtcatccaacagtatgattacttttaaaaacactttgagagtgagacaagtacctcttgggaatttttgttttgttttgttgttttagtaatctaggtggattcattttcaataactattcatatatgttttcaatgtctatacaggaagaacatatttcctatgttccttgtggttgatgagacatttcatcccaagtatgccttcattttctgccaagaatttttaattatcttaaactatttagttcacgtcttgagcacacagttgaaaaatggcaaaagtaatgccataaaatattttcctcaaaatatatgagttggggaaagttcagggaattagttctgtagtaccattggattagaaaatgaaataactatttttgcccatttcaaaggactctctcatgatcattatatttatatttaactatacagttatacatggcatgcatatatatatgtatacataaacttttattaaagtattctacaaattaaatgtaatccctcataatcataatttgcagatcatggatgctggttattaaaggttaaatatatcttttagttaggtctaaggttaccaaattaagtgaaaacaaaacaaaaatggaacaacagaaccaagacacctggataaatttgaattttatataaagaataagtcatttttgtcacaactatgtctcatgatatttaggacatattaaaattattcattatttatttaaagctcaaatttaggcactggatattttatctagtcatctggtttcaacaccatctgtacactgagtcattatggatttcttaaaatcccacctggaaactattttgattattaggaaaagaatatgccagccaggcgcgatggctcacacctgtaatcccagcactttgggaggcagaggtgggcagattacctgaggtcaggagttcgagaccagcctggccaacatggtgaaaccctgcctctactaaaagcacaaaaattagctgggcatggtggtgggtgcctgtaatcccagctactcaggaggctgaagcaggagaattgcttgaacccaggaggcggaggttgcagtgagccaagatcgtgccaccgcactccagcctgggcaacagagcaagactctgtctcaaaaaaaaaaaaaaaaaaaaaagccaacgttttctgtgaaattttataaagacycaatttttcatttttattttaaagtaatgatttttgraatgtttctttcttaaaagattttaaattcaaattgcatttgaaaggcagcaaaattttaggaagcaaaaacatgacattttaataaatcaggaaaatagtttgctacataaccaaaagaatactatttttaaaaatttgtacttaaaatggatttttatttaggaatcatagtgtcatagtttaataagagtttaaaattttgtaagttcctaagatttgcccagtagttttggtagtttcatgtgaaatctatttttgttaactttatatataactttgaagttactttttaaatataagatgctggtaataataaaaacttgtgatgatttctgaactaacattggcttatgaatggtaatgagatttttcttgggaaggctagattgataaatagaaagagtaaattctattgaaggccaacttcagtaaactctatttttgattagaaaaatacataaatcctaccctaaatgtattacttaagacattttacttatgttatctttcataaatcttcttaaataaatgtaactattacgttctgggcatatagaggattatctcttaccaattactttttctgccaacaatggagtcactgtaatgggactttatgcactttttaaaaataggtaaatttgagagatgaataatatagttaattaaaaatcaagccaagaatgatattataatttttatttggactgaacgttaataactacacaataaagttatttttaccttatctacaaaagaaatttatacatgagtaaaaaatatattgacatcatccaaaataaatatattttagatatggagaataaaggcatcttctgtggtctttttgagatagtcacatactttctcttttagttttggaatatacggctagatacagaacagggatagaagatagaataagttttaaaacagtttttttttttttttttttaagcggggctgtggaattgaattgaatcaaaatatcttccttgtatgaatgtttctagccaatgttaaaagtaaagacactgcagaacttctcaatacttacatgttctattcacttttaattgatatgaattctaaatatttacagtgttcctgaggtaacattgatgtgatgtgtagttttgagtagaaatagtgtgaaaatgtatccattttacttttagattagcacttactatcgtgttgtattaccatagttctgtcactgtgatgaagaagctgtatgatacattgtattttgtctatgtaaataaacctcaaagtataaagatgcatcttctaaggcatattgttaacttctccccactgctttttatttccagggtcctcaaggacctcagggtccagttggattccctggaccaaaaggccctcctgtaagtgtcagagcttctctttctctttcttcatttgatatttttacatttttgagagtcacagcttacatttatatatttgttagatataatattgataaaatctctgtaaaattacaattgatgtcaaagaaagtagacatttttaatttataaggttcatagatcgtttctgaatataatttcaacatctcttattaagtattttttgacagtataccgaagactagaaaaacatgaatatcattctctcagctgctcctttactgcaatgaatataattgatgacattacaaattgttatcaactcttaaatatttggtatattcgaatttatctttatcttccatcatcaaaataaccttcttcaaatatcacttcctaaatccctccaacattgtgatattacttaagtcatgctaaaatctatttatattaatattatatctgtctctataatcccttctttttagaaaatgtaatgagaattctcattaaatcttaacccttttatgaaatgtgtttagagcaacacttgaatgttcatcaagcatcttcataaagttaattgaaatactttgttttcatatttaaatatttgtggggacatagaacatactggggtcttttttgtttttgtttgtttgttttgcaacctcctcagtttctttaagagagtgggagtcagcttacccacctgtctaggacagtggttctcaaatgtagtccctggcccagcagcatccacagctcttgggatattgttagaaatgttccactgaccaaatcacaattctggagaggggcaggggccaagtctatattttaaaacaccctctagacagttctgatgcatgttaaagtgtgtgaacctctgtgctagtccagatgaacaatactacccatactttaatgtgcacacaagtcatattggtgaattatttattttgaaataattaaacatcaaatattaagacaatccttaactttttacaataatttttagaccctgcttaaattattatttaccactgaagagttttgcattattactgcaaagatattaggaaagtattgttatctgtattacaaggttatagaaagatcgatacatatggctagtgttaaatataaagtaaccttggtactacctgcatataatgcttacctactatgtcagttttgctccaaatgtaacatgaagactctgcaaagtttcacagagaaatgaaaacagtttcaaaagtcactgtatgtatatttttataaacattcttataattattttaagctgtatattagattattgtttaggaacataaagtttagtgacgtatataacctcagtattgtacsatttatgtttgtatgtattgttgagaactgcttggctcatgtaatattgtttcattgtcaaagaaacccatttgactcatttttttatcagactttttcagcccattgtgttatgtgtctttcaacatgttttgagccattgatcgtgcatgcattttgtctgtaagaggtatcagaagcataataaatgcctacacttgagaagcatgcattctagtaggagagacaagaaggrgtatttctttcactgataaacaaagtgatttttatactatgtttctctaacaagtgaaacattagagcatgaaataaaaataccccatttctctagtatgcagttttatgcagtttgggacagaattggcttcatctgtttgatatagaaagaagaagttggggtagagagatagaaaaaacctcttcctgtaaattaattggttcatctccttcatcatagcaggaaaaaattttatatatatatgatgtatattcacacagacatatatatatatggatctaaatattcccttcagattctgttaatatcatgcccatatcggcatattttgggaatatgcagccatccatttaaaaaacacattaacttgaaatgattaagaattatagcatgactagtatgagaaacattctatttagaatagaaaaagtcaaaactcagtgccaatgagaagtgagaaaacatccttaaacaattacctacaagttttcacagattttctcgccaaatctgcataccctcatttagatgaatttgttctctctgtcctgtaccagctagatcaaaggggaagcctgggaagcctattttgatgaaaaaattattacttttacatagataccgtgaaattatttggtaattagtctgcttatttcattggttaatagtttgtggcctttatatttatttagggctaattgcttgatattagaagtacatacttaaatcaagaaaaatgataatgacaccaattcttaatgcagtatattaacactactccctcagtctatctaggaaagccattaaatattatgttgcattcttcccaggatgtgatcgcttagacctaagatcgctattttaaagtattataatattttgcaatgaatgtgttatctatgtcagcaaatatgagatatttaatcttatatttacagctttgttaaaaaaaagtaagtcttgtattagtggcaaagtacatcatttaagaagcactttagtatggtggaaaaaaaagccagacataattgatatccttcagctgtcatcctctctataaaacttttattattgcccagaattgaaagcaagtttattgccaaatatatcaaaccagtgataaggcacagaaattgttttatttgctattttgtaaaactggacctcaatgaagtctactaccaatcaactaaatacttatttctgtatgtcacctccaaactgagggcaaaactaagtcttagcattagtatacacctagtaaatgatacgtgggtatgtaatatatgttttttaaagaagccatggttaaatgacatccaagaatgttttgggtccttggttaaaaacactccagttttgttttttgaagaagaggatggcagtagtagccctggaaaacctgaagaagtcactgagcaagccatgatgttgtgaagtagcataacggattttaattagagttgttaatttacagggcacccaggatgtcaatacasatgacttaagggagcaaagatggttctggcaccaccaagaacctttctcctgaagtaactagccaacctggaaaaagtctccctcagttggaagaaagctatttgagaaaataacattttggaacaaagcctgtttttcatactcactctataagaacatatattaaaaatagatgttcaaaaacaattttatttaaataattaacatacaatgagaggtgtacctgttataatttaaaatattattattaaaagaatcatttctcttcattcatctagaagggtgatagtatttttatctctacccgttgaccatgttttgaaatttgaacttgatacgtaatggttactgagtagaatgaataatccataaggcagtctaaagaagcagtttctttctactaagtatttaaaatataggaccctcacagagttgttcactttgtttgtagttaattgcttcatttatttcttaagccatgacaaagacagcatcctttatacaaagtgatagcagcagatttgctctgtggtacttcacaaacattatgcttccaagaggacatttaagaaaatctactgggaaaaatttgtcctgatgacttctagaattgagtataacgtattgtttcctttacttgaaaaaatttgagagataaaatgccattttttatgagtttgtatttattttgcattcttggtttttttttgtttgtttgttttgttttgttttttgttttttgagacggtctcgctcggagtgcagtggcgccatctcagctcactgcaacctccgcctcccaggttcaagggattcccctgcctcagcctcccgagtagctgcgactacaggcgtgtgccaccacgcccggctacttttttgttttttagtagagacggggtttcagcatgttggtcagaatggtcttgatcctctgacctcttgatcctcccgcctcgacctcccaaagtgctgggattacaggtgtcagccaccctgcccggccttcttttgccttcttgtcagttagaagctcggattaccactagagggcactatttctctctgttatccaagttttgatgcaccgggaattgaattaggaacaaatcaccaaaaagggggaaatactcatttgtgaagtgctaaagaagyaatatttttcacaaaaacgaaaatacaaacctttgcaaatattattttacaaatgattgatgcaaatgaaatatatttaaatgtaaaatattcagaaaagagttcaactattttattttggtttcagctatagctacagaattatattgaagagatatatgtgcatattatcatatataaaatcaacagaagagcaaagtaaaatagctaatggaaatataaaaagaaaagaaaattttctaacatgtcacatttagactataaaataattaaatatttatgacatgtggtatttaatatttgtaatttcagggaccacctgggaaggatgggctgccaggacaccctgggcaacgtggggagactgtaagtgaccttgttactcttattaaaaatttccatctctagcacctcatcagttcatacatagaaagctactttattatgaacatttcaattactaggttgagaaaaatggaaaaattaattccattaagccttttattgaaatatayatatatatataaatacaaaaatagatacaagaaatatacttcaggaaataggatgttagttgatatgattgtttttattgtcaatagcagcattttaaggatgagctgatggagaagacaccattattttttggacatctcctcaagattttccctctcactcttttcactgaagactgtttatagatacattccactcaaacccatcatctctccactctaaaggcaacagattacgaatagccatgatcataataccacattcttttatctagaactaagggattaaatacttgctgatattggacccatcggctataactggttgggaactatgtcaaaagcatctttccatgtgaaataggaaaaagtaaatcaaaaacggtcactaaattttacttaaaacctataaagaatataacagtaaacaaattgactgaacaacttaccatgtgtataacaatttgggcagagaggaaactggcagctcagtgatggtttaagaatcctggtgagtttatttattttgcccctttcaaaatcagacatctggctatcccagtggattgtcattctaatcagaaatcatcatggattggcatatttccatggaatcaattcttgcttctcaccaatgattacttttatccagacttctcaaggaaaccacaaatgcagactacctttgactatgtggttgaaaatcatgttagggtagggggcaccctgaatacatattggagttgcatagcaatgtactataataaatctgaaatctgaaaaaaatatgatttttctgctatggaggaaacaatttgtcagcagccacccaattttgccttgcttaccatgtggcaattcttagtttcaccatttcttagttttagccagatgagaaactttggagtcttggatttcaaaagcaaaattgaaatatgatttagtgagacaaaagaaaaaactgtttggatatcctcttgggaaagatatctgtatgaggagcagaaataaactttctaaaggagagtcaacactcaatttgcaaatgcattatcattcaaatctttcagccaaatcatttttaatgaagtcattgtataactttctgggaataactatagaatattccaaaatgtcttgtggggaaaggatacctagagaattactgttataaagtcctttatgtctatgatttaatctggagcttccacttctaacaaaaataattatatcacatataacattgagatttaaacatagaagaaaaacagcataatgtttctwgaatgaatgtttctgttttgtagcttttcacagataaaagccaggattatttctgaaaaaattatattcccgatttcacatccactttaagggaatagtgaatcgtcctatagcctcaaagctttctttctcactttgttctctgctgacccagattcaaaggatcaccttgtacaggagtcacaatctagagtgggcattctttgccatatatttattatcttatttaaatggataaatttttgaattatatttgagatttgtctccagccagaaatccattaattaaatgtttgttctgacatcttacattcatttgggttgtttcagtataatagaaactattcccaatttttcctggtggccttaaacagcttcagaaatggtttctattatattgaaatgacccaaatttgtctcagaaacatagtgccaaatgctgtattggtcctaaaattggcttagtcttttaaagattatcagaataggaatcacatttctgttggattgtaacagcatatttttcaaactacccatgaatatgtccaattaatttccattttcagcaactttgaaaaacataatttgactagctactctgaaattaagtggcaagtgtagtcttattacatgacaatattgaacaagcacaacttgttgtgaactgtaaaagttttcctgtgtagtttgtttgtaagatccccaagatcaaatgtattagatacttgcaaacactctgaatggattgaatgagcagacatatgggcaatgctgtcttccagctttcccaaatccatcactcacacaaatgggctagcagccaagacttcctctctccccttaggatgtatgagtgcaagtctatgttgtaattttgtcgagactttctgcaattaagtattgatttttaatctattacatttaattattattgcaatattttgtgtgtgattcttgctctcacagttagtaagacaaaatgctttataagacttttttaaaaagtttggaattgcctttatatcttcctgttgaatttaatgattaaaaattggaggaagaataacccagacagaggaaacaggtcatacaaatatatggtgtgtggctattcagaaaaaggtaggaagatcagcatggctagaatttaggatacattatcaaagcaaaggaagtaactgaatttgcatactgggcccctattggctagaactttgtcatctatatgtttaaaaatgaatttattggctgggcgtggtggctcacgcctgtaatcccagcactttgggaggccgaggcgggcggatcacgaagtcaggagatcgagaccatcctttctaacacggtgaaaccccgtctctactaaaactacaaaaaattagccgggcttggtggcgggcgcctgtagtcccagctactctggaggctgaagcaggagaatggcgtgaacctgggaggcggagcttgcagtgagccgagatcgcgccactgcactccagcctgggcgacagagcgagactccgtctcaaaaaaaaaaaaaaaaaaaaaaaaaaaaaaaaagaatttattatgtttggttttgtgggtgatgattctgcctaatgtaaacaagttagtaaaccttatttgaaaactcaacaatggtgaaggaaagaggtgattatagtttgaataagacaggtctactaggataagagagaagaagctgtatttgagggaccttctcacgtgacacattcagataaaataactgattaagcatgggcactgaagaaaagtctggaatctgaagacacgccattaaaaaggggaagaacatagaaggaaaatcaaaggagaagatacattcagcaagttccatgttaggaatgttgaagagagagcatgatatacaactggaaatttctagtaggcacttactgagmgagttttagggctcatactgattagaggtttataaatagttgggaatggaggagttcatcagcatagagatggcaattgtggtgatggaggttgttgagataatccagggacacacatacacatatgcacacatgtatatatgtgtttaggtatctgtgtatgtgtgtatgtaaatctgacaacagatttccaaaccaactggttgatgaaaaaattaagcgactaatatgcttataaaatgctaaataaattttatgacatttccccccagaaatgattgcttttgctattcataatgatagctcaaatagaaccctgaaagtctgaattaatagatttttaaaatagaactctattttctttccctgtagcatcaattgcaataattacagactctttacctacttatacaattttattattgtaaataattcattcatagttattgggaacattgtgatactaacgtgagactgctagttcctacccattttttttctaatcttattattttcagtctgaccagatgttgtagggaataaaatattcagttctttcgaaacttctccyaatattttctatctacttctccagctgttaaaagtaacttaactctcatgggtaagaaatttacctatattcacacaattatgtggaatgaataacccacagcctagagaaaaataaataccagaatatatgcccagaagttttatttagtgagtatattctgctcaaatcaaccagatgatattttaatgactgaattattttcaaaatgcatttatgactatatctcttgagtttcttacaagaaagaatattgataaacgctaaaataattactaactatgcaaagcattattttagtagatctatttttatatcttgttttatgagatttttggaatacaatagagagaaatgtattaatatcacaggctgtgaatttacctttgtataaacaatcagtaaactgtttcaaagaatgtctaaatcatcatttacttcatccataaacattactgggttaaaattctgtatgttgtttgacctagtggaatggggctaagaacacatttttactctagcttcatttattaaaggtaattattgccctaccatgtgaaatattgaaatggcaagttttgaattttaatgaaaactgaaataagtttaacatattaaacatatttaagcatwtgaaaataaatatttttagtcaataggtgactttcttttaatgtgacttattcagctatctcatagaattttgatttatgctttrtgttgtatgtagcttttacaaataatactttgcctccttagggatttcaaggcaagaccggccctcctgggccagggggagtggttggaccacaggtatgttcctttgctttatttcccaagcaagatttattttttgtttacattttaaccttcctaagttgtgtaaaatcttctaaatttattatgattcaaaatgatgtattttttatttcagattgcatttaaatatatgcagctttcgtacatcaaatgaaaccaacaaactattacctaactaaagcaacttttcaattgcctgtaagaataaaagagaagaataaaataaatgaaagtaaatcagaaagttcacactgaatttaacactaaagcctgactatgacaccatctactaataaaaatacaaagttctttgtaaataggtgggccattatctttttctagaattttaaattataaaatgacttcatggttttgagtataaattagatttagaaatatacattctaaaattttaatatttgtaacatattaggtgtttcttaagatttttgccttcataataatgaatatcagaaataaaatattaattatctttgaggatatacaaaatagtggaaaagacaagtatttatttcaagataggtggcagaagaagtctcaaaaattggtgcagtatcctgagttatagtataaaataactacaaagagtaattcatggtaatagaaaataatgtttttcttccctggcaaagcatattgaatgggcagaacacatttagtttctggactggaatttagcccctgctaataccaaattataacaaaggagcaaaagcaggtgaatacgtattttaattatttaattggtttagtcttttctctgtctctaaatagttctcaacactgtaactcacacacatacacacacacatgcgcacacggacacacacatgcacatccaaacacatacacacacacacacacacacacacccctagagaaacaacaaaactgcatcttgtttttaggaatatgtataacagaagcaaaaatgaagaatcattggatttattgattattttatttcagaggttaaccctgaggcaagggaaatacgatgttattttatagagtgtgtaaacatgactacttacttgtgctgaaggcttctttttaactgcttatcagttttagttaraacattatatatactttctcagtaattagaaagcttcctccaaaaatactttcatttttcctgtttaaaacaactttataactattttctgtgagaaaatttaactagaaaaattattcctattatacttaatatccataaacagaaatggaattagactcttaactaaaatataaacatcatggaatgtaactaaatattttaggacctcacatctttcaaaaatacaattctgttcaatgtggtcatctaaaacttctgagacttgtgttcttttttcgttcccctctttacatgaaggcataaaaatactggtgttttactgaagatgcaccttccttgaattacattttttattggtcctttttaagagaaaaaaaaccaacagcctattttaaatgtagccatactttcatgtgaagacaaaagatttggtttaatgggaataatatagattgcaatactgaatatgcacccttttctttaaacagttatgtgaatctctgatcatttttgtctcggtgatcgctgttcaattatggttaattctgtattccttactgttcaaattctggtgttcagatagttaagaaaacatcatgttttggataaatgtttacacattaatgttaagttgagaaattacagcaattgtataattaaagaaatttaaacctagaaatgtatacccaaattgggacaggtgtataccttatccaagataaatagttaagamtatgttgcatttttaggaaaaaaatatttatacttcataagcaagtgcaggaacacattctcctgtttaacaaccttagcatctaaaaattttctctttgtttaacttaaacccttcattttgctttttattaagatagagagcaactgatcaccatcctctatttatacatgaaagcctgctatactcaagcaccacaaaacagcaccactcaggggacacgtaaatgacctgatattgttcactttggcatttgctgcaatttaaggcagctgaccatttgttacagcctttggccgagaggaactgctgacccatactcactgccttcaggatcccatgccacattccctagactttgtcaaatgaatatagattaatagtagagaaattttcagtccatggaaattccagggagaaccactggctttttgggttctcatggccctaagtttattttcaagcagtgattcattgagtggctaccaatgtggtttctatgcctctttactactaagctgatttgacacctcatatgaaaagaaggaatgggataaaactgtaattaaaaatcatagttttcataatacttggactggccacactctgcagaaattattgtattaagcaaagaaaacatctttttgractttatttatgtactttccttttacactcagattctaacsaagattatataaaatctttttagactcttacttgatatgctactttcagtgctttatgtgaagtgttttgtaggacatcatgagaataagtgaggatgataaacttttrtaaatgtaataataytgtttttgagtttgtgttatctttgccaaaaataaaagagcaatctaaagtgattttgcttatctaatttagggaccaaccggtgagactggtccaataggggaacgtgggcatcctggccctcctggccctcctggtgagcaaggtcttcctggtgctgcaggaaaagaaggtgcaaaggtacaacatgctycagaaaactttttttggcccaaaactttaatttatgtttaactataytcaccycttgtctacagattccatttaaatgaatgtcagaagatgtgtcaggaaaatatttaatgtgcgtttattgtactccaagatattgctcaacatttatataagaccgttagctccgttgaccataaaatctttaatatatatgtaacgtwaaatgtaggtagtgggtagttcattttaatgcatatggcattccacccaatattctcatcattaaataatattcacattttacttacagtagtttagaggtaatcacaattttgtttgtagaaagatgtgtagaaattaatctgtcttgwcgatgtttattatattctttagggtgatccaggtcctcaaggtatctcagggaaagatggaccagcaggattacgtggtttcccaggggaaagaggtcttcctggagctcaggtataatcaatatctatatagataaagcaagtgattccaattgtttattagaagcattttttctcagaacttaagaagtgatgattaagggaagatatataaacatatatatttgattatcattacatatatgtgtatatatgtagttatgtctataaacattacctgacatccttattttactaatcagatatctcctcctattggtattcaattcatatggattcattttctttatttttttcacttttcccagggtgcacctggactgaaaggaggggaaggtccccagggcccaccaggtccagttgtaagtatgatgatrataaatagccagacaatcatggttgygaattacagctcttctttcattactctcatgctgtgattccacagtgtgtgggagagaaaataaacacatgtcaatcaaatcagtcaatgcctagttcccactaattgcatgcactaatgaatgcagaaacagaagggtttggatgattggaaatatttgcttctgctgctgtcaggaggtaaaaggagatatcttgcttcttacggttcccaaggaaataaatcctcattatgartaatagaagctcatagtcacggaatgcctggagaggctgtagtttgaaatttttacttcatttacatctattattttagaagtacttataaaataagatttgatttcttataaattatattctatcattcatttaytataaaacatatttaatttgtttataagtacttgatgagamttgaatttgtcaatgatacaaaaaacataagcataaaagcataaaacccataagcacaatcttatatattatgcatattgctttatttaatcaaaacattatgaaataattggcaaattagtaaatatcagatttttacctcatttttttcttgagatacatatcaatccctcagaaaacaattgaatgtatgcttcattttttaataaattcacctttattcttatctgcacactgaaatttcactataacagccaaactgccatatttagtgtcttcttctcattttcttatttcaccaatctaaaaagctgaaagttgccttaaaggccctctcaacttcctttcacacaatattcattagttttgcttccaaaatattttactaatttttccgctttcttcatttctaccaccaccattttgttcagactctttcctcttcctttctctttgactaataacatcttatcttttgattcattttcttatccccttcagtcagtttcacctatagaatactagtttaacatacatccttaactatggcattcctctatcatacccatcctatagttccacactgcctttggaaaccaagctccttatcctagccagcaagtcatcttcatagttcaaccccaattgctatagtcctttttttttcccttcatgcctcccttttaattctacccaacttaatgcattgaatgttgtcttgcttctcaaaaccatgaccttttctattttgagaagagtatactgtacacctttcccctttctccaggaaactccagtttttctttctctacttgacaaagatcctacccaaccataaagataactcttaaatgttaaatctctataaagtcatctttggataatttgcctccatttcatgtatttgtaaaaattcccccccccacacacacccagtgacctttattatatctccatttttagaaattacattggaatatagttggctgtctctcgcattaggctgtgagttaccagtattattttggttactcamaatacggtgcctgaagcacagtaatcatctcacacttacccatttgaattattatgaatacctaatattggaataaattttatatagcattacttaatactgggaatacaacaagtgtatcatttttcagattgattcacatgatacttactctttacttcactcacatcatataacaaccattgacataattatggaaatgtggcaaagatattttttaaagaaaatatattttgataactgtattagacttacactggagttcataaaattatgaacattttctaatgtcctcaaaagttagtgacagtagcattagcagcaacaacaacttaataagacaaaagttcttatttagatatagaatcttctaaaatttcagtaaaatgcaatccatttaaccagaccttcagattctaaagatatcttctaggaataaatgatgttttaagaaaaatgcacactgaactaatcatctgagctgtgactataaggattaaattgttttaagttattttttaggaaccaagcactgaagctctctcaagggttgggaacagttgaaaccagtgtatttgtaggctgcatactatgtccaggggatacaattttcaaaatgttaattgaaatatgtatagttacatgtagaataacattaaatgtacttttatttatttggcttcaactgtgtatttgagaattattacttactttgwtatatgcaactgaacatcacagtagatattctttgagataaaataggataaacaattttgaaaagaaatacaccaaagactaaatagcactgtaagttggttggtgattaaatgcctaatgacatacaaacaataaatgttaattctatgagggaggtagaaagagaatataaataaggggaagggccatgtggaaaaggtgaccctcgaacttggcttcacagagtgcagaagattacaaaatcgttgaagagcgagaaaatattaggaaagagatgtgatgtttaattagtatctgtttttgcccaagtgggacaaaatttgggagatggactaacatttgttgaattcttgctagcatctaagcactctgctattttacataataaaaaactaaatcactaatacaacatrtaattactgaagctctgaaattgcaagatgtagtcatttgaatatttgaaatgtacagaacaagtggagtaaacaaattgaagttttaagaaaacaaatctgtcattaatgtttaatatctaacagagataggagagaatagatcacaaaagtccagtgaccaatgtcaacattggagtgagccgatgacttgggcaacgtggaatccaaggacattgcagatgtagcaaacacggagggggcgaggtagtaggatttatgactaagatttgatgtgggcagtgaggacaaatgaaaactgaacaatgacctcaagcttatgtccttgagagaatgacagtttggtgacgccttccatgcctagagcaattttacctcatcaagagcaagaacaaacaaaaaccagaaatattcacacacaaaaacttttaaaacctcttggcagtcacaaaaaattacaaaggattttatactttgctaatagatatgcttgatagatgctcactgtgtttatttgaaattaataaccattcttatatttgcaaatcaaatatgcaaacatcaaccaattaaaattattccttaaagttgttggaaaaggattcactaaaaggaagacaccatacacatttattagttcctaacactattgttttaattgctgcagaatctagtgaagcggtgcatgatgatgactcagttcataacaagtgctgagcgagccttagtttactccatttaaagtgattacatcacataaaatttgattttgaattttttaattccaaatgacagataaaacaaaaactggatggttttctagatgtgaagtataatttatctagaaaattaataatgtcaattcttattttttgaggttcaaaacttactatgagtttcccttgcaattaatattgaaaaaaaaaagaatcaggagtagggatttctttaaaaggtaacaagttctgctttgcaatgttaatagaaaaggtgatggcaaaatattaaaggggaagtatttgatcagttggtgagaaatgataaaattctgagtcataaggaataaaggcataagaacatcttctaaaaattcattttataatgtatatgtctgagtttatatcaatcttatgttaactttacctttagaatattgaccaaataattgtaagtgcaagacaggaattcacagaaacagagtgatgagtattcagcggttatttgtattaaggaaaaagcaaagcaaagtgatgagttctgaggaagagaatgtgaagtctaaaggaaatagaaaagggaaatgaagtaatattgagtgtttattctttcaactcttatgctaggtattttatatctgttattcttattcttgcaacttggaatggtagattttttttttctattttaccattccatatttaaagacaaaagatctgaggcttgaagaagtatagagcttgcccaaattatctgggcaaatatccatgatagcactttacataaactcattttcaagtcatcttgacccttctaaatctctgtgaacaattttgtcaaaagagagtgagaagagttagtatttcaactacctaggctttaatattactacatattctctataactattgcttattttgaatgaatcgaagatgaaactgattaaactaatatacaggttgattttttaatgacaagatgtttgtcagaatgccattgaactcttagtttctttcacctataatgcaattcataaggaatgtagttgtgctgtgtatttctggattgctagggaaataataaattccctcattgcacaggatactgatgaactaaaactaaaagtcctaagcagagctttaatcagctaaccttattgctcacagtgatatttgcaaagtttgtatgtgtcccaattatgtagcttatgcactatatccttactatatgactctaatctgcaaaaagaacaaatataatatttaattctaatrtatccattcaagtgttctatctattcatttataagtatatttagcatctattctctttatttataatccatttagtctgaaacataggtcgttattatgacactccatagaagtggatttactgtactcaggtaggtctaggtgtatgtcattgacttatatttagagaaactttatttgtaaaacaaataaactaaaaaaatctgtttgaagatatgggatattgctttatacagggtcatctttatgaatatccttggaagaaatctcttgctaaccatagctttaaaaatatttgcaatttctttttttcaagtatgctttttatagaatatttaaaatttttttaaatattaactgacttggttttttttttagtcagtttgaattacaaaacttagaattcttttcactttggcttacagaaataatggagtcaaaatagagacggtacagaagataatgtttgataactattgtaaaaactttttgaacacaacttactatcaaaagtacctatgatatactttaatattttctattatattttgttatagttaatatttttaaatactgggcaagacctgtgaaatttacctcataacctactcatggagcataacctacagttagaaaaatccttggtcttggtatgcatttttagtttactactactactggctccattttacttcaataaaaagttatttgcttacctgttttccttgcttacctattttaaaatttatattgtctaatattttatgcatactatttaagctgctataagtctttttctgtgaaagtaccataaagaaataaataccagaaaatatcagacaatctattaaactgaagttatattgattcataaaatggaccttcctgcaaagagcttatggtttactgaggaggacaaagagcagataaaataacatagtaaataataagaatatactaaaagaacagaaaacacaaaggtgagaacaatgttttttgcctaaggaaattatgtttgaattgaagctgtaaataaaaaccagttttatctatgaaaagcagcctttttgtgtgctaaatttagtcttgaactgctcatcactttttgtcctcttagtaaagaactagtatttcaaggttagggttatctaaaggttttggtcctgggagttattgtatactgaggaacgttctgtcgtgctaccacttatgacaaaattataccaatagggtgctgtgacgttgggattttaaagtctaggaaaaccaagtgttccctgtatacgtgatgttgtatccaagaactggtaacagatgccaatcaaatccagggcatgtcttctgatctcaggggatgtagtcactaaatggatgtcttgatgcacacacaaggcagaaagtagcaagagactgaacatcaagagagtaaggcagtgcagcatttttctgcatgatgaatataaactgggtaaatgttttctatgtatgtaaacagatatatgtaaatatatcatgcaacaaattctcagatttcacctactgcatatatttttataaaacaaaatcaaggaaaataatatttagggaaaatatattttccctaaataatctctcctccagatattctttatggtagagaacaatctcattaacaacagttatttatctaaaaatgagattaaaacaaatatagtagtatgttttgtaaaagccttctatctttacaatcacatgtatattttatccctaggagttgtggaagttaacatgcagaaagtatatgagaggagccagatagctggtacagartatatgtccaatatttcaaaattgtgcggtatagcagtctttgctgttttcctgtgactcctattatgtgaccatccccccatgattctgactttattttcctctttatttattatttcttcttcttctcttgcttctctaagagttcacattctcttcctatcataattcctattcctcttatttttttttcttcatcctatttctgagaaccttcttttccttggcttttacttattcttccagcaagggaataaccaaggtttaaaaggatgtcatgtaccgacatgccaagtcagactctatacattttaagataaagtccattttctccattgtgacccaggtagaccttagtggactatgattacatccaactagggatgagataaatgtagcaatagtgatggggaccagtgatcaaaatctgaggtatttgatttgactttgatcatcagagtctatgctttaaattctgataatgcttgatagttcatctgaatttttagttcacgtaatctaaaatgtatgtcatgtagagagtgaaagtacttcatagttttgacatgaaggtcaacttcttttttttttttttttatttcaagagggagtttcgctcttgtcgcccagtctggaatgcagtgacgcaatctcgcctcactgcaacctccgcctcctaggttcaagtgattctcctgtctcagcctcccgagtagctgggattgcaggcacccaccaccaacccggataatttttgtatttttcgtagaaacggggtttcactatattggccaggctggtctcgggcttctgacctcaggtgatccacccgcttcggcctcccaaagtgttgggattacaggcgtgagccaaggtgcctggctgaaggtcaactttttaaaaagacagagcagacgtgtttttgccctctagttgtatagctctggtttgtaagcactttatgtgtttatgcttctatttttctctctagtgggcggcatcttaactgaatgctgatgaggtgatttgtctatcactttcatttactttacaaatgctcctcaraatatgaaacatccagtgaaaataactgataaaacatttattttggtgttctcatctgtgtgagggattaggggaatactttctattctcattgctccaggaatatagaccaatgctattgcttcttgtttcattatcattgtaagttttagatgaaggtgcagcaggatttaggggaagggctgcagaaggggataaagctaatacacaagtaaagaaaggtaactaagtagagaaaggtaaattcttcccttttaaaagcatgtaaatgttcacttttcagttcaaaacaagagaaaaatggcatgttttccatagttgttaatatttagtaccgaaataacagaacacttatgatattatggtcattgtaattcatgaaattaaacagatattattgcctttgggaaacatgtttttattgtcatttaaatcacatattaagaaaataatattgctataatttttagtccctcctttgagttctttctagctaagcactttcaatgtgtaaaatatctatccttcttacagagagacaagtatacaaatagttaaaagttaggattaacaatgccatattaatggtggaaaaagccctacccttcttttaacagggtattttatacctgttgttttgatattcatttattaatgtattaaatatgccatataattttctggatcttagtttactttyctgtaaaattttacttctacaaykatttgagattttatatctatttttggaatatataactgttcacttacagtcctctaacatctattacatttatactttttgacaggcattgttcaaagaactttagttatattaaayatgactaaaacctgatgacaaactatttctgtctctattatgacaggcattgttgaaataactttagatgtatcatagtaaacatgacaaaaacctgatgacaaactatttctctccatctatggcaacaaaagtggcccatagagagtttgctccagatcagaaagctagtggttccagtgctagagagggaaagatcatacacttaattgacacacttatttatggcatactrtgtgccagtaactactcaaactgctggagatcattgaaaaaagaaaaaaaaagaaaaatcaaaaacctctacctttgtgaagttgatcattatctattttacctatgcttaaagacaatcattcagtttagatataatagtttatttatctgacaattataaagtcccttgttctttagccagctatacagcaatacaaaaatgtctcactatatatgcctactctttatgcaaacaaaaaaagtatatacacaatgtgagtttctcaagggctgcttcctgccataatacatttcatattcacaatcaagtgtcccaagagaatagattctcattagtgttgaacatggagtttttagttgaatgtctaaatggtaccttcttttcatattgggcttaaatttttgcttaaaaaatataacttctccagtgattctgttgagattaaaggattcataggcttattcttttaaagttggcatgagaatatttaaataagatttgcaagtttgctatgtcatttgcttaatgggtaggtaccatcagagattttcacttttcatttatagatatataaaataaaattatagcagagcatgctgttattacaaacatctaggctttgagagtgtttgaagtaactaatagaaaaagaaattgcagttgtactttagggcatggatatacattccaaaagtcttctcttgttttcatctgttgtttcaaagtttatgagctgtgacaagatcatgagcaatattttaactacagaaaagtaatatattctcgacactaattttaatgcagcttccacaagcaagatgacaatctgaaatttaatcttatgaatgctccaagggagaaattaaaacagttaagcttttaaataaaaaatagtatacagtatctggctgggcacggtggctcacacctgtaattccagcactttgggaggccaagacaggtggatcacgaggtcaagagatcgagaccatcctggccaacatggtgaaaccctgtctctactaaaaatacaaaaattacctggacgtggtggcgggtgcctgtagtctctgctactcagaaggctaaggcaggagaatcgtttgaacctgggaggtggaggttgcagtgagccaagatcgcaccactgcacttcagcctggtgacagagcaagactccatctcaaaaaaaaatagtatacagtatctacaaactacacacattgccatagagtcaaatcagcattctgtctcttcttgatatatgttaaaataattattaaaatatttcaattaattttaaataataaacatacttcggtataaatttaataagcattattttcataagtaaaagccatggcttactttcatataacatgtcaatcataatgcatccagttaaggtaatatttattttctttcattttgaaaccatttcttacagggaaaatatacattcaatagcaattttcctgcaaatttgaaaaatttctcttgactacatgtgtgtacatttgaagcctaatttttattttattttattttattttatttttttaagacggagtctggctccgttgcccaggctctggagtgcagtggcgcgatatcggctcactgcaagctccacctcccggattcacgctattctcctgcctcagcctcccgagtagctgggactatcacctaccacctgccaccacacccggctaattttttgtgtttttagtagagacgccaccacgcccagctaatttattgtatttggtagagacagggtttcaccgtgttagccaggatggtctcaatctcctgacctcgtgatccgcccgccttggcctcccaaagtgctgggattacaggtgtgagccaccactcccggcgtgacgcctaaatttttaacatgttcaacatgtttgcatacataataaaaacacaaatgcattatagttatttaatgcatacagtcaatatattattgtttgttaatatgaattaagagacatggagatatttactactcagaatgtagtgccaagtgctgcattaattcactccaaaaataatggtagaaaaccaaggttctataagaaagtgtataagaaatactttgaaggatctcatgcttctaattctcaggaaaatacaattttttggtaagatggtatatcagtccattttcgtgctgctataaagaactgcccgagactagataatttataaaggaaagaggtttaattgactcacagtacagcacggctggggaagcctcgggaaacttacaatcatggtggaaggcaaaggggaagcaaggcaccttcttcacaagtaagcaggaagaagtgcctagcaaagggggaagagccccttataaaccatcagatcgcataagaactcactcattgtcaggagaacagcatgggggaaactgacctcatgattccattgtcttcacttaatctctcccttgacaggtggggataatgaggattatggaggttataaagcaagatgagatttgggtggggacacaaagcctaagcatatcagatggttattgacctgggtcaaaaaaaagaggctggaattttagtagtataggaaaagaccaaagactttccatgtcagaagataagtgtgaccaaatattcagaagtgaaaattggacatattgtgttagagagacagtgagagatgtaatattttaggataaaataatgttcaaagtagaatgctaagatataaagtaaaaaaaaaattctaagaatgtgagttgaatattttctaggatgactgaggataaatatattctcaaaaagatgcattaacccacactatttcagagttcagcataggtgaactctgaaataaggagtgaaggcagatgaaaaagtaccatggtgtctccagtgaaatgtgttgaaaaattaccaaaagtgaaaacgtcctttgttgttgaaaatttcaaataaacttataaacaatatgacaaagagcagagacttcttttttctttcgagacagagtcctgctctgtcacctaggctggagtgcagcagtataatcacagctcactgcagccttgacctccctgggctcaggtgaccctcctgtcctgagtagctgactataggtgcatgccactacacccagataatttttgtatttttattagagagggggtttcaccatgttatccaggtcttgaactcctggcctcaagcaatctgcccaccttggcctcccaaagtgctgagattacaggcatgagacacagtgcccagccaagagcagagattctaatgaattgtgtatcaaaggtcaaatgaactgaatgaatgatggagaatgattatttggataaaggagacaagcattttcatcaattcctttaagttttttgtttgttttacacaatgttcaaccaaaatgagcttgttttggtagaagtggctcttaagtggctatatttcttccatttattaaaatttagcacaattcattgtacccatgagttgtatgggtacaatgagtcaaggaaattttgttttcaccatttataaactgctaagcrttgtagaaaatacttggtagtgaattagggcacacagaccttgagtccatggtttttaacttaaaaatatacaagtcatacagcaataaaattatattgcatatgcaaagcacttagcacaataattgttaattagtaggtataataattgtaagtcagttaattctcttaaaatggacttcaaacttttgttgattctccctttttcattctagtctagtacccatcaacttcgccatagcctagtgtgatatcttcctagggtattctttgaacagttagggtttaaacaggattaaagagagaaaaattttatggcccgacaaattaaaatcgcacctctttttgtatagccaattacaaataaaatactgcagaagttaaattgaatgcttattctagatttgataaaactaatggatagcaatcattttgtgagggttagaagtgaaatactaaacaaaattgtaatatagtcaccttatatgtacattgatcctcaataaatcagtgtttcagattagtggagatttatctttagtggtattaattttaacttgagtagaataaccctagttgcatcatgtgttgtcttctgttgatgtgtttctgttaccaaaaaaggagcacttttattactgacttttttcttttctctctttttagtaattcaagggacacctttgcattcctctcaattcatagaccttgctcttcttgctcttcttcttatccacctcctatacttttttcttccttcctgacctccctctcaaagaattagaggcaaatatttgtgttctttttactcttagggttgctcattttgaatgtgcaacagtaggaggattctattattttttctactgcattgacttctataatcattcaacaggagtctgttacctggttaacagtaatacaacttgtggttgactattttattcataaaatattttaatattattaaattaaaaaatacattgatgaaagagtatatgtttattatcaaaaaagtactaactgcaattttctcttataactatagcctcctctttagtatttggaatacttcattggtaaaaatagagtttacatacaactcatttattatgcaatataagaatattccctagattagtttttgaatatatacttactcacagctcaaaaatgccacttttrtttatataaagctcaaatttcacaatttccttaattatatttttggcaatgtctctccaaattatttctatcaactaactttaagatacccaataattacaaacattgatgtcctcattagaaagaaccaatgggtggctttgtcaagaaatcagagtagagtccaagctcagggttctcttaactagttatatgattacaggaaggacggttaacttctttgagccagagattcttcatttttaaaacagatgctacaacagctctataaactacctggaattgttgtgagaataaaataagatgaaagttaaactgatttgtgaattgtaaagcattatgttaatacaagttgttggtatagttaccatttttatcacatgtaattagtttcctggttaataaaaatacaaattagaacaaagtcaataatgtaaatttgtataataaaatgatttctaatatatcattaagtataatagtagaaaacataaagtaatatattttccagcttttataaataattttctctgagttttgaaatgatgatgttatctaagtatgttaattattaagaaaaaatactaacaattatattttctaatattttacatttagtttaaacataaaataaaaagataaattgtaattcaatcacccctctgagaatccaaagacaattttttgttatcttttagtaactaaaattggaagtagaaatagattatacttgagctttacaatacttagtatgtatgtttgcatttcttttattcttgttttaataatgttttcttaaattgttggtacagataattactataaaagcagtatccatgtgattattttcaaaaatctatatatatgaggttttttaaaaaagmaaactagttaaaagcattacatcttttttgaaactcagttaaaaaaaattaaaaaacctaatcagattcaaatgatctcatcagtgttcataagacccagtggtcctatagaactctaagttgaatttaatagcttatcctttgggaaaacgtccagactttaggatagtgattatcaaatgttattttgtaaaaaattttgtgtgtatcctaatgcaaagaatttctgaacccattttttttattttgaaamcttggttcagcacatttgaaaaaaagcctagaaataacttcaagaaacactagtttagggattgtattctgccaattcattataatacagggagaaatttatgtaggaggttattagatatattttttataaagcattgtgcacaattatgaacacttaaatggaaacagataacattaaataaatattaaatacatctaattttgatgtattttttcatctcatcaatattttctaacatcaacatctatgcttaatattggggctggaaattagtctctcaaatagtggattcaactgtttctctttgggatcttaaaattatctaaactctaaatgtttctttaacataatttactagactgtaagaagctattgttaaataagtgattcttaagccagtattactttctttaataacaaaatacttcttttcctgtatactagggctcaccaggagaacgtgggtcagcaggtacagctggcccaattggtttaccagggcgcccgggacctcagggtcctcctggtccagctggagagaaaggtgctcctgtaagtaatgtctaggagaaaatatattatgctgctaccctgtacacgttattactttttattcaataatattagcttttcatacaccaccgtattctctctgcatatgtgtctggcatgtaaataccctggctcgtatatgtataatagagaaaatttcaaattcaattaaatgagatgacattttcccacactttatgaaaccgtaatacctgtgagggagttggatattattaatgtaaaaggcttttcattttgctttttttaaaaaaaaaaagttgtgagttttttattgaagctataccttgctgctttacattagaaaagtgtgaactttttacacgtcttgtaatacaaattcaatttcaagcatttccatagtctgcaaataagactcatagaaagtagctgcccttctcatgtaatctgagctccgatcgccagtgagtgagacggggaacatctcactaattatttcatctaatatctattggattttaacattttttggggggggtttattatactttaagttttagggtacatgtccacaatgtgcaggttagttacatatgtatacatgtgccatgctggtgtgctgcacccattaactcgtcatttagcattaggtatatctcctaatgctatccctcccccctccccccaccccacaacagtccccagagtgtcatgttccccttcctgtgtccatgtgttctcattgttcagttcccatctatgagtgagaacatgtggtgtttggttttttgtccttgcgatagtttactgagaatgatgatttccaatttcatccatgtccctgcaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatggcagcatgatttatagtcctttgggtatatactcagtttatatttacatgactatggactattccactcattatgtttaggtttctttgttaagatttcttctctattttttttcctgcttttgatatgattgtattttttaaaaatgattctctcttcctacaagattaaaacacaaactgtttcagtaaatgtagataaaaagtattggctctgatacacaaaaatataagttgaatatttttgtatactggtaagtattgatatataaaattaagcttaagcttatattcaaaaatactcctctatcactaagacttcagttttatcaagttgatttgctttcattgtctatgcattttctttgattattctgtgatattattccaatatttctgtttgagaccattttgtgcagttataacagaataccacagactgggtaatttataatgaacaaaaatatattgactcatggtgctggtggatggaaagtccaagatagtggggccacatctggtaaagaacttcttggcacatcatcccatggtagatggagaaagacagggctrgagagagagagagagagagagagagagagagagagagagtaaaaagaaaacaaattccctttgttttaatgaacccactaatgcaataacggtattgattaatttcattttgccctcatggcctaatcagctttcattaggccctactcccccacactgttgcattgggaattaagtttccaaaagatgtttttttggtgacacattcaaactgtagcaaataaaaaaaaaatgttttctgtaatccattacctttcagaaagagttagaatgttggaatgggccatgccacctgtggatagaacttttaggtgacagaaaaagcacttttaatatgctgagaaaatatattttatagtgtactgtgtactaggagaagatagaaaatagattcagttcctttaatacaaattaattaaaaaatatagggaacacatattttgcacaatacactaaataatgcatacagagaaaatagacataaattgctttgtatacaaattgagaatatactaattagataagtcaatatttctgtgaagataatatattgaatggtagattttaaagtggataaaaaccttagatttatgaagaataagtaagttattgaaataaagatcagaatatcaaaaaagattgaaaccgataagaaattaattaggtgagacagatgaaaaattattgacattagcctttgtaagagccaggattcaggcctgagttttgttggtaattagtgatatcataactagagaagggaaaagggaatgccttgcytccccatcctctttcagttatcccagccaaggacaacaactccagcatgctcattccattttctattagccaaaattagctatttagaataactaaggggtaggcactgtattgttagcattatacttttgaaggagctgtctgcttagggacagtaacataaagtgggtaataagagtgttcagtgaaaggagttatagatatccattcagaagtttaataaaaactgatgaaaatgttgggcaaaatgttatatctagactttacttcttcctcttttcaaatataaattttagatcttacctctgctgagcagcttatcttataaaaatgttatgcagttatcagcaggtttacatttgcattaaaagaaaggcaagatgtgacctgtggaagacaagcccttggtctacctacccatcaaccctgcttcctagaatggagaaatgtcctaattagcatccctatattattaatcagttagattagaaactctaggaggtgggtctggaaagcaggtaagaagaaaggggctaaaaccttctccaatttaatttcattgatagaaaattttgatagggaaactgattctaatgaaaactattagttactggatgcaaagattacagagaagaagtgattttaactatgcatctatttggggacagttgtagaaattggggggaagagctagatctaaaacacagtgaagtcaatgcactaactataactgaattaggcaatarcagtttgaaattttaggaaaartattcttcaaatacttatttacaatttctagcatgtatgtgtgtataattgcagagaaaataatcagtgccagaattgtaagtctgggagtcatttaaaataagagtgatgtttaaaagcatatttttggattaccacgtgatgtagtgttgagagaaaacagaagcctggactcaagtcttaatggagaattakaatgggtgtaagttctgaaagcatctaataagagagaaaaatagtccatgagkttgttkgtttgtgtgtgtgtgtgtgtgtgtgtgtatgtgtgtgtgtgtgtatctccagaggcatgccatcaaacagaacaagacataaacaagttcccttttgtgggatgtaaaagatcgagaatactgaaatccgaaagacaaagaaataaagagactgggattttacctgctgggtatttatacctttagattaattctaaattgattcaaaaagaaaaaaaatggactatagaggagtggagtagggacatgtaaatcacctcaagcagggcatggaacccatagaaaaatgagccataggtggaagtactaataagattgaatgcgttgcctcattattattattatgtggtgcatatatttatctactttatcaataataagaaaatagtcagtggaaaagttaaggagttaaggaaatgagagtagactcaagttgcctgcttgaagacaaccagaagtgggttgggagctacccctatcatttatttagttcatgattttggttaagttatttaaaatcaaaacctctgttttctcaactctgaaaagaagatggccatctctgaaaagaagataatcacagtattttgtgaggactagataaaattatagttctaaatcatttttcagaattgtgataagttgtgagaagtgttcagaataatcattactattagtagtagtattatcattaccatcagtgtgtgaatcagagtgccataaaaaaggatgaaataataaactgagaatgaatacacaaatgagcttttgaggaaggagtgatggattttgtgaattgtaataaaagttgtgggtgtgagtataggttaaatataagaccatgccaaatcaaacaaaagacatggggatgtttagctaattctatcattttttaaggaaagatttagttattaacgtaaatggaatgttagaagtggtgaaataaagaacggttacaaggagagatgaatgtttccagtagttgtgcagattgtgggccaagagatacataatggaggaagagttatgtcatcttgaggaattataaatggctaatataaatttagagtgctgtagatctgttgaatttctcccaacatcacacagaccagggtcagaagaaatgaatggcaagtgattcctggctagagattatgtgtactatmatgaaggcagaagagaatatatctgccttatttacaggaaaccttatacaaaaggattgacttttagagtttaaggctagcaagggaattcaaattaaggggaactatctgaatcaactattgtatttaatatagtgaagtttactgtgaatagcacagcacatcctatgagtattgatagatttgaaatatcatatttatttgaagaagataaaaggtctccagagtgacatcaggggcatccttcttataataattatggcatccttttgaaaaacaagaacatatgaaacccaggcaagtaataaattagttaacaatttaattttgccttattaatgttgttacttttgttgtcattaattaagtaatgtagcaacagttccttaagtgactactctggtccacaggccagagatatataatagaatgcaaaatcagacacaattcctaccctcacatagtttattatctgatagggcaatttgataatatgcaaagaatcactaaatacatatataatggcaaactcaggttactcatatgaatggaatgtaatagtgtatgtcagattatagtagagagacctgctagaattggggactttccttggacaaggcattgatggtgagatgtaaaagatgagaaggaattaactatgcaaagagttctcataggggcattccaggccagaggaaaaaaatgtgctcaggcaatgtcacaggaatggacatggcatcagatttaagggactgagaaaaatgtctagaagggttggaatgcagagagcaagggttaggggaggctagatgtgtttgggcaggtagcaggagctagatcatggtaggctgccctaagccatgaagtctttatctgaggaaaagtaaacaagtaaattgacctaagaatgtaggtaacatgatctgattggctttctggatgcagtgtgatgaatagattggaaggaagtaagaatacgtatggggaaaggcaggaggtttttttcagtagctcagaacaaggataccagtattatagagtaaggtgtcagtgatggagataaagtcaatatattcaagagataattaggagataaaatgtctaaaactaagtcattttaaaggagcaggagatgttaagggaagtgagggaaagtggggtaatgaaaaggcaaaacctaatgacttgtagattcccagcttgtataacagaaggacagaaaggacctctgaatgcaatcaaaaatattatcttgtgcaaaactgatgaaattttgactcttagaaaataatttattttaaattacaaaaatatattttatcggaaacagaagttgagttcattatcaaggcacttttaaaaaattacacagtataggtaaatttaaacatgaaaataatgccatttttaaaaaccaggagaaccaaaacaaacacttaaaaataagaaagttacatatgaaacatataaagcatatggcaaagttggacatatgagcaactgcattttttgatttctaaagcctaatacccattgcacagctatgccagtggcactaaggaaggggagaagaggctcagcaaagttttgcaaatgtaagaaatctgatttgtcaatatataataattgcatgtttgaaagaaaaattctaagttgggtcctaattatttttgtgtatcatagcctaagatttataagtgatttaaaaaaatagtattcttagtcacaaatgaaggtagggaacatgtatcatttattctttaaaatgtttttctaaaaaacattaaacaatatccttgtcaaatatagaagctagaytattactcttgtagctgcacttcaaaactgtaaaattaatgatctttggatattcaatacagggagaaaaaggtccccaagggcctgcagggagagatggagttcaaggtcctgttggtctcccagggccagctggtcctgccggctcccctggggaagayggagacaaggttggtattcattattcrtgttagtagatcctgtgaaaaagcttaatttttgtcaagaattctagataattctaatctttatgattaggygccaggtgaaaggttacctttttcaaagtttcacacacattttcatatgctcaaaagttttatttaagaggttcagaattagtatctgttccataaaatagtatgtgatacataaacagaaaactcaattaaaagaacagtggtagtgagaaaaactagtagatgccaaaatttatttatttttaagaatatccttctgaaatgaatataaaataaaaaaattaattacatgtatatggttagtcctcatgtcttggatattgtacaataagacttaagaatgagctacatatttacttcataatcctgttatcatttaccaacatgtgagtacagactctaagctcctaattccaaatgtatggctgtgtgttaaatgtttcaattgaatacatcattatattattttaaaatattatttaaaaatttttaaacsagcactctsataatgtgcatcattttagcatctggaaaattagcagaaaagaattttttccattattttgtttttatttttattttttacttttttgagagagagagtctttttttgtcgcccaggctggagtgcagtggtgcaacagggctcactgcagcctcaaactcctggacttgagcgatcctcccacytcagcttcccaagtagctgagactacaagcatgyctcaccatgtgcagctaactttttaaaaacatttatttgtaggacagggtctcactatgcttcctaggctgatcttaaactcctgggcccaacctttcacctcaacctcccaaaacctgggattacaggtgcgcgacccagaacctagctggtaaagtaatttttgattaatgtgtaattatagattttatawgtcagtgtatttccgttaccagtttatacaggtaatatttgagacaaaattgatttttgaattataaattcagttgtagtatactttgaagttaaacggacttgtctgttaacatattagtcaatattagaaagctagaagcagtgggaacccaagattttccattttaaacagtgacattacacactagcatgtaattatattaaaggtaaaatttaactgtttgatgataattaagacaatgcaatagcatgttagagataaactctaagtcaaatctttcaatttcagggtgaaattggtgagccgggacaaaaaggcagcaagggtgacaagggagaaaatgtgagtttcctacttcttactgagagaacattatttatttaacaacttttactgtttaccattgatatttttatatagtgctacttactttcctagccaatacttataataccaatactacattacctctgcagttatatcattctataattttatatatttgtgaagttttctatttctgtgattaagtaaagtatgatgattgtraggccattatttataactctgctatagcacatgaaagagtaacataatgaaatagtctttyttgtatgattatgagaaattttgtatacatatatttaccaaaattaacagtattactatgttctacatgtatacaaattggtcactyattcccatatgttataratacttattttaaaatttttcrtttaaatcataaaacttcaatataattttggttgttcattcaaatggtgtgttcactcttgtctttatgatgtttttctttggtcactaycagtatatattctctttaaattatgtatttaaacatgttcctacttcttaaatgaaatatgttagatgatgatactgtcacatgcttcagcacttccttactaatttatactctctaaagaatatctgtggacattattttctaagttctttttttttaattwwtttttccctttaagtgttcatgtatttgctctctgatagaaacataaattgggggagtacagagatatgtccttcaagttttttttttcacctagtatggaagtttatacattatccccagcaatttcattctaacagaccagtctggttctattttgtgatccatcagtctgatgcttttagggttggayttactgcctacattaacacataacggaaagaagatttttattagaattgatggaatcccaaactgaagagttaccatagtcctatgagatgaatttttctaactaaaaagaaaacwctagaatgaaaagagaaaaagcttgtagtaataattgtagtatttaatgcataattcatttttatatgcagtraaacaaaacaccaacaaacaggtgatagcactgatactccagatccatgctgtaaaattatgacaagaaattgtgtacagaaaaccggctgcatatgtttgatgcagttagtattgactatacatttacaaaatgtattttggtatctgccttagtctgttttgtgttgctataaatgaatacccgaggctggataatttataaggaaaatagggttacttggcttacagttcagcaggttgtacaaagaagcctggggctggcatctgcttggcttatggtgagggcttttgtactgtgtcaaaacatggcagagaagttcaaaggggaaccgggcctgaacaaggagggaccaaaccctgcaggagtgctgactttaaaacaaccctctttcatgggaactaattcattccttcaagaaacaattcaatctccccagagcaagaactcaatcgctatgcagctattcctgatggatccaccttaagaaccaaaacacctccatttaggccccacccccaacactgggaattaaatttcaacatgagttttagtggggacaaaccacatccaaacgatagcagtaaattactttagattccatttagatttcttaattataaataaatactatggatttaattagactaccttatacactcgacagaagccacatttttaaaagttttatttactccttaaaagcaatgctaaaatgactgcatggccattatatgggccagcaaatctcaaatatttttgccttaggacccttgcatactcggaaaggtttttaggagcccaaaaagcttttgtctatgtgggttrctatcatatgaatgaaagctgatatatttaaaatatttatgtattgatttatttataattaagaataataagcccaaagcacttttaataaaaactagctatatttttgcaaataaaaatatatagtcccaagagtaccattgttacatttgttttgtctagcttaatagaagaagctatattctcatatctagttcagcctgtggtgacatgtttttttggttgaaagcatgaagaaaatctaagctcacataaattatgtagttataaaagggaggggcattttcagtaccttttcagataattttgaatattctttgattttacatagaaattttataagtggtagtttttcttaagggtcaattgcacaacagaatttgaaacaaaaacagtgagctttttgtgctattacattatattccactgctctatcttgcacgttgatgactatgtttcatacataattttgtaatatccttcattgataatttggaaattattgatttcctgggtaaggtcctcaaagtgttgacacaattctttatgcratattaatatcataggaaaatactttcagattgggaagatataaagcctgcaatggcagatgagacatttccaaaattctaatttttgctttaaagtttgaacgttattgacagtaaatactgtcagttgttttctttgaaatccaaggcttcctttatattgaataacatctgccaaaatcatacttactatttataatcacacttattatttataactgattatttataatcacatttattatttataactaaaaaatcatagtttttctgtcagccgctctttcaagtaaaaatagcgttccatgtaaaagttagtgttccatgtaaaagttcagccagcatttcaaactataatccaaatgtttgtagggcttttttttttttttgagacaagcactgtacttcagtatgaggcaaacatactttatgtatgtcttcartttgtcaaatgaatatgaaaagacacatattcaaggtcaatatttaataatattaataactttcaaagcctcatcaatacaattacatccatgacattcttagatggaacagccatttttgtgttgattgaaagtatatcgtggtaaaatacaattaatgctattacaaatggtagctaccaacatgataagcgctaagttaccagcaactttattcaccacggattttacatcattagtgcaaaagtctatatagttaaaggacaaaaaatgccttactgttgttatgagaagagttatgaactagcagaatcctaaaagcatatcaagaactcccaatggcccatgaaccagcttttcaaaatcttgctttaacagttcccccacaagtagtagttacaatacagaacaatacagttcaatgacagttttatttctttaatgcctgaaccttttatattgcctgacccgttactaatgtaagaaaatgagacaatgaagaaatatctatgcatgtaagactcataatgtcttttgaaaactattgctcaaaataagaggtcctggtgtacttaatatataacaattagtttacatgtgtacgcatatgtgaaaattccaaattttcatatattactacattctatctgtatagaaccctcagaattctgatattcactcagaagacagtatatagacaattttttsatgggccctttcctaatcatatttatctcattaaagamatctgatactttgaaaattttcaaatgcgaatcttacaacttgatgtctgatagcatagaaatctatcttgaagattcacaacattacaaatgagagtgttttcaacaaatgtcaacttaaaattgatttcaaatgtgaaagcttgagtctcaaggagtaaaataaataatgattgcagtaaatgcaaaataattctatgtgatgcttctttttttccaaaggagtgcagaagtgtttgatcttggtaggctaaatgttctgtttcatatggctgaggctcttctggcttcactttaaaaattacttatttttatctcactgcagggccctcccggtcccccaggtcttcaaggaccagttggtgcccctggaattgctgtgagtattccacattgttcagcaaatctaaatccttacagctccctgattaaatttgtatactgtcccataaccagtcaattttgtggggtaataagttttgtttgtatgtttgacattaaawyaaatttaaattatcaaatatagctagccgtgctgattcttagaaacaaaacatattgtaacttcatttgaaagtaagtaataatttgttgaraattccttaatagataataattcagaaaattatttccgttattagacagcttttacttcacttggyatacaggatcaaatcaaartcagttatgatccagaagcaaagaaaataagcaaaacaaacaatagtatattggagcagataatgggcattcagtctactttttacttggttattcttaaatacatctgctttgattaaattagaaatggccacattttttaatgactcatatcgtaatgattttttccagtttgtgataatgtttctttctcttctctagggaggtgatggtgaaccaggtcctagaggacagcaggggatgtttgggcaaaaaggtgatgagggtgccagaggcttccctggacctcctggtccaataggtcttcaggtaagatgatcctgtcattgtttactccatcatttctacctacttctcaccaggttttctggtggatgtaaaacaaagtatttttttctttttttctaygtaagaacttgggtacaatgtttatccataaagatcattttatttttaaatgagcagctgaacttgaaatcattttatcatgtatgattaattctcctgaacatgtatcagccctcgctcctgattctggagtatttttagacccaccttaattattacacttcctttcttcactcccattttgtttggaaaatgaattacaaccttgcctaagtctgatacttaaaagtaagataggaggagccaagatggccgaataggaacagctccagtctacagctcccagcgtgagcgacgcagaatacaggtgatttctgcattttcatctgaggtaccgggttcatctcactagggagtgccagacagtgggcgcaggtcagtgggtgcgcgcaccgtgtgcgagccgaagcagggccaggcattgcctcacttgggaagcacaaggggtcagggagttccctttctgagtcaaagaaaggggtgacggactcacctggaaaatcgggtcactcccaccggaatactgcacttttccgaccggcttaaaaaacggcgcaccacgagattatatccggcacctggctcagagggtcctacgcccacggagtctcgctgattgctagcacagcagtctgagatcaaactgcaaggtggcagcgaggctgggggaggggcgcccgccattgcccaggcttgcttaggtaaacaaagcagccaggaagctcgagctgggtggagcccaccacagctcaaggaggcctgcctgcctctgtaggctccacctctggggggcagagcactgacaaacaagacaacagtaacctctgcagacttaaatgtccctgtctgaaagcttttaagagagcagtggttctcccagcacgcagctggagatctgagaacaggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaatggaacaaagctggatggagaatgactttgatgagctgagagaagaaggcttcagacgatcaaattactctgagctacgggaggacattcaaaccaaaggcaaagaagttgaaaactttgaaaaaaatttagaagaatgtataactagaataaccaatacagggaagtgcttaaaggagctgatggagctgaaaaccaaggctcgagaactacgtgaagaatgcagaagcctcaggagccgatgcgatcaactggaagaaagggtatcagcgagggaagatgaaatgaatgaaatgaagcaagaagggaagtttagagaaaaaagaataaaaagaaatgagcaaagcctccaagaaatacgggactatgtgaaaagaccaaatctacgtctgattggtgtacctgaaagtgatagggagaatggaaccaagttggaaaacactctgcaggatattatccaggagaacttccccaatctagcaaggcaggccaatgttcagattcaggaaatacagacaatgccacaaagacactccacgagaagaacaactccaagacacataattgtcagattcaccaaagttgaaatgaaggaaaaaatgttaagggcagccagagagaaaggtcgggttaccctcaaagggaagcccatcagactaacagcggatctctyggcagaagccctacaagccagaagagagtgggggccaatattcaacatcttaaagaaaagaattttcaacccagaacttcatatccagccaaactaaccttcataagtgaaggagaaataaaatcctttacagacaagcaaatgctgagagattttgtcaccaccaggcctgccctaaaagarctcctgaaggcagtgctaaacatggaaaggaacaaccggcaccagccactgcaaaatcaggccaaaatgtaaagaccatcgagactaggaagaaagtgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcagggcttgcaatcctagtctctgataaaacagactttaaaccaacaaagatcaaaagagacaaagaaggccattacataatgctaaagggatcaattcaacaagaagagctaactatcctaaatatatatgcacccaatacaggagcaccaagattcataaagcaagtcctgagtgacctacaaagagacttaactcccacacattaataatgggagactttaacaccccactgtcaacattagacagatcaacgagacagaaagtcaacaaggatacccaggaattgaactcagctctgcaccaagtggacctaatagacatctacagaactctctaccccaaatcaacagaatatacatttttttcagcaccacaaaacacctattccaaaattgaccacatacttggaagtaaagctctcctcagcaaatgtataagaagagagattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaatgagaacaaagacacaatataccagaatctctgggacgcattcaaagcagtgggtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagacccctagcaagactaataaagaaaaaaagagagaagaatcaaatagacgcaataaaaaatgataaaggggatatcaccaccgatcccacagaaatacaaactaccatcagagaatactgcaaacacctctacgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtgcaggaccagatggattcacagccgaattctaccagaggtacaaggaggaactggtaccattccttctgaaactattccaatcaacagaaaaagagggaatcctccctaattcattttatgaggccagcatcattctgatactaaagccgggcagagacacaaccaaaaaagagaattttagaccaatatccttgatgaacattgatgcaaaaatcctcaataaaatactggcaaaatgaatccagcagcacatcaaaaagcttatccaccatgatgaagtgggcttcgtccctgggatgcaaggctggttcaatatacgcaaatcaataaatgtaatccagcatataaacagagccaaagacaaaaaccacatgattatctcaatagatgcagaaaaagcctttgacaaaattcaacaaccattcatgctaaaaactctcaataaattaggtattgatgggacgtatttcaaaataataagagctatctatgacaaacccacagccaatatcatactgaatgggcaaaaactggaagyattccctttgaaaacgggcacaagacagggatgccttctctcaccactcctattcaacatagtgttgaaagttctggccagggcagttaggcaggagaaggaaataaagggtattcaattaggaaaagaggaagtcaaattgtccctgtttgcagatgacatgattgtatatctagaaaaccccattgtctcagcccaaaatctccttaagctgataagcaactttagcaaagtctcaggatacaaaatcaatgtactaaaatcacaagcattcttatgcaccaacaacagacaaacagagagccaaattatgagtgaactcccattcacaattgcttcaaagagaataaaatacctaggaatccaacttacaaggatgtgaaggacctcttcaaggagaaatacaaaccactgctcaatgaaataaaagaggatacaaacaaatggaagaacattccatgcaaatgggtaggaagaatcaatatcatgaaaatggccatactgcccaaggtaatttacagattcaatgccatccccatcaagctaccaatgcctttcttcacagaattggaaaaaactactttaaagttcatatggaaccaaaaaagagcccgcattgccaagtcaatcctaagccaaaaaaacaaagctggaggcattacactacctgacttcaaactatactacaaggctacagtaaccaaaacagcatggtactggtaccaaaacagagatatagatcaatggaacagaacagagccctcagaaataatgccgcatatctacaactatctgttctttgacaaacctgagaaaaacaaacaatggggaaaggattccctatttaataaatggtgctgggagaactggctagccatatgtagaaagctgaaaatggatcccttccttacaccttatacaaaaatcaattcaagatggattaaagacttaaacgttagacctaaaaccataaaaaccctagaagaaaacctaggcattaccattcaggacataggcacgggcaaggacttcatgtctaaaacaccaaaagcaatggcaacaaaagccaaaattgacaaatgggatctaattaaactaaagagcttctgcacagcaaaataaactaccgtcagagtgaacaggcaacctacaaaatgggagaaaattttcacaacctactcatctgacaaagggctaatatccagaatctacaatgaactcaaacaaatttacaagaaaaaaacaaccccatcaaaaagtgggcgaaggacatgaacagacacttctcaaaagaagacatctatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttgrtgggactgtacactagttcaaccattgtggaagtcagtgtggcgattcctcagggatctagaactagaaataccatttgacccagctatcccattactgggtatatatgcaaaggattagaaatcatgctgctgtacatgcacacgtatgtttattgtagcactattgacaacagcaaagacttgraaccaacccaaatgtccaamaatgatagactggattaataaaatgtggcacatatacaccatgaaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggagaggggagggatagcattgggagatatacctaatgctagatgacgagttagtgggtgcagcacaccagcattgcacatgtatacatatgtaactaacctgcacaatgtgcacatgtaccctaaaacttaaagtataataaaaaaaaaagtaagatattagaagggtcctctcataggactcataacaagataagttagtacttcagattgatagcaataggaggaacacgaagtcccaggcagacaggggcggatctggagacactttcgcttcctttccccggagaaactcgacctatgactctttactttcaagatggctaaaaaaattgaaagcattttgagaaataggatcctgccaaaagcaactgccaacagcacatgttaaacaataataggtaaaataaattaagtcgatcatttaagatcgattattatcattttaaaattgtaatttgaattttatgaaacatatccaggaaaataaatattaaattgtagaacactacagcctctgttcaaatatatcttacaattggactcttaaacaacatgttccagaacagataccttctattctgggtttttggttttttttttgtttttttgagacggcgtctcacgctgtcacccaggctgcagtgcagtggcctgctctcggctcactgcaagctccgcttcccaggttcatgccattctccggagacggggtttcaccgtgttagccaggatggtctcgatctcctgacctcgtgatccgcccacctcagcctcccaaagtgctgggattacaggcgtgagccactgcgcctggccgtattctggcttgtttttttaccttccgcttgatgttcactgcttcctataaaccttggaaacgttgagcttttttcttccacttgcttattctgtctcttcctagtgatccacggaaagattatagcattttgtcttaaatgatattgaggtcccacatgagggtaacttatggtatattatttgtattagaaatggtaaattaagtcatctagttcactgaacctagaaatttgtgaacttgtagaaaagcctatgtaaattgaatttatataaaaaatttgtatctttattttwataaatatgattataaaattactgtgttgatattaaatatcttatgtgcataattacacaaattgcatcatgaacacaatataatgaattattactgttaaaacacttaataaatgtttatcagataacaagattttttatttatctcattttaaggtcaaaataattctttttaaacttggagagtgcaaaaacttcactttcatatttgtcatgtttaggttatacttgttagacaattatacgtaaacagtcataagtaccacatatcaatatgtgtgtgaagcatacatatttgaaaacaaggcattaaaattagattgtcaatggktacattaatattcattttcttttttttatttgactactctgaatcctataaaactgtaatttagaaacagttctcatgattaaagtaggtgtcttgtagattatgtttataaaatattcaataaacatcatcttcattttcacgaagaaatgtgctctttgatgagggtgactcaagaaatcaattcatttaaaaaagtgattgcattttcccacagctacttctgtaaatcaggaaactgaatgatgctaatgtaattaacatgttcacaattgcatctgcctcctttaattgagtcttcatggcagaatagatattagcaattataatagacataaataaaataatctaatattcaggttacatgtcttgatttttcaatttgatgtttactgtcatctgcatatgaaggatatatacacacacacacatatatggagtgagagagagtgtgcattcttggcctaacttcatttttcaactcatcatttaagtggcaatgattttaaattgacagaccttaaaacagaatctctccacgcataaattacctctttggagaaaggtaggacatttcatgagaatggattaaccctagagtgcttttcagagtgtttagttccatgcaacaagagattttgactcattgtgtctccactaattgtaataataataattttttgtcttaatcaatacaaactatgatctaactgaattaaaaataaataaatttttttctattgggatatttttattgaactaattggaataattatatgcataaaaaagatgaaaatgcacaactgggtttgtaataaaaaaactgtgaattaatattgacataccttttaatttggggatactaaattagatgcactctatcctaaaagggtgtgaaaacctggacaaaaaataaggaatgtaattttaaatttatggtgtttttgraaacttaattatgtttaagttgcagtgtatgctatttaagaaaatggtgttaaagtgaaatatttatttaaactgtgttaaaatatacatgcatgtttaagaatttaagtttatgtgtttcatcaaattcagattttgaatttctgaaattgactgatttagaacctaaaattttttgcagtcacctacaatttttaggtctataagatctgagaaatactacctgtctttttcttccagaaacttcacttataattctagaaacagtcatcagatgatggtaacagtttgggaagtatatatagcagtctcttttcttagacatcttactgacatttgagaaaaaaatgaaattctggtacatattttttgttacaaattagtaactaagatttcctcataaaaatgaatatatgccacaattaaacaaatatataaatatattcagtaaagttccttctttacaaactgaaagtcatgtggatatagtaggttataaaaaaattttgtggatcattaccagcattgaaaaaatgaaatagaacatgataaggtaaaatagaatgaaaatatcaaaggctatcatctatgcaaaaggctaagtactgcttttttgaaactcatgtttcagctactttacatgcgcatggttagggagcattaagtaaaatacatttttcacagtggctcacagtcaaataatattcagcaattacagtgcagtgtcaagaagtcagtaatgtcacgaaagtactagcagttatttagagcttttacattgtatttttatgtctaaaatagattacatctaaaatattatgcaaacattaaaaattaattatgtatagcatatataagatgtattaatatataaataattatacactaaaaacatgaaaaactgaaaaaaatccataatcctacaatattagaaacgattactatgtttgctatttgtctgataattagcatacctattctacctacatattttacagttaaacttatgcatattcatttgtattttttatttgttgtatatattattcatgtttagagtattagtatcacattaatagtcacataacattccactactttatgtaactgaatttctttagttcttttttctaagattaaacttttggaatgacaggattttcagtatcatagctactgttagcaagaaacattttattgaatgtagctatccttattagtttattttcttagagttcattcattcaacaaacattttaatttttgattgctcctctgctagttcctaaacagttaacacctaaaagatcactgatgaatgcatgccccagagtagttcatgactgtaaatatacacaaaagtgacataagaaaatttataaatgtacaattgaagtatgtacaaagtattgttgtgacatgaaagaggaaataataatcttcatggaataatttttgggaagatcaaataagtagtcaagaactaaaataatttttcggtgaagacatagacagatgaaatttgagtgcaatctttctgtcttcctttatactgtaacacagagcttttcctaaatagcagttacagtgcaattgaatacaatggaaatagatttgaaagaatttttttgtcttttggagacggagtcttgctctgtcacccaggttggagtgcagtggcacgatcttggttcactgcaagctccacctccggagttcacaccattctcctgcctcagcctcccgagtagctgtgactacagtcgcctgccaccacgcccggctaattttttttttttttttttgtatttttagttgagacggggtttcaccggtgttagccaggatggtctcgatctcctgacctcgtgatccgcccgcctcagcctcccaaagtgctgggattacagccgtgagccactgcgcccggcctgaaagaatttttaaaagtataatatagtaggtttcatgggctcattgatttgtaagattcagaaattgaattaacaggtcaaaaattcagaagatatttataacctttgaaatgtattggaatatttattttaccagactggtacctaactataaaaacctcatatactaaaatattttgagtcaaaagattccagaaatctgtaccagggaagttctatatattatttgtacgggactgagcaaatggttgggtgttcataaattcccagatcaaattaatatttagttattataactaaaaataaacaatataatmttatacaaaacataaattttatttgtaaatgtaggtgtaagattttatcacatgtggtcaacatttgcatagtaggtattttaacaaatgttagtatctgaatcttaatttccatgtacttattgaactttatacttgattttatcttagaaattgaccaaacttttttttttaaagacatcagtgacttttattatttttctattatattttcttagggtctgccaggcccacctggtgaaaaaggtgaaaatggggatgttggtcccatggtaagtttttatttttggtgtttgatgggtatgtgttatatgcatggcagtcactggtttgtaaagtattatgtgttctttcattactatgtatatattattgaggtgtatataagcaactgacatgatttagttatatattagtctttagctctggattttgatttggagcaggtagagaataggtaatattcactcaagatttagataattagcaatttatacagaatcaaaaattaactactttgaaacaaattcttaatttaataattctgtcttaattagaatgctatgacttataattatttgcatttattgattctggctctctaagacctgaactgaaaatttgaaatgcatataattgtttatgaagcactaccttagataagaaaataattagcaaaggtaattgaaatccataatgaaatgtgatgactgcatgtcttaagtggccctttccttcaacattgcccccaattttcacttccttcaaaatacacattttgaaattttaacacttgtctgttaggttttattctccttaggaattacactcaaatctattatattctttgaaatgatccatatcatcattaataaacctagatataagaaatgcataaaaaactttgctggccgggagcggtggctcacgcctgtaatcccagcactttgggaggccgaggcgggcggatcacgatgtcaggagatcgagaccatcctggctaacacggtgaaaccccgtctctactaaaaatacaaaacaaaattagccgggcatggtggcgtgtgcctgtagtcccagctactcgggaggctgagacagaagaatggcgtgaacccaggaggcggagcttgcagtgagccgagatcgcgccactgcactccagcctgggcgacagagcaagactccgtctcagaaaaaaaccacttttctgattcaaataactggttaatacttccaagcagtaacagatacatagcaagttcctttccagatatggttaccatcgttccatgaatcattgatatattcttcctgattacacggtagtagataataacagaaaagcttttcaaccatggcattagaataaactgagatcttttaaaaatactaatgtccagtgaaatgtactaatgtacagtgaaaaacaaattcgctgtagactattttaatcacaactttgagataggagtttctggcatcagtattttataaaaagttttccaagttaattttactgcactgtcaggagagaaaatctttgttttacratgaaattaaataattattcttatttctaattctagcatatagaacctaagagttgacatagaaaaagctaaaaatacctatcaacaaaaaatacttctattgagttaatgaattctaattctattcaagcaccatttatttttccaactttacattctctttatgttgtaacatattctagcatgaaatatatctagttatattgtgaacacattataccagacagtagcaataggctttcttggcccattttctaatcaaattgtttctcttgaaatcctaatttcctcatagctatgtgtaaaggctcatttgctaacatgatgttgtatccatgaaggatgacttataaccctgatgtgcttcactaactatagtttttacaagcttaaacttcttttagatttttcagtcataaaatgaaaatgttggaaacacatttgaatttggtctttgtaaacctcaatatttctctcttacaggggccacctggtcctccaggcccaagaggccctcaaggtcccaatggagctgatgtaagaactctgaaatatatgttaattattttgaagttatataggtattgttattttatagcagatgctctttgtgagttataacaatattaaactattgtttaatattaagtggttaagaactcaagggtcacctattcactccactttattatacaatgaaataaatggaatttatagtgaacaaatcatggaaaatgtaacataggtacacattttccattcaatagatatttactggtgactgagaaatgttataatgttgtgtatattaaaattactacattgttcaaaccaacatacttagactgtgccttgcatatgataactcttatgcacttgttaacagtggctttcatgtaaaagctttgcattttgtattttcagactatataatgttacagcaatatgtgcgtgataggtgcaccctttatcatgtaaaatgttttctcttaattgtataaagatgatattctccaagcttaaaaattattttaatgttataagattttgaaatataatgccatatttatcttactgttaccattaatggatccatggctttgatgatatttttccttctggccaacttttcacaatgaagaagtctatgtttccttcatgtctctggtcttcattttcttcattatttaatatctgctttaattctggcaggccagaactgagtaaaaatagactagaaagagaggaattaaaagagtttttagattttcattcttcttaggtaatttaaaagctaaaagatgttataaggggtttgtttcttgcgtggattatgtaattcttaaccagkgtcataattttgattcactacaaaatcaccgcctaaaaccaatctgactattctattggcaaagagattgaaattatgtttcaggaatcaaccagagtttgaaagtctcctgctttatcttcaaaattatagtgaatttgaaaatcagtgtaatatattgaattatttgctttccaacacatttgacaattctattaagcatcatttagtctcattctttaaatgactaagaatactcatgcatctatttctcttttttgagaacaactagacatatgtttacgaatgcattattttaataagaatatggataattacattcctttttctacactgcagggaccacaaggacccccagggtctgttggttcagttggtggtgttggagaaaaggtaaatatgttagtgacacacagtttgaaacagcatgaattaagaactgtaataatattgggtagtagtttaagtscttctagtatgtgtgtttctaagccttttacatagttatatgattcacatgtcatctagtagttgcaaaaattaaagttaaaatgattttgcaatattgtgttttggttgccaattattatattgaatgagtgcaggyattatgttctttaagcaggaacctcacaattacggtgtccttaatatccacatttataagctgagaaagctgagccctagaggattcctgtaatttcatcaaagattttccttagaaagtgactaagctaggatacactgcagtccatgaatgtctagtaatagtactcaaaatagaagagattggttgatgtaactgacttaaagggaaaaaggaatcctgcaagccacaaaggaatgaatcattcattttgttatattttgagttatattttcattaygaatactctgacctatccttgtcacttgtcaaaatatttggcatgaaccacaatatctgggctcagaatagctttttttttcttgtgaacatgatttcatttaaaggtctgctcttccttttataaaaatgtcaaaatgattcattgatttcttatttatgcattcatgctcacttcttaatagaattttcaagaaaattatcatggatatttgcgtgctttaaaaaataaactaccaattttcagaaagggaagaattatatttataacatcatatattatgcagtgaaaacactaaaaaattccttaatatgctacttgttaaaggatatctgcagtgtagacttactctattcttaaaaatgatttcctttcttggtctcaagttttttgtgtattttatattatatttaaatttatttcttttaattaaagcatttaattctcagaaaaatgtaataagattagattgttattatattttgatatctacttcagcttgacacctgtattctagtattttgattataatcattatttgattaagataatttttaactcattagataaatcttactgcattctttgattgactgccttttttaatatattcttaaatttaaagttgtgtgttgaaactgttccagtagttggtgttgaaactgaaaacacacttttcattccattcagttgtcctagaaaacatttttcatcttgcttagtctcctatgggagagcacttgtctctgaggatatcatcagrttagacaaaaggcaccaaggcacacaccttttcctcttctctttgcatcatctccttttggctctaatgctgactcaattgttgtgggagctagtctctaggattattagcttttatcggcttatcttgtttcctaaagaatttgaatgcagagggaaagttgtcattatttcagtgctactcttgaaaataggcatgaatgccaggtgtttagttctgagaaacttccttccacattgtttccatttaatttaaagcctatgtatattatagtaacactttgccaactttgactcttatgagaataattcagtcaatctgaatcattttgaatcaatcccagtcaaaatgagttacactaaaaaacacagttttaattttgctcctttcttttgatttttttttatgtgacagcacgatagaagcagaattctaaccttcatttttttgtttgtttgttttttgttgttgttgatgttttttaatcaagaatagtataatttctaatagattacaaatttctaacatcagctttgattctggctgaatgtatacccatttytaattggaaaatttatttccagtcactgacaatgaagaataaaaaaaccagtatcttttagtcacattgcattttgtctaaatatatttaacctgttcttcatgtactgtaaaattgctataaataacttttgcacttcactaattttgtcaatacttggaaatatgtcaggatattttcttaagatttatacatattttataactttgtacatacagagtaatttgttgttctttctgaaaaaatatgtacctaaacaagtgctttatataatgaggtaaatagttacacgataagtgatgaagacttcataatctaacatctccttcatatatcagtgctctatcataaaacatattaattattattcttcagaatgaatagtttgtagcattttggtattagaaatatagacttaatttatataacattagtcttgttgcaatgatttattgatttgtgattttgtcccacctttcttttaaatgaaacattttagataaattttaaatttcattttarctaattgtcattttacattgtgcacacttggatctaacatactaaatggtagttttcatatattttggacaaatgaatattaatatattattctaaaaatgaaactttgtagtaaaaagctcatactttttttgaagcagaatatattttaawwtttttatcacctcaagcatttatcattagaaagcacatacataaattctaagattatttaaacctatctttttaccacatatcatttcactcatttaataaaaagaaaataatcttttcacaatatccataaatttaactttatagttgataagaacgaaaagagaacaacaaaacatatagagggttactacgaaatatttcaactatttcttctgcatttctaactttctgtgatgttaccatgaattaatgtggtacataagaaaacattttggttatttcttttgctgtgcagaagctttttagtttaattaaatctcatttgtctagttgggggtttcttttgcctgtgcttttgaggtcttagtcatgaattatttgcctagaccaatgtccagaagagttttccctatgttttcttttagtatttttatagtttcaggtcttatgtttaaattcttgaatccttcttgagttgatttttgtatatggtaagagataggagtctagtttaattcttctgcttaaggcaaatcagatttctcagcaccatttattgaaaagaggatcttttcctttttgtttttgtcaactttgtcaaagattagtttgctgtaaatatgcttttttagttactacagccttgtagttgaatttgaagtcaggtagtgtgatgcctccagttttgttctttttgcttaagattgctttggcaataagactctttttttggtttcctgtgaattttaggttttttttctaattatatgaaaaatggcatgttcaatgtacatgctcaatagacttatcatatttctaaataaatattttaacatggacattttacaattgatttcaatgccaaactacttgtttcatttttaagatatgaatatcagcccttggaaacatcactaacatcattacattctactgagatgaatgatacctctctttataaataatataaatgcaatttttttttgtaagagttatccaaaaattctggaagtatttgctgttcatcttgagagatgaaataatttacacatcacactacttataataaactctggaaaagtacttgatgtctccaccattaagtgggtaatttaagaatttaaaatatttgtgtattctcacagtaagaaactatgtacacaaaatagtctctgccctgaaattatgtttgtatgtaatatgacacatttatttaagagcagtggatttgtgtcaggaatattggaaatattagagttaaaaagtaagggaaatttaggcctcacttctttttcaatttaaaagaacaatttccacctcacaattgctgagaccactagtgtgactgattttgagtggaaacatggtaaatgaatgtaytgttttacttaaatgattacttgaacaaratgttatatttttgtgcattttgaattgtggggcattagcaacagactttcatagctaaaccctactagttacagagatttatttattagtccactgggctagaaaaaaagccattcatatgtaaacagggagataataaaggctatcacatttatgtgtatactcaaatggagcaattttaattaacgtctaagtacctttacatatattataattattgtctttcctctaagttctttagattcctactaaacaaatcctataaaatatcaacatatgtaccagcaagtcatctgttgatttgttgtagttaagataaataaatttacattttagcaaacaacaatttgaaagtgttcactcaataaactttattgtaatatgaatattgacacagtgcaaatacacaatattttaggaaacatgcatatgtctgttatgatggttttgtggtaatctggattaatatgccaactattaaccaaccagtgacaactacagcatcaagcctgcatatttctgtctactcacctgagaaataaaagcactggagtcactgatagaaaaatttatttttgttattaaagtttttcaatgccttttaaataatataaaaaaataagggctaatctaaaatgatatgataacatttgaattttataaatgtaaaagatcatctctgtattctaatactaatttgatcttctctatatagggtgaacctggagaagcagggaacccagggcctcctggggaagcaggtgtaggcgtaagtactgtgttattgttaacatagtgtattattggtttgggaatttcttttacarcattacaaacatgtaacaactcttagctgtggttcraattttactttcccttcccaactcattaaggaaaatcacaaatacaaagccttgtttaataactttggatatctttacatatgtggattgataaacaaattgaaaaaatatcatatttgctgaagttagaacattaaaactatgggctgtttactgtatacattccctttgatgaactgtccataaaaggaacaaacaaagaagtcctgctgccttaaataaacgtgtcaattgtattgtgactatattattctaattagtttaaaacgcgattaaatttgcccaccaggaaatatttgacaatatctggagacacttttggtcttcaaacgtggagggttggtatccagttagtaaaggccagggataccattggacttcttaaagggcagagaacagctccccacagcaaaaattgtctggcccaacgtggtaaaaccccgtctctactaaaaagtacaaaaattagccgggcctggtggcgcgtgcctgtagtcccagctacttgggaggctgaggcaggagaatcgcttgaacctgggaggcagaggttgcagtgagctgagattgtgccactacactccaacttggtgacaaagtgatattccgtctaaaaaaaaaatatattctggcccagtgtgccaaggttaataaacttttatgcaaaacttgtaagataactcttctttccttcttcttctttttttttttttaacattgtttagggtcccaaaggagaaagaggagagaaaggggaagctggtccacctggagctgctggacctccaggtgccaaggggccaccaggtgatgatggccctaagggtaacccggtaagtgagtttggtcccctctaatgtggcatttatgccaaactcaccttggagcttttcttagaaagatttgaaatcctgagactctggaacrtagatggtaaatctgacttttcatcatttcatatattygtaagcattctcaattgaattaattctttagaaattttttggcgggagaagagaaatattctcagcaggttttgtcatgactttaacctcttcacctccagaatgtcataattttataaaaatttatttttcatttatttctttttctttcaaaacgtcattctagggtcctgttggttttcctggagatcctggtcctcctggggaacntggccctgcagtaagtatcagggaaaaatcaagaaattattttggagkgaatgtttccaatttctgtattgttaataaagaaaaaaaaatctaataacctaagtgaactcccaaaaacagaaagaaaaagaaaacataaaaagtaattgcaaatgyaggaaaatccatatagttggagactattgcaccaacactaagtgattaagctcttcatgcaacataggtacaacaattggattagattcctagactttgatgggttgtaaaaacaagttatctgagtagcatcattattattatttcaaagttacaggatctttgcttttctgtttctcttctataatgcaaatcctatttcaaactataccayatwtgttcatggtgaaatgattcrctgacattgtatactaatracatcttctttcttccttatataaagagcatgctggattttaaatttgatatattaatagtagcagttttacaaatttttttgcggagagtgagaggtaccacaatctttttaaaaaaggttaaaagaatataatgattttacttgtccatctgataatttttctcaagagatggcctaacatacttttttcctgataagtagtgtgatttattgatactgagatatatcttgcttcatattttattgcctcttatagggtcaagatggtgttggtggtgacaagggtgaagatggagatcctggtcaaccggtgagtaaatgcactaatttatttttaagtttttacatagtctcaaggcattttaatgagataattagaagtaatcagcctttgaaaaacatagctctatgtatatgcacttttttgaaagaattatcaaaaaaatttttgaattcccattaaaaatcaatcttacatggagtgtttcttatttgatgtaaattaataaacagwatttataatgaaaagtgtaatcatattatactaataaggttgtcacaatatatcaaattcagttatctatccattgtgttaaaaaattaaaatcactaataatactaaaagcaaagttatttcctatcattagcaaaagttattatcccatcattagcatgaattatattaattgtgaacctaaatgaactctcaacatagtataggcctttttaaaaaaaacttgtgaatgatacaggagtgtactttgaccacatttagttatttagggagaaagtaagggagggaactcactttaggagccaaagacaatggtccctcaacacaattttgtctctggggccattcccactagatgctttgctatcacagatacaggcttattctgcatagacagacctgtggatcatatctcagcatgtgtattagtccattctcatactgctgtgaggtacacaagaatgggtaatttataatggaaagaggtttaattgactcacaattctgcatggctgggaaggcctcaggaaacttacaatatggtggaaggcgaagcaagcatgtctttcttcacatggcagtaggagagaggagtgcaaagtgaagggtgaaaagccacttattaaaccatcagatctcgtgagaactcactcactatcacaagaacagaatgtgagtaaccacccccatcactcaattacctcccactgggtccctctcaggatacatggggattataggaactacaattcaagatgagatttgggtagggacacagccaaaccatatcagtatgttatatacaacttggcatagaatgttagtgttgtacaaaaataaatttaaaagtaatagtattatgttttcacatatttatgtgatatgagcagaattattaaccatatgattatattaattagcatgcctgtttaatgcttgccagatataaattagcactttttaataggacacagttttaaataaagagaatttgattcactttgttctaactataaataaktttaccatctaaatttaccagctctaactataaatatctagaggaagtttaggtatctgwaatagggctgagattttccaggaaatattgacatgtggaaatgaagaaagagggttggtttccatccagattttgaaaatttatgtgggccacaaaataatatccaattttgttaaaggtattttttcacattttatagggtcctcctggcccatctggtgaggctggcccaccaggtcctcctggaaaacgagtaagtttctttaattctttatttgaaacatatgctcattagtcaccatggataaatttatataatgtgtgtaagctgcaggcagcatgttataagaataatgagaaatatcataaatcctaaaaacaatttttaaatgtgccaaataataactaaaatagaacatattctaactatttcactgtcacaataaaaatgagaaaaacaacttctacttaaagagctttccactcctctgtgcttagaactcccctttgtacaaatgtagtagattattataaaagactttggtggtatcctgaacattaactcctattgtaatacatggggatgagctgtcaaaagtccagtgctagcttaaaacattgtaaaaacatgaatgcatcaatgaaatgaggtgaaatgagctcaggaatcagtatataatgttaaattgctttacactgtcaaacttctctggctcggaaacagtattttaatgatgtgctatagcaaaatataaataaataggtattgctgacaatattggccacagtagaccctaggagatttactttcctgtccttttctcactgatgcattcttttcataataaagcaatctctgcagacctgcctcttacagcagctatctcactttagcgtgttcttctgtaccacctgcagtctattttcaaaccggcacatgagtaaaatatgtgataaacatcaaaatatatttatgaggctgattccctcttcagtaatccaaagtcacagggcaattggggccactactgttttctaatggtatctttatttcaggggtatttttcacactgaatatcctcacattaaacatagaatgtgaatgrgttttacttgtctctcagcaatacaaatttgaatcaatatttacaaacatttctctttccaaaaatatatttaatttataataaaacttgtctctgaaaacaatttgctcttcattggccaagtacattttcttacattttcttttattattattattgtgtctacaaccccaaagcatggtctcagtgtcaatagatttatccccaaacaaccatgggactattattcttagaaagtaattggaaagtgtacatgatttttgatatccattgcctctttctgctgtaagtccagctgctcataaaactgtgatgcatagctgtctattatactatttcagaccttttggaagaataactataaaaaacatccttgagaatgagttgaaatacttcttggaacaacaggaaatcattttttttatcttttttctggcctcagatggtgggatgctatataatgtggttagtagaacaatgcagtcacaatagctggctttcaacccagctacaccagttattacctgtattacrttgggcaaattgtgtattttctgtttctcagaggacctaacacccaccctagtgttgggttgaacataagataaatcatgtaacacaataaaaaaaaaaatcacctcataactgttgctgtgttagcactgagttatggcatagttattaaacacttctgagcacagggataatcatcatacaagtataaagtatgatgcttttaatataagcaaggaaattaaaccttgcttcaaaatgtggtagcagctagaaaaggagagactatatcaaaattgattttaaatattctattacatattggcagcttctcagctcatttcattactcaagtcaaactctcagcaagtgctatctagtctagtttcattttaaaatatgtcaaaaaagtacatatttatattttttaataaatttaagtaattatcatttgatatttgagatgaagtatcttaacatggtaacagagttatagaatgtatttgtttctttagccattcagtggtgggtcacatgaattattcattttgaaaacaactgaatatttttgaaaaattttttaagtaatagaataaaataacctattaaagagtattaatgcaaacataaaaaagagacatatatgtgtgaaccagtaaatctcatgagccttttagtataataatatgacccaaaacttatatataaacctataactatcacataaaaatattatatgttaaaactattaaactgttgtgtgaagctattttgacataataatgttgaygctattgatattataaactttcaaaatattttcagtcatatttactaattttaaaatcatgataatataatgcagcaaatttttattctttattataacatatttttaaaatatatttgtgtttattactttggaatggataatgatcgacaattataattttagtgaataactcagactcctaggaagacctcccctcaattctggaattgagaaaatatcatagaaaattcaatacatattcagatttagattatatatttgctctacaacaccgaagtagttttgagtaagagaaagtccatgtatttacattcttattcatttacatctgagttggacctctgcaatttctagttaaatgagatataattttaaaacatgagttaattgctgattcttaattcttgtctcttataatgaaggatgcattttcatatattagaaataatcagttataataaaatatagtagtatattaatgaaaatataatgtacaaaaaaatttagttatttgttgctttaagaacatgaagcatccttttttagtacatttagtgttgctataaaagaatacctgaggctgggtaatttataaagaaaagaggtttatctagctcacagttctkcaggctctacaggaagcatgatgccaacatctgcttctggtgagggcctcaggctgctcccactcatgctggaaggagaagcagagggggtgtgtgcagtgataacaaggtgacagaggaagcaagaaggggcagcagaggtgccaggcactttttaacaaccagctctctcaggaactaacagagtgagaagccactcacacccatcctggaaaggtattaatctattcataagaaatccatccccatgactcagacacctcctattgggctctaccgccaagatttggaataaaatttcaacatgaggtttggaggggagaaatatccatattatagcaataatcaatrattattttttcatccaaaattaaagattacatgatattgtgaaattgtaagcaattggtaaatttttctttagatataaatgtcaaatacaattagaaaatagaaaaattatgttactctcattcctgccagtatttctaactagacaacattgttaactcccctgattaaaatgtatttaaaaacccttaaaaaaataaaattatggttaagtggatttatgaggtgggtaaaaaataagaaattaagataatttacttgcaaagttatacttgatttttttatatagatatataggcaatggtctcattgaagaaaaagaccagaaaatacctaagggtatatgtaaaccttatttgtaacaaattggacattacacatcaatggaaagtggatagactattgaaaaaattctgctgggagaaatgattttctatatggaaaaagattaaatatacctcatctagctcattkaacagaattcagttctaattgatttataatcataaatgtcaaaggtaaactttgaaatattttaccaaaaattatttgagagtaattttttgacctccagtcataaattctgatcacacaggtgtaatcagaaaggaatagattgatgtatcaaatatatgaccattgaaatttcctatttatccaaaaatacttagaagacattggaacaaaaagatccgattaggagaaaatatttgtaacatacaggaaacatgcatagaataatttgttagaatatctaagtatttcttacaaattataatagcaagaaaaaacaatagaaaaaaatatgccaaaggcatgaaaaagtatttgacacaaataccccatgaaacaagaaaaaatatttgtagaaatcaggaaagtgtgtaccagaaattacactgagatactatatcacatacaccaattaacaaaaatgtactctgacaaaccaagtattgggaagaatgttttcaaaaaacagtgaagattattatgcatggctgttttgagttactgggcactgccactttagggaaatagttctatgttacctaatagaatctaacatgaactttttctgtcatctggtaattccatttctaagcacatatcctagatgacattttgcacatatccaccaaaagactcaaggaataatgttttgttatccttgttaataataactgtagacaatataagttaattgaagtatattaataaactaaaattttgtatgctaataaaataaatgcactacagatgcatgcataacatagatgaatctcaaaatctaatattaaacattaagcagaataaatatgtgtatgtgtatatgtatgtcttgtgtgtgtatgtgtatataacgttgaactggaaaatatatattacattatttcatttatataatatgcagaattgttacagatatgtttagcattttaacataagtggtaaacatgataaagaaacataagccaatgattaacaaaaatttaggatggtagttacttctgtggaaaaaaagtgggttgcaattgttacgagtggtatgtaggaagcttctaagttaatgatactgtattatgtagtgcatttaggttgaaagcctaaaataatataatattgagtcattctagcatatgttctttaacattatgagatagtacattagttgagttccctttgatttttgataaattattttaaaataacctcrtaaaaattttagcactgttctatcctctctttttaaattacaatttatagaaagatgatgagctattttaatccattctagtcactttgtaaacaaaattagaaggctttgtattcatgaattaataataacatgagaacggtggtgactatgcattgcttacaaagctattcacattcattttcatataatagaaaaatcaaccttaggtcagcccgatcgagcataatatgcagggttttctcttttaaaatatggcaacaataaattgaaactgaaaaccatttaacacaatatgttaaattgttttctatattaggtttggataaactggcatgcttaattgcttctttctgttttacataataatctattttcttcaccagagtaaaatatattttaatggtgtgaaaaattactcttatgtcaacaatcttattaccaaaactatgatttgttctgatttaacactagcaattaatgcttgcaccattaatttacagcctacagcactagttaatttagtcaataactctacctcaacataaacaaataggtggcttagcttgaaaaaagaaaaagaaaaagaaaaaaaaaatggaaacacaggtcaagtgcagtggctgacacctgtaatcccagcactttcagagacttaggcaggagtattgcttaagcccaggactttgagacaacatagtgagaccctcatcttcacaaaaacttttaaaaattacccaggtgtggtggcacatgcctgtagtcccagctacttgggaggctgaggtgggaggattgcatgagcctgggaggtccaggctgcagtgagtcatgattgttctactgtactccaatctgaacaacagagggagaccctctctcaagaaaacaaaaagtaaacccaaaaattgaagcccaaattacttactaacattatttgcaacctataaactgacactccttttatcttaatttcactgaaaagtagagaccagaatgctgttgcatcagaatcagacagaacttgtttcaaatccttgctacttaaaaatgtgacttgggataagttaatttatttgagtctcagttttctcatttaaaaagcgggcataataactaatttacaatactgaagtgaggactaaattaagaaaatgtatatttaaagcacaaagcctaatgcctgaatctatcagaatctcaaacagtggatgttattattaagcattgaataagggtttccaattgtagtatcatttataaactaaataaacctattattaaataaaatataaaataaggagtaaaatattttcttccaatatcctagttgtatacatgaaatgatagctcgttagcaataaattcatggtaaagttagttttgtttattgttgattttgctttgttgtttgagttcagcagtgaccaatactgaactaactgggtgatacacatacaaaaaggatatagaatattaattaactgcactttcagagtatagtatattgtgattttaaggaaatttatatttgtaatactaatataaattggttatcccttggtacaaattcatgtgacatatatggtaaagaatttcctatgagaacaattaccaaaaatagaagcatttaaactcatgacaacttcatgtatattttaataaaatggatttgtcaaacagtagatatttaagaccagtttaagaaataataaagttattaaactatgagtcaactgagaaagaggtatttggtcacacccacgatcccagcactttttttttttttttttaacttatatgggtgctttagcaactcagggtacaaataaaggcaccactaattttccttcctccctccctccttcttttcttcctttcttccttycttcctttctctctctttcctttttttttaatttttattttattattattatactttaagttttagggtacatgtgcacaacctgtaggtttgttacatatgtatacatgtgccatgttggtgtgctgcacccagtaactcgtcatttagcattaggtatatctcctaatgctatccctcccccctcccccgaccccacaacagtccctggtgtgtgatgttccctttcctgtgtccatgtgttctcattgttcagttcccacctatgagtgagaacatgcggtgtttggttttttgtccttgcgatagtttgctgagaatgatggtttccagtttcatccatgtccctacaaaggacatgaactcatcattttttatggctgcatagtattccatggtgtatatgtaccacattttcttaatccagtctattgttgtcagacatttaggttggttccaagtctttgctattgtgaatagtgccgctataaacatatgtgtgcatgtgtctatagcagcatgatttataatcctttgggtatatacccagtaatgggatggctgggtcaaatggtatttctagttctagatccctgaggaattgccacaccgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgttttttggctgcataaatatcttcttttgagaactgtctgttcatatccttcacccactttttgatggggttgtttgtttttttcttgtaaatttgtttgagttcattgtagattctggatattagccctttgtcagataagtaggttgcaaaaattttctcccattctgtaggttgcctgttcactctgatggtagtttcttttgctgtgcagaatctctttagtttaattagatcccatttgtcaattttggcttttgttgccattgcttttggtgttttagacatgaagtccttgcccatgcctatgtcctgaatagtattgcctaggttttcttctgtggtttatatggttttaggtctaacatttaagtctttaatccatcttgaattaatttttgtataaaactggctagccatatgtagaaagctaaaactggatcccttccttacaccttatacaaaatttaattcaagatcccagcactttgagaggctgaagcaagaggatcacttgagctcaggagtaggagatcagcctgggcaacatggtgaaaccctgtctctacaaaaaaatacaaaaattagtcaggtatgatgacatgagcctgtagtcctaggtactctgaggctgaggtgggagaatagcttgagcccaggagttcgaggctgcagtgagccaagatagcaccactgctgtccagcctgagcaactgagtgagaccctgtgtcgaaaagaagaaagtactgtacataagtgagatcactctgtttatacactgtacatatgtgaggtcactttgtctataccacaggtgaacacaaacatctaatcatagaggggtataatgcagagtgaattctatgaattgaaactgatttgagaatactgtcaccacaaacctttgagttcaatatctgatgcagcaatcaatttaataccacttttgtgaaaatagcaagagcatatttctatgcagtaaggtaatatctgttctacaggcttgtgctttggttgaatacagatttgccttacaatctgtttccctttagtccatctagaaatgttaatcttaaattaggtttgtatatattttgtggaaattaacatttctcagatccttactttcccactgtggaaacaataaaaaagccacaattttttttataatatcttatggcggaagtagcaatgacaagaaatgtgttcaaaagtattaccactttttttctgtgattgaatcttacgcatgaatgataataaaacttcctaacagaatattgatcataatgttgtaagtggcagtgatactgagaaagaaaattctaatggttattaaacaagtaggagaattacattatcattcatagtacatgtactttctgtcatgcatttgtaatacttgagaatgaatgtatatttccttaagggactggaagatttgtacagcttgtttcaataagccatggacttctaatactaaagttatcattttagctagttccatgtccttttactgaaaaaaaaatctagagctgaccaaaataatttaagcattataacctgaaaatgcacatattaaatggaaatttgaattcggctcatattgccaaagggaagttcacaataaaaaattaaaatggtaactgttgttattaactggttataatgacagatgaagttttaacttattatgcacacacacatcatatatataatatagtatatatatatgtgtgtgtaccttgtatatgcatgtactatgtgtgtgtatatatatatatgcacacacatataaagtattattatatatagtattaattcaaatttcaaattcagacattttcttttacaaagtcctttgaaaaattctaatataaatgtatagatagaaagtacattgtaataataaaataaattataaatcctcttaaaatttctgtgtggtacaaaactgtgccttccaagtaaggtcattatgaaaacaaggtctgcatttaatttgagaatcactgaagagattatatacctttctaggagattcatagttcaagaagagtattaaaggttctaaaaattttgaatcaaatttatttatttttaagctattttaaatattaatgtttttaatacttttgggaaaattgttctaattttttaatgtggggaaacaaaaattcttgttcatttaacatgttcaaaaatgtctgtttatccaaatagctaactgtatactaaatttggcagtttattttgctaatattaaaaaatcaagatctccatatgccaagactctgcctttctccaattctcttttttcctccctaactctcaagtcaccacatactcatgcaccctaatattctgactcatagcaagacaaatgcatagatgcttagctactggcctaagtgaactcttaacaggtccatagagactatcatgtactttccattcttattcctttaagcatgcacgtgagtgatcagaaggtaaagtgttagaagaagccatccctctctcatcaactcacactgtaagattcagatcagagactaggtttttaggaaaatcctctatactgccaaactggatcattgtacctattttgtacactgatatcatctttgtttattttacagtgttctatttgttaatttttgtatctgtgtttgtgactaaattctgtgaatttcttagggatttgattttacatgttatgtatatgcatagcacattctggaatataagggatatttaaatgtttgtgacatgagtggaaaaatgattaaattacagaatcatactgtaaaacttgaatagtgaaaagaagattatattagatgctttatatgaagaatagttctcttgagtagaaaaatctgttataacaataactactggtggagaattaactaggccctattttagtgggttatgtttttatgaggtatttttcaataagaacactcattacttcatcaaagtgcagcaagagctcaccagattaagtttctgccccttcgtttatgcaaacatatgaggaataagttattgggacaacaatttgtccgtaggcattgtctttgttttgtactactataacagaataacacagactctgtaatgtataataagcacagatttattggctgaaggatgggacatccaagattgagtggccacattttgcaagggccttgttgcagtgtcataccatggtggaaggacaaggagcagacttgaaagagcaagacatcaaattcacagcctcagttttttttttttttttttagacagagttttgcttttatttcccaggctggagcacaatcgtgcaatctcggctcactgcaagttctgcctcccgggttcaagcgattctcctgcctcagcctcccgagtagctgggattacaggtgcccaccaccacgcccagctaattttttgtatttttagtagagacgggtttcactgtgttggcccagctggtctcgaactcctggcctgaggcgatccgcctgccttggtctcccaaaatgctgggattacaggaatgaactgctgtgcctggctgcctcagcccttttatatttattattaatcaattcatgagccctcatgaccttaacaccttctattaggtcccacttgacttactactctctcaggaaaagtatatctgcttttgtcgtcatttttcttatttttttgtcatctggaaaacatataaggaataaataaaattgggaaaaatgagaaaaagaacagaacaaagtcatttaataaaatttttactatgacagatatttgttcacagaaggaagaaattatttagacaagaagccctttattttaatcacaacttagttgctgtattgtcatttagttatgttaaaattctctgggctcttctaatactgattttctttctcctttgaagtaaaggtgatattttccttccaattttagacaatagatggcttgcttttttaaaagccatgtattgatatatcttttctactataaacttcatgtttgtaaatgcaatcttttcaggttaagcccacatatcattatgttactagtttaaggaaaaactgtcattgaataaggaaaagctattatttcattgaatgtcattatttctatttcccaaataataatcattattattgttgtatctactttgcatatgttattattttaaagatcacaccaaaataatttctggctcaacattttaacaatagaacaaatttgaaattcatggctcaacacagaattccttttgcttaaatatgaaatttgaaagatgtcctttgaagttttaatgtatatattattattagcatattgattccacctcaagagattacccataraatttatacattttttatctttgggttgaggtacaatgaatgtctaataatagatagttataggaatgatattgagaaaatcattactaatgatgtcatcattgactctttctgagataaaatgagttcgtggaattgaagtgcttgatactcattttattcatctttactttgtgtataaattcatggggtacacgtgcaattttgctatactgatattacattgtgatgaagtctgggccttcagtgcatccatcactgaagcaatgcacgttgtaccctccaagcaacctctcatcatccaccactattgatactcagtttaaaatacgatataaaaggctgggatatattcaccattaaaatattaatatggcatctgaaaaggaacagtcaccctcctgcctcaccttattctcaccaattaacaccaccatgactactctctgcaaccaccaaccccaatctcagttaatgattttgagcacaatttattatgaaaattaaggtaaatgaatggaaaaacaagacagtctgagggaaaaaaatgaaaagcagtttcttagagatcattaagtttctttttcagtcattctgtacttatgcttttggatggcatctaaagtgtaatttttttttcaattttacttctaatattaggatttaaaaagtgatatttgctttcattttacctayttatgtgaaytgcatagttctcaaaaatgaaaatactgtgtctgttgaccatcataatttaaaatattgtgtttctttagttgttatgtgatcctgtaagaatgcatgaacatatacatattctaagattaaggaaggggccattcttaaaacacatatgagaataaaagtagaatacaagtagatatattaaattaatttctaataataaacataaatgatatatcagtatttaacacactcagggtggcgattttaattcatcagcatttctttaaaaactttatttttactgctttcttatattgatgtgaagtgattgtwgtatacttaatttgtgctgtttttcagtattctaagaggaagtttgtacataaaatgggttttgattttygttattatgttttaaaccaaatagtgatagaaaactacaatttattcatctgttacaaactaaagtttagtgtttgwaaacaagtgctcattaacattacttttatatgtgatacatattttacaataaatcttatgtctatagggtcctcctggagctgcaggtgcagagggaagacaaggtgaaaaaggtgctaaggtaaaaaaaaaataatatatacataatatatattatatattatatatacaaggtattatatttgaaaatttcatgcataaactgatcwacttttttcagtrcatttaataaaataataaaagtattttctcatcactaatgtgctcccatattttactttctaacagggggaagcaggtgcagaaggtcctcctggaaaaaccggcccagtcggtcctcagggacctgcaggaaagcctggtccagaaggtcttcggggcatccctggtcctgtggtgagcatctgtgttaaaaagatgccattttgaaaataacatttttattttaaaaaaattttgaatgaaggtgtctatgttagcattatttcataagttatmacgtggataattttgtgggaattctgtaaatataatgtaaaaaagatattcttcatatatttaagtatatcatttatttaataagttcatggtgaaacactaacttataaagagaaaatagaaaaccaaattttaaaatttcaatgatgtgaaatgtttatatataacctatgtatatgtatatataggtgtgtatttgaatatagacatatacacatagtaaagacacaaaattatttacaatatttgtagatgtcctccatatggtggaacttaagggtgatatttcctttgttttcttattgtatttctaaaatttaaaataaataaataaatatgtattattttattaattttaaaaatcaatcatttttattttctctagggagaacaaggtctccctggagctgcaggccaagatggaccacctggtcctatggtgagtaagatcttttcagtcatttaaaaagtgagaatttctaaaacaaaattgtttattagctagaatttttgacattttagtttataaataggtttgtattttttctaatagtccaagaagtatattattttgtcttagaggaaagtaatcctaactgataggtatatggaaaataaaccacttgatcagaagatttgtttctttcttatgcactttggatgaaaaaatatttccactctgaatgaaatgccactaatgatccagccagtgtttttcctagtctggatagttccctaaaacgcttgcagttacacttattttcctggcatttcactttaaaaagtatgctggcaccagcatagagtgattctttgacgaaacaaattgttctcttcgtgagtcatacaggctgaaacataaaacagtaaaactcagtgaaaaaagatatggctactgtaacactgaagcttggtcactatcattaartctgtgtgcaaacaacatgcttgagaaatgcaataaagtattttgttgactgggatactattcataggtggagtttattataggatctgaggctatacttgatacaaatttgggcaaaaagtgagaataaaagacttgccctttaaaataattccttactaggtgacttagttgctttatatatatatatatwtatatttttcttatggtagagatttttgagtgtcattatccagtaatagttaagtgtggagtgattaatcaaaatggcaaatcatacatatagcactcgtatgtgtggtgagtattagttaagtcctgctatatggtattttaaaatttattcaaatgccttttatcataaatatattaattatctcagagatagaaacatacgcacaaagccatcacaactgggattcacagttcattcaggaaaaattttggttattccttttaacaaagatgccacagcatctttggtatgcaaagcatacctaccaaatatttcataagttttaaagagattatttaaactttcactgaagaatttaamgatcacttatttagtaactagataaaagttatcaaattttggtagatttcaagcaggagatgatcagttctgcccattatctcatcagcttaggaaaagggccccggttgaagcaggatcagctccacatctgtaccattacttatgaatattctccttagatatgataaactcataactgcccagagtcagagcctggaaggaaaaaataccttgccttaatgtcactctaaaatttgccagagattttttcttgttatttcagattttccrgtaaatattttgacctttctgcagatgaaataaaaagcaccatgctggagatttccttcagctaatattaaaaataaaaccttctgacataccacctgatttggcatacaaacttttgtatttttgtcttttaaataaatgtgagtttacagcgcaagaggacagaataatttccaaatcctttaggtaaagcggaatgataaacatcagaagtgggctgcatgggcacattccattctgactgcttgttttatggcgagtacttacgatgtgaatataatgtgtagttttttcatagctttaattagtcttgacttgtgataygtaatctcaatgaaaatgctacttggtcttcatgaggtgaggatgggcagataaatcatcttcaaaatgccatttatggcaatttaatgagcctttcaactcaactaagaaagatctattttagtaggtaatttttaaatcagaatgagaagtaacttattatggttactagttaaggttatcgactctagagccaaactcctgggttcagaaacaatcactaccacttacttggtggatgactttaggaacattaccttttttttttttttggctttaagttcttcatttataaaatgggaatattgctagcctctatccagtgatatttctaaagtttaartgagttcaattgggatatggatatcttctaccccatggggttcttaagttaattaaatgaattgcttgtaaatcacttttatatcaacaattagcactagtagcaccaaatcaagaatcattaaatgaatgaaataatgataaatatgttgaaaaccaatcaattttatattcttagtggaaagtwactaaatttgacctcattcaygcatgtgtgtcatcaataaaccttatgcaagttgttgactattaaagcaaatggaagagatcaacaagtacaattatacttagaaaagttagagtgttaacatgttaagtactatgatagactcaagcagaggatactagatatacacagagttggaccatttaaatgtaatttcctctagggacccttccctgtttagaaatatgatacgattattaaagaaggaacagagaggtgtaagtgtggataacacaatggctgtgagattaacgagatttggaaattcatagaggtttctattaatctctgaaattaatctgtgtgaaagctataataataatactttctccatgatgaattttttcctcattataacatatattcacatccatatccaaatctacacaggcttcaatttgcttatcattggagttccacaagtacctattgggtctcttttccccttctagaagctgcctgtaactacctactgtattgtttctactggtgagataaagctaccaagacattccccttttccccaccttttaaatacaacctagctgttcagtaagtacaacttacctactttcatctctccagattggcagctacctatttagacaattgaaatatctaacagagcatccattagacacatagataagtttaacaattttataggaagtttctggatatgaaattctttggggtagagtaaaacaaactgattttttaaactcttaaaatgatttctgcttggtgtctgcccacactatgttatcagctctactagagtcagatgtgatatagtatttattttttacttgaaaaagtacatatttcacatggtaaaaaacttgtttataaacatgaattcaacatatatttacatttgtatatgtgtataggtgtmcacacacacactcacacacactacaaatgtgtacttagatcaccgtatggaactgaagattgacaaatagcacataagggttgggcatggtggctcacgcctgtaatcccagctactcgggaggctgaggtgggagaatagcttgaacctgggaggcggaggtttcagtaagccaagatcacaccattgcactccagcctgggtgactgagcgagactctgtttcaaaaataaaaaagataaatagcacatatggaagctaatcaaaagctaaggatgatgatcagcctatataaataactctattggagtttgtttttttaagtgggactctgctagagtcggtataatataattttattagggtttcttaaaggatttttaaaattttcattagaattttgtattggttgaattatactactattttagtagtcaaccaacattaaatgggaataagactgaatgtttcagtatttatttattgagacagagtctcactctatcaccggggctggagtgcagtggcacaatcacgagtcactacaaccttgtccttctaggcttaggtgatcctcccgcctcagcctctcggttagctggggctgcaggtttgtgccactgcaccaggctaatttttgtcatttttagtacagataggtttttgacagttgcccaggctgctcttggactccagggctcaagcgatccatccacctctgtctcccaaagtgctgggattacaggcgtgagccaccaagcctggccaattgagtgttttaaagagaagaatgaagatgtctaaattctaccctctgatacaaagtcaaaattaaaatgatttagtcacttttaaaactaaaatgtatttgattttttgaagtcagaattaacatctgtcttagctttaaggttttattttgttttgttttgtattcttttaagactctatttgttttaatgcagctgaaaaattattcagcatttatgttcaaaaaagattatttagtattatcacacatttctgcttttgataacaaaatgttaaataaaatatctgatagcattattttttaaacaataaaaacttaaaagataggatgggatactgaattagagtttatttctttaatsctacatttaagttatctgtagacaagggtgatatgggtagcattccacaatgattaaaaaggtttaaataaaaaagcatttgcttttcaccagattaaatattattccacaattttatattttaaataaagtgtaggatctgcagtttctttaaatttcaatgaactagagttttgaaatgcagatcaaagcaaatattccagaaagtataatactgcaggggaaaatgtttgcttgtgtattctagacacttaagaatgtatcatccctgttttccttttcactttattacttatgaattatgtatttccctgggggttttcaatttacaatatccgaaagagaaaaatagaaaatatgtatagttagaataacatttttatatgcagagttgatgtttttgatctgtttcaggttcaaagggttatttataacygctctcgatatcataccaatttctatttccagctgatgaaaataaaaactgattttgtttggcaaaytcatctttagatgtagtttataatgttaagagagattattagcttagataaattaatattcattatctttaacttcatgaataatatttatggaaaggatttttaatgcatttaaaacacaaataatgtctaatatatttttcactaagcttgagcaattagaatcactagtagttcttttcttgccattttagctttttctattagaatgggatgagaaagttgacaggtatttatctgtagcatatctaaaactaatgataataattcaaatttatattatgcttcactgtttatacaatttttactatggagagcaaagccccagtaatggggagataactatatacttgaaagtgaatttgacaatttcattgtggtctttttgtctgagatttaacagggcaggatgattgtttattcttatacaaaagagaatgtaactaaattcayataaatttgactctgaggattagtaattttctccttattagaagattattattaagcatatctacacttaaaactgcatgtgcttgtatgaaaataacttttgtctgttgttaattgaataatatagggaaattgtccactttaatacttagagaattccaaattcagttatgaattaaaaaacataagtatacctaataatagtctraaataccattgttacacaagggctaatttatattaacactattcttgctctttcctgatattcacagttttggtttgagaagcaggcttcagaaactaaagaatagggagggcccatcctcattcatgcagcagctctatgagataggaattgtagtccccagcttgtagatgagaaaactgaagctctatttgtccaattaatttaagtagctaagaagagagtttggtatctatgccagaccttatctattctgaacccatacttttcctagtacatcatactgcttggatcagatccatagttcttaaggctttaaattcacaaaaattatggaccaggatataatgtgctgttttacactgaagaaatagtgtttccagatagaggaaaatattactcatggtagccttgtagaagatacaatagtggtgactcatgatgtactttggtaaaaagttaaaacaatttgctgtcatagagccatgatgaaaattattactgaaattataattgagctaattgaattctatcaaaataattctaattcatagagaaaccatatgaacagtttgcttttgttgctgggtgccttaggacttgcggcaagcagtagtgacatagtgacatatctaggttatcgtggccctaatttcataagtcacatataaatcatttttttagcatcagtttcacttccaacagcatctgttgcctgcgtagtktcacttgtataatttcacaaggactgtattttgtgttgtcttcaaaattgtagtacaacaatttggcttgttagtgtggtgtgtttttgtgttttgttttgtttactttctctagcgacagggtgttcctctgtcacccatgcaggagtgcagtggtgtgatcttagctcaccgaagcytcaaactcatgggttcaagtgaccctcctcccttagcctctcaagtagctgggacagcaggtgcacaccaccaattattctagtttttgcttttttttttttttttgtagacaaaatgtctcactgtgttacccaggctggttgcaaattcctaggttcaagcggtcctcccacctcaggctctcaaattgctaggattacaggtgtgagccattgtgcctggcctagagtacaacaatttatagataaaacagtttgttcgaaagtcatcagtatgaaaatttccttgggcgggggggcaggacagagttggttgctaaagtcatgccataattttcatagaatgtaagttaaaaggataaatgtcttagtctgggactattaaaaacgttaaattattgaaatagaagtatatttatataaaaaataaatttctttattaatttcataaatcatttagatatgaggtgcaatttagaaattacagctgaaagtaccatcttgatgtagtttgtaacgtcttatactttagcttagagaaattaatagtcatgatctctaacttcttcatgaataatatacatgcaatattttattgggattattaagtattcgtagtatatgtctctctccagtaatcatagtgaaggacatctgatttcaagagaacaaagaataagaattgagatcagaattcagaaaattggccatggcctagaagaattacagagttccatgttttaatttagtatatataggaattatcttcttattctatagaatattattaggcaaccattctaacatatacaaatagagkttgttatttaaatacaaaccaaacagtgtattaaaattttgtctattttttttcctgtggttatcaaagatctattractgttcaaaagtttattgagttttttcaaaaatgttactaaaaatatcataaacttttaaattcatgtaacataaaaatgtttgagtaactggatatataatttggaaatcccttccaaaactagtgtacttaaaaattgacactttattcttaactgaaaagccatataaccatgttctatttctaactttacattcatttaatcaaaattatcaatattatggttacaaattaaaccrtagtgttttaaatatataaatttacttagaagccttaaaaataaagcaacattaatcattactatttkcaactccgtattttcaaaactaaactaggtctgtgactagttataggattctctaattcatacctactctgtttttgttttggggttttttttttgttattatttagggacctcctggcttacctggtctcaaaggtgaccctggctccaagggtgaaaaggtgagaataaaagaatgtgttattaataaaagaatatgcttttatatactaatagccctgcttttgcagattaaaatcattcaaaagaaaatttcaaacaatatcttcattctaaccctgaaaaaagcttcaatccttagcttcccagatgtatgtagaggggagaaaatatgcaaatagtgaaaaatgtgctggaattcagtgctatatcttctcaaggttccattatagcaaccatatgkagaaagcatatggttatactaaaataactattcagaaaataaacagactgaataacaaaatatctatttttatgtttttaaatgtgaaaataaaaattttaaactagaaatatctttcaaatactaatttgatgtactagaatttatgctgagttgcaccaagtacttagagaaattagcctttttaaaaatggtattattattgtttggattatttttaaatcttcaaatgccttttaaagactgcagagtctctgaagagtagaaattatttcatattaaatgagatgcctattaaaataatgagttttstgttatttattcaacttatattataggagatcattattggtttagagattcctcaaatggaacacttaaaatgatatttttagaaagcattttgttttgtaatatttccaatgcttaataaagccctcacttaaagtaagcagtaaaagatccagttaggtgatgagaaggagattcttaactgtatatttcattcagaagggtattttaatgttgttttatcagcattgttcatttttatgctttagaaatttaatgtgcaaatattttataactaaaattttatgaagatagtaatgtacatgttattattttttttctctgcctttcaaagggacatcctggtttaattggcctgattggtcctccaggagaacaaggggaaaaaggtgaccgagggctccctggaactcaaggatctccaggagcaaaaggggatggggtgagtaaaaatataggttattttttctactcatttccaataatacacacacacacacacacacacacacacagtcctttaagtatgatcaaagaaagaatttagagtgtcttaattctaatttaagtcagtaatgttcttaaaaagatatttttattcagccctagagtaaataaattttaaaatatttaagttagaaaccataaaaattacagttgagtattatttaaacaaacatgtactaaattcccatcacctgtaaatcatattctgagggataaaggaatatacacattaacacatatagattgaaaacaaaaacctcattgatattgtagcaacataggaaaaatcctgattattttgcacaagttattttttagattcaccatggaaaaatgtttaagccattcataaatatttttgcattctctaaattttacagtgtatgctgttatgaaaatattgaaaagttatgaaaacatgaaaatgaaatagctgagaaaatccctttaaattggctgattctctctctagggarttcctggtcctgctggtcccttaggtccacctggtcctccaggyttaccagtaagtacaagacaaaataaccttataaggtagggttaagttacaaatataacagagacacaaatgctccagatttttatctgtgcttttgcatttgcattttgtagggtcctcaaggcccaaagggtaacaaaggctctactgtaagtacttttccctttgacaatttaattttgcattgaaacctatttaattgcctcttctttatttatgtcctctctcttctttctaacagggacccgctggccagaaaggtgacagtggtcttccagggcctcctgggyctccagtaagtatatgttaacaagagtgatgttctgacagtttgcatctggaagctgccaatgatttctctgaacttataagatagacaaaaagcacattctgccaaaagtgctgattttataggaaacattatatcatttaagtawtcaaatctacatgccaagacttaaattttaattgatttcactcttcaaatataaatamcttaattgtatattatagtcttgtttttattawtttttcaagagaatcatatactattttgtcacattaatgaaaccaacttattttatgccgtaaagatacatttttacttgactctaggaataatgacaaaaattcagatgcttcacattttttcctagtgcattataaagatactaataaaaacaatagtaatagctaccactttattaatactaaaatgttctaggcttcacataactaattaaatggtagaattaaaatataggtccatgtgaaagaaatgttattcttctttcttgagctaaaatctttccaactatatgtatactagtttgctagggctaccatagcaaagtaccacagagtcggtggctcaaaccacaaaaatgtattgtctcccagtgttggaggctagaagtcctagaacaaggtgtcagcagtgttggttccttctgaggtccatggcggaagggtctgttctgcacttctcttcttggcttgtggtggctgtctttcccctgtgtctcttcacattatcttccctctttgggtgtatctgtgtttaaatttctcctttttataagaatatcacttatattggattagggcccactctagcgatgttatcttaactaattatattttcagtgactgtatttccaaatgggattacattctgagatactgagaattaggacttcaacattacaaatttttgtgggatacaattcaacccatgacaatatgataactatttgatatagctctgctcgtaatgtaaattcaagtckggttgcattgattttaagtttgttaatttataatgatttaagtcacacatatttgaagcaaactaatgtgtacatattttttaaagtttaatgttttataatataaattatcatcaaatataatacacagttgattagatagcgcaatagctttaaagtgctgttctaatcctcagagactttacaatctagttgtggagttagggcatataaatgatgactaattaataaacaagagactaacatatataacatatctacacaaatctgtgctatattattgtatagataaagggtgagaaatcatctaacttattcacctacctcaatatctccaycaagttcatcatagaagaatctatgacrtttatatatttataaacttatcctatagcataaattttgtagctaatgaaaagctaaaccaactctaatttcttataacaaaaacataaccagtaataattaatatctgcagaatattccactttatgaaacaattgcactcacattatcttctttacagggtccacctggtgaagtcattcagcctttaccaatcttgtcctccaaaaaaacgagaagacatactgaaggcatgcaagcagatgcagatgataatattcttgattactcggatggaatggaagaaatatttggttccctcaattccctgaaacaagacatygagcatatgaaatttccaatgggtactcagaccaatccagcccgaacttgtaaagacctgcaactcagccatcctgacttcccagatggtatgtaaataatacatgacaaagcaaatgtaccgagcccctgagtttctgaggtgcattggcagctcattcattctagttaaatgtttaatacagtctctaaataaaatgaaacagttattaattatcttctagacagaaaaaatcatttatactgcataaatcaagatttgctttggaaaatccttgtctgttaaatgggattttattaaattatgacaagatcatttttggatgattacagctaacacaaatgtactttgcttgtaataactatcacagaatgratactgtgtatacacacatgtgtatattgtaatatgattactaacttcatgttaatgtgaatacttacattaatatgattattattttagattaatatgaatatatggatatgtgtaaatrgcataactgatgtatatttgatctatcagtttggcaatgatttggtgaacagaatattaagaactgggatagcttggggcaaaaatgtatctttaattgatccacagatattccaaacagctgtgaatagcttacttactaataacaattaggataattcatcataccaactctttgacaaaacctttatatacctattggtcagagaaagaaagagtttcaggttgctaagttagttgactaaactcttacaattattaaagtagcaaggggcagatcttcatctgatttttaaatttcccactgcatgttgaactattttgtctcccctttactctgtagaaaatattgttttgcactaccaatcatataatgtcagttataactgtgatctaagtaactcaatgcagatagaaaagttcagtgtagttcagaaacagccagcataaaaaaaaggatgtcacaaaaatcttcttatcttaatcaagcatagcctgttaaaggtaaaacacaggtaattattagcgttcctatacaaactggtatctaacatcttcatgtttataatatgtttatctgaaaaatatacatttagtytagtgatttataaggagatttacttttaactggtrttatttaagcaaaagatgtagatgatttagataattcaatgttatatactcctaaaaaccatgtaagmtatatcaaaggtttacagtggttatctctacttggtaaaatcttagatgattttttttatttccttgtatttttttcctgggaattctaatttgtttcagacatgattatattaatggtataatctgaaaaaatatagatgtttttgttaaagatattaaagttatgcgactattagaatacttttcctgtttatatacaagtagtagcagaagataaagcaggttgatattgcattgtttagagttccagcaccaagataagcaatttgagcttttaaaatattaaaagttcataaccagtggacttatataattcaaatatttcaaatgaagtggcagcatgaaaaacakttggaagtataaaggtagaaakaattygattcctttccttctcagtataaaggtcaaagctgacacccctataaaaaaaaaggttaacaagagaaaaatattaaaaatgtatttgattatagttcaacataacataggcgccttcagattcaagctcgaaagatacagaggaagctatctgattttatgcttaggttcgataaggcagggacagctgtgtagaaatgcaatataatattggacaaaaaaagggtatgagctaatgatactaatccgagtagggaaacctagtaaggccttctgttcagatactccctggcctgtgttgtagtattccatcctcccaggtacggggtagaacccctctggaataagggttttaatttctttatggccagctgttacacagaaaggtgggtgaaggttatgttaacagtggcaaatccatatggtatactaagggttrtaggagtgaaagtttattaaaaagtttyagaacagaaatgaaagaaagtaaagtacacttggaagagggtcaagcggacgactggagggcttcaagtgcatggtttgacctttgacttggggttttctacattggcatgcttctgaggtttgcatctcttctcgcctgattcytcccttggggtgggctgcccacaagtgcagtgggctgccagcacttgggaggggccacacacacattttgtttcctggagctgtgcgcatgctcacttgaggcgtcagtttagtgttcccagaggaaggttatttaccagttaaagtccaaccatttgcatcttagtgcacatgcttgagcccagtagcccacctcctgagatcgtataaagaagctgctggtcaccagtttcaggtgttttctatgaggaacaggaagactgccattccctggcaccagctgcaaccaattgttttagcaagacagtttaacaactgcctgaccttcatctgatggtcgcctgacattcctggtgggattggcagggctctcctgccctgtttatgtctgactacctactataacagttagagtagtatgtttaggttttatagctggctttgcaaaaaaggggttctggtttctatgacccactttggggaggagggattctaatttccatgacttgcctcgagggagaatgagggatgagagacaggagggcagaggtcagagaaaaactgcctcagcggctttcactttggggtatcattttctgagtcccaacagaaggaagcaaagtaatgtttacatgtatatcacttttggctcctagtaacttttgttaactaaagccgtattgtcagttatctaaagaataactttgttactcccactattttccatgcttactcacataacaccaaatgaatggtgatgattattcacataataaaatgtgttctgcaacatttcagcaatggcattaatagcaggctgcattaaaatataaagtagtccttcttaggaccccccttcaaagagagagtacatttattgcaagaagttttttttttttataaaataaggcagaggtatgatctctgaggctaagtagatacgatatcacctccactgttacaaatgaataaactaggaagaaaatatattgattacactactcagattacttaagtagtaaataatacttatgagatttggagtcaagtatatcttatttcaatatgcatgcaatttattacacagggataaatggaatgttaatatttgaggagatgatatttaagttgaaaccaaaaagtgataggcatgctaagaattttaaaaaggtattccaggtagaacatatggggcatttgcaaagctttgaggcagacaagagaaagtatcactctttattaaaaaccgtaccccaatatgcccaaaagcttaaaaggcaaaagatctattaatatgtattttccttatttctctttctaacaaaatttgacatctaatgcattcaacaatgatgtcaatgaatttttatatgacatattttttgctaccttctaggtgaatattggattgatcctaaccaaggttgctcaggagattccttcaaagtttactgtaatttcacatctggtggtgagacttgcatttatccagacaaaaaatckgagggagtaagtaccaatctgttttggtggtgaatgttgacagttcctgccatgttttgcaatattgaactaaacaggaaaattatactgtcatattttcatttatcwgcttttcttacaaaataattagagtacttcatttgcataaacatgaataagcaccaaattgatgcacagagttaacaaatacttctcttctttattttttacccagatgtattmtttctgcacctgcttgctcactaaaattctatggatttccatgacacagcacagctgaatctcaaattttagtgccactaaagtgttcttctgcccaattaccacatcagagacctcacagctgcatattacacccaaaatatctaattttataaagaattaaacttttatatacaagtmttttctgcacttacatattttttaaatatttagtttctttaaacaaattctttaatttttacctaacattattaccagtacactgagttctgtcttcaaagctaaatgcaaatcattaatgtaaagaaagtttgttcacgagcataactatattctccaaacattttataagtggacattttgtctttattggtattcatgtaataaatctcattcttcctagtaaatggtgtggacaatagaggcacagaaactcctkaaggcaaaacaagtagctttatgtgtgactaatggttttgggagaaaagttaagtttctgagtaaagagtgggtagtaagggcaggagaaaaaacaacttccatcttccaacactacttggcatgtaatgaagcacagtaaagctcccctagcctccagagaaatgtggaaaaacagaaaatgttgtttcttacacagataactcgagttccctattgtgaagacttatataccytttgctgttcttcacaaagcagaacaataaatgcagatctataagattctaaatattctaaccagcagggagtaattcaggttgcttccaatcagtgcctttcacacagtatatctccttagctactggctaaatactttcaaacatgttccttggctatggagtgaagatggtacctgccttgcttgatgaagctgactgacattttgaggatttcctttgcaaagggtttctgagtgttccaccaatgtcccctataacccttagwatgcctatacccggttgtctttccccttttcctttagagctgataaagacaacaaaaaggaaatgactcaatcttcactacrtagaatgtacaggatctatctcaaatttttctctttgtctcattttgtataatctaatttgtgtcattttaaaacgattttaagcactctttattttcytagtcttactgaaaatgaattatatgtatataaaaatactgtttatattgtaaattttcacctactcrctaacttttctgttcctttgcaacaggtaagaatttcatcatggccaaaggagaaaccaggaagttggtttagtgaatttaagaggggaaaactggtatgttattacctcaacatgaaacgatttttcacgaactcaagaagtgacattctgattatgtatttctggactttaacagtgaaagtctaaattatgctaaatgaggattccctgtggtctctagtttgttccacttaatatctcttagaccactgtggtatcttaaagcaacctaacatttttgtataaaagtaaatggaaatatgctaaatttatggaaaacaaggatcaaatcatgcatacaatttattaagtacctgagatagacatcataaaaattgattatgttagaaatatcaggtataaagaatataatatctacttaatatcttcctattatttcactttctgtctgcttgaaacctaattccttctttattcttcatatcaataagttggaatgtgcaactttttctgattgttctggcacaaatttaaagatttccatacaattaccagttcatttcaataattttctaaagatattttaagattagatgtcaaaattaaattaatctttaaaaggtgtttaatcatatacatgtgtttaaagtattttatttagaagttattgaatttaaagtgttttccagttatccagataattattcagttgtttaattttctttgaaaagctattattttccatttatgattatttatacagttattatttctatacaaactcatgcatattaaccacttttattgacactctccactggagttataattctctattacagtcttcaagttgcatattaaatatccatattacattattatctttgtataagtttaaaaatatatacagatagaactctatgtgtgtggattgaattttcccagtagatttttttcttcaacccccaagaatactcatgatctgacctactattcagtaagaactaagtaaaatctgttttaaggaagaaagtaacaaataactgcctttacattgacctaatctataatctaggtgaacatcttaaccttttttttttcaaatttaagtgtatatgttacagctkaactcagatatttttattaccaaaaataagacaatttataaagatgatatgagacagttgctaataaattacaactgagactattttcctgctataatttcagaataagtattgactcaacaaatattaacttgccttgtcttgcacattatgcctgctgctggcaatacaatgttgaatacacacatcatctaaaaatagataaacaggcatttctgaaaatattaataacctttgaggactatagccccaaaatgaaaagtgtaggaacatgtttacagatttgggtaaagttgatacattttgaaatgtttgaaaggaatagtcaaaatcaaacaacataaaaccagctaatctttgcattattctgagattccttggttttcattgttccattattttaccaatttttttttcaaaaagatacagaaatatattgaaacatttcttggaaactaaagcattttttatagtgtttactgtttaggaaactaagacttagagataaagtggttttttcaaagataagcagtggctacagtaacttaggtgggatacaattcataaaatcttgtctctgggtcttctgaccctcaatgtacactttttttcattaggttaaggtgggtcttttgattcatctacatgcttctggcatcacagttcactgtctgcagtgatttaattctttgtagcataaaagaggaaaagagtcattaggtgtctttttattcctttattcctagctttcatacttagatgttgaaggaaattccatcaatatggtgcaaatgacattcctgaaacttctgactgcctctgctcggcaaaatttcacctaccactgtcatcagtcagcagcctggtatgatgtgtcatcaggaagttatgacaaagcacttcgcttcctgggatcaaatgatgaggagatgtcctatgacaataatccttttatcaaaacactgtatgatggttgtgcggtgagtataagttctgcttgtctcccttcwcagagatgataggcagcatgtcaccgtttcagtcggtccttagccagatttttctcatgaaatggacgtcagttgttattaacatttgttgcttaatcttgacatgttaaactatggtatgtgagaaaccagtaatgttaacacacacacagttatgcacatagacactctgaaacatttttaaaggcatacagaaggtaatcttggattatatgttattttattctgacatttgaatcatatcacagctagttattcctaaaatgaaaaagaaaataaaaacacttatttcatttgcctccttattgctgattttaaaatgacagataaaggaatcaccattataccatttataatatcaataatttttagccctatattttgtttataagaagcttgttaatttgtactatatcagtttgagatccagtatcattattgttatctctatcttatagaactaccttgttcacacacataagattttacataagaaaataataaataggtgccctaaaaagttcattgctttagctgagtattgatgactgaagagaagtcacaattgtaaataagtaagttcatgttttcatcaaaatgagtggagtgcaagtagaatgaagaagagagagtaaagcaaatgaatggagcaagagttgggaaaagcttttccaatatagtttattgttaaatattcataaaattaacatatagcagaagaaatttttttgacatttgaccttgtgtgttatagttgtgaacctgtatttaactttttctgtaagagaatttgactatgtatatcttaactrtaatggtaaagatgtattatttatactggaggggctgggtgtggtgtcttacccctgtaatcccagaactttgggcagccatggcgggcagatcacctgaggtcaggagttcaagaccagcctggccaacaaagtgaaacctcatctactaaaaatacaaaaagtagctgggcatggtggcacatgccagtaggtccagctactcaggagactgaggcaggagaatggcttgaaaccaggaggcagaagttgcagtgagctgagatcactgctctccagcctgagcaacagagcaaaacttcatctcaaaaaaaaaaaaagaaagaaaagaaaaagaatatatatatatatatwtatatatatatatatatatatatgaggattcaataccaacatcaattttcatattaaattgtatttattatgaaactcaagactctttttaattacaaaatatatagcactatcatagttaagtaattacagctaagtattaaatgtactaatcaatattcaaaatttagaactatacagtgataagaattattacatagataatagaaaatttgtttttctattctcttctctctcagcttcttacctccactcagaagcccaagaaaaaataagatgcatttaaaaatattaaaagattgtataactttttatttctgctttattttacagtccagaaaaggctatgaaaagactgtcattgaaatcaatacaccaaaaattgatcaagtacctattgttgatgtcatgatcaatgactttggtgatcagaatcagaagttcggatttgaagttggtcctgtttgttttyttggctaagattaagacaaagaacatatcaaatcaacagaaaatataccttggtgccaccaacccattttgtgccacatgcaagttttgaataaggatggtatagaaaacaaygctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaacaaaaaaagaaaratatatattcataaaaaatatggtgctcattctcatccatccaggatgtactaaaacagtgtgtttaataaattgtaattattttgtgtacagttctatactgttatctgtgtccatttccaaaacttgcacgtgtccctgaattccatctgactctaattttatgagaattgcagaactctgatggcaataaatatatgtattatraaaaaataaagttrtaatttctgatgactctaagtccctttctttggttaatrataaaatgcctttgtatatattgatgttgaagagttcaattatttgatgtcgccaacaaaattctcagagggcaaaaatctggaagacttttggaagcacactctgatcaactcttctctgccgacagtcattttgctgaatttcagccaaaaatattatgcattttgatgctttattcaaggctatacctcaaactttttcttctcagaatccaggatttcacaggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttcttgaatttgattctaagttgcatattataacagtctcgaaaattattttacttgcccaacaaatattacttttttcctttcaagataattttataaatcatttgacctacctaattgctaaatgaataacatatggtggactgttattaagagtatttgttttaagtcattcaggaaaatctaaacttttttttccactaaggtatttactttaaggtagcttgaaatagcaatacaatttaaaaattaaaaactgaattttgtatctattttaagtaatatatgtaagacttgaaaataaatgttttatttcttatataaagtgttaaattaattgataccagatttcactggaacagtttcaactgataatttatgacaaaagaacatacctgtaatattgaaattaaaaagtgaaatttgtcataaagaatttcttttatttttgaaatcgagtttgtaaatgtccttttaagaagggagatatgaatccaataaataaactcaagtcttggctacctggattggtcattttctttcttaaataggttccaaattattctcaatttcagataaagcttttgattctttcttgaccatccagattagaacagttttacacttctgaacaaacatattaccattcagagataagttgtctaaatcccccacatgcataagatagtgaaaaggacatggtaatactgaatttataaaataaaggtagattatacttaaaatttcaaagagatatttttgtaattacatattttacataatgatgaaagtatagcaataacagaatattttgcatattagcctgcatcagggatgcagtgttatccatttaaaccaaataaactttaatttggcactcaatagaatgaatagataattgaatgtctatgcttttatattctttccatatatagatatagtcttcttcaggacgtcagacttttttctctcccttatgattgatgtaatctagacaaaagaaagctcaccagaatagaaaaaacttgttagatgacattttaatcctggccccagcaggtatgttattcatatgaatacaaagaacagtattgaccttgaaggcagggtaaatcatggacttaatgcacatgaaatttgatctaactttaagaaataaaactacaaacacaaggtacagaagtgactataatgagtaaagatattacaacaaattattaattttattaaaaagttaaaaaaacaggaaatctgggaaaacaatgttttttctttctgaaacacttctgtgattttttaatattatatttttggctgcagtctctttgagtgcctctttataagagatttcataatttaacttaatatagagtaagatactctaatatgcaaggtgaaaaaatgtttcttattgataccttagaaatatttctgtttcatgtcttgttattggtaagtaagtattataaaatttttagattatttaaaaatttaggaaaatctctattacatatatttcatatgcactacaaaatttgtgagaaatttccacagactagcttctgattctgtttatttcaaatcttgtttctcctccactgcctatagattttatgttctgggaaccataaaacacatggatgccatggtacaaactcagtcttctttgtgatcatcataacatatcattagttcattcttccattgctataaagaaatacatgaaactgagtaatttataaagaaaataggtttaattggctcatggttctgcaggctgtacaggaagaatagcagtttctacttctggagaagcctcaggaagcttccaatcatggcagaaggcaaagtgagaatgagacgtctcacatggctggaataggtgcaaaagagagtgagaggggaggtgctacacacttttaaatagccatatctcatgagaactcactatcacaaaaacagcccaagaggatgctggtaaactcttcatgaaggatccacccccaggtccaattacaccacattaggtcccagcttcaacactgcggattacaattcaatataagatttgagtgtggacacatatcccaactatatcagtggatgacagggttattccagaaagccatttacactaggattgccggcattaatatacataaaataatgacaggttgtataattataccccatcatgtaaatatagtatacaaaccccaaataaatgaatctatatttgaattttctccttgctggccccttccactctacctaacaaaaggcgaaatgacaaagagtagttgcagtggtaaaacaacgttcttaactaatcatggtcaatcttactctggcaaattttactaataatatgaccatgcagacatatttctaggagacctcccagggtcttaaatggagcccatgcaaaagaagtgtcctggagcttaagctttatgagattcatgttaaatagatggcttcatactggataactgtaaaacatatgagttacctaacacaaaatctggcatatatcagctataaagaaattgctgctactctagatttctttgtgctgctattatcaccacagtataagtccctttctgaaatgtagctagtaacacctgtgctacccaatatcatataatttttataaagatttcatttgaacaaagtaaatattatacaaattgcatgatcacagagacccaaatcatcaaagagacttacatacaaactttacaaatgatttgcaaaagataccaaaaaagaacagcagcctaaggcattttaaatccagcaagtctgaattcaccagacatagcttatcaaatcttctttttctatatataccaaaatgtgttttacttgccagaggatgattttaataggtctttggggtctctcaactttggtactttgctagtttcatatccctgtactggctgtatgattaaccattgctcagtacagctgcagtcaggagatccatagattgcagaattatttacagaaaattttttaaagaaaaatatctcgcttaaaccattccaagttcagtaagctgtacatagcaacccatgcagaatcctcattcactattcatctaataaatccaactgtcaatatttagaaggagatggttcagggttaaaaaagaaacaatataaaaaaaaatttacaaatccacggttaactctttcctaaaaccacaacgtgaaataatttcagaaatgtttcatgctatagtaactgtgacttattttacaataacattataatggtagttctgtctataatactataagtatgagataaacaaaaccatggggatatggtttggctgtgtccccatccaaatctcatcttgaattcccccttgttgtgtgagaacccggtgggagacaattgaatgataggggcaagtcattcaaacgctgttcttgtgacagtgagtaagtttcacaagatctgatggtttataaagaggtgttcccctgaacaagctctctcattttttgcctgccaccatccacgtaagatgtgacttgttcctccttgcctttcaccatgattgtgaggctttcccagccaattaaagcccattttaattgaactgtaagtccaattaaacctctttcttttgtaaattgcttggtctagggtaggtctctatcagcatcatgaaaacagactaataccgtaccttgataccagtgaagtgggcactgctgaaatgatacctgaaaatgtggaagcagctttggaactaggtaacaggcagaagttggaacagtttgaagggctcagaagaagacaggaaattgtgggaaagtttgaaacttcctagagacttgttgaatggctttgaccaaaatgctgatatggtctcagatggaaatgaggaacttgttgggaactgaagcaaaggtgactcttgttatgttttagcaaatagactggtggcattttgcccctaccctagagatttatggaactttgaacttgagagagatgattcagggtatgtggcagaagaaatttctaagcaactagcattcaggaggtaacttgggtgctgttaaagcattcagttttataagggaagcatagcataaaaattcaggaaatttgcagcctgacaatgtgataaaaaaataaaatccctttttctgaggagaaattccagctgcagaaatttgcataagtaacaaggagaggaatgttaatccccaaaacaatggggaaatctctcaatgtatccagggcatgtcaaagatcttcatggcagcccctcccatcacaggcccagaggcagagcaggagaaatggttttgtgggccaggcccagggtcgccatgctgtgtgcagcttagggacttggtgctctgtgaaccagcagctccagctgtggctgaaaggggtcaatgtagagattgggccttggcttcagagggtgcaagccccaagccttgacagcttctatgtggtattgagcctgtgagtgcacagaggtcaagaattgaggtttgggaacgtctgcctagatttcagaagatgtatgggaactcctggatgcccaggcagaagtttgctgcaggggtggggccttcatggagaacctttgctagggcagtgcagaaagggaatatggggtcagagtcccccacacagagtccctgctggggcaccacctagtggagctatgagaaaagggccactgtcctccaaaccccagaaatggtagatccatcgacagcttgcactgtgtgcttggaaaaactgcagacactcaatgccagcctgtgaaagaagtcaggaggagggctatactctacaaagccacagagtcggagcttcccaagaccatgggagcccacctcttgcgtcagtgtgacctggatgcgagacatggagtcaaaggagatcattttggatctttaagatttgactgccctgctggatttcagacttgcatggggcctatagcccctttgtttggccaatttctcccatttgaaatggctgtattttttatttatttattttatttatttttttgagatggagtctcgctccatcaccaggctggagtgcagtggtgtgatctcggctcactgcaacctccacctcctgggttcaagtgattctcctgcctcagcctcccaagtagctggaactacagatgcccaccactacgtctggctagtttttgtatttttagtagagacagggttttaccatattggccagtctattctcgaactcctgaccttgtgatccgcccgtctcagcctcccagagtgcgtaagcccccacacctggctggaatggctgcatttacccaatgcctgtactcttaccgtatctaggaagtaactaacttgcttttgattttacggactcatagtcaaggagggacttgcttattctcagatggaactttggactgtggacttttgggttaatgctggaatgtgttaagactttgggagactgttgggaaggcatgattggttttgaaatgagaggccatgagattttggaggggccagtggtggaatgatgaggtatggctgtgtcccaacccaaatctcattttgacttcccacatgttgcgggagggacctggtgggaggtaattgaatcatggggcaagtcatttccatgctgttcttgtgacagtgaataagtctcatgagagttgataattttaaaaagaggcattcccctgcacaagcgctcttattttttgcctgccaccatccacgtaaaatatgacttgctcctccttgccctcttccatgattgtgaggcttccccaatcacatggaactgtaagtccaattacacctttttcttaaattgctcagtctcgagtaggtcttcatcagcagcaggaagatgaactagtacaccctgattcctattctaaaattacctctatatgtctatgcagaaataattaagtagcctttcttcccacaatgtgatgatttcctttttgtggaatctaaaaagcaaaacttacatctcagtagcaggtctcattccagtgataacacagtataagctattgagttgactgacttaattcacccccatattagggtgcatggtgtaactaaaatatttggctgctttttggctcatagagtgaaatgattatttctggggcccaaaggaagattcacatgaaatgatgaaaacttctttgctcaaccctatgtgagatgtccagactttgaattaaataaaacaaatccactacttacagattcctccagtcactgtggttcaaaggtctgtgcaaccaattccttaacaacacaggtttttgtatcttacctatttctgggaaataaaataaaacaaaataaaaataagacatagtaaataaatagtttaagccactaaataaaaaattgttcccatagctaccattcaatgggtaaaagtattttcaagactctgaaagttttcatgtaatttttatgtaactttgatgtttcttttcta

SEQ ID NO: 17746 - DNA, 30431 bp, Homo sapiens
cctgccgcctctctctttcctttgggtaaaagtaatatgggctctctttcccttcatggaggcctagctgtcatatggacacaggataggggcgtggcaggccagagtagtcttggaaaaggcaacatttgggtgcaaaaacaggaatgcctgttccaatttaggggcgtgggttcccaggcttgagggtggggcatttgccagggaactgccctcttctacccagtgtttctctgcctcccgtccatatcaactgggactacaggtacatgccaccatactccactaattcttatttgttgaagagacaggatctgattatgttgcccaggctggtcttgatctcttaggctcaagcgatcctcctgcctcagcctcccaaagtactggtattacaggtgtgagccaccatgcccagcctttacttgaattttaagaggaaaaagaaactaaaggaattactgaactttggataagcattatcttcaaaacaagggacatcataatacaatttttacaaaactaaaaatattactcatccaatttagattgaatatgcatcaaagatgtatttaactcattagtgagagaactattaaaataattcaaagatcatttgagtaacagagatttgtatagtttactggggatgaygttctgaaataagtttgttaaattagagcacacattaatatcctgtggatagggcaataaaaaaacctgtaacctctgggattatcttttttaatagacagaaatcatttgcatctggctacacacaagtttaaaatttaacatgtactttctcagaatctagggcctgatcaatggtaaacagaaatcaatcaaaagttcattcccctacagatttaaggaatgccgggttgggcctgttagtcaacattgtaatatgaccttgaaaaccatgcagtcatccttttacctgtttttttttttttttttttttttgagacagagtcttgctctgtcacccaggctggagtgcagcggtgcagtctcagctcactacaacctccgcctcccgggttcaagcaattctcctgcctcagcctctctagtagctgggattacaggcgcatgccgccatgcccagataattttcgtatttttagtagagacagggtttcaccatgttggccaggctggtctcaaactcctgaccttgtgatccgcccgcctcggcctcccaaagtgctaggattacaggtgggagccactgcgcctggacccttttatctatttctaagttttttattagatataaatttagttagcagaggaagttattcgagttacgggtggcaaatctgtacaggtctgcagcaacctcaattcttccctcctcaggaaaaagaattcaaatgaggggcctaagtgagaagagactgaggcaagtgttagagcaggagtgaaagtttattaagaagctgtacaggccgggcgtggtggctcatacctgtaatcccagcactttgtgaggcctaggtgggagaatcacttgaagtcaggagtttgagaccagcctgttcaacatggtgaaacaccatctctaataaaaattagctgggtgtagtggcaggtgcctgtaacccaagctactcgggaggctgagacaggagaattgcttgagcccaggaggcagaggttgcagtgagctgagaccacgccactacactccagcctgggtgacagagtgagactccatctcaaaaaaaaaagagagagagagaagatttagagcaggaataaaaagaaagtaaagtacgtttggaagcaggccaagcagacattttggaggtcaggtgtggggtttgaccttttgaatcagggttttacatgttggcatacttctggggtcttgggtcccttctcccctgattcttcccttggggtaggaagcactagcacaatgccctacttgggaggggagcatatgcagtgtgtttactggagctgtayrcatgctcacttgaggtgttcttccctttactgatggaatgcccccagaaggtcctagatgagttaaactccaccattttgcctcttgacgcgcatgcatgagctcactcgcccaactcctgggatcttaccaggaagatgctgatgaccattttcaggttttttctatctataggcacattgcctttccctggtgctggctgcaaccaattattattctagagagacagttaacaacctcctgaccatcacctgatggtcacctgacattcctggttgggaggagcctctcctgccctgtttatgtatgactagctacctacagtaacaatttctaagagatttcgcctctaaacttaaagaacattaagaaaaacatttaaagatatagttaatattaattttatatacatctctattaaagtatataaatttatatgtataattagtacaccttggaaaactgtctcataaaattcaaaagacagcactgaattctaaacaattccaaacaacaaaacattttttatttaaaaaaaagtttaagctctatgcttacttttagtgtgatttgtctaagaaatcaacaggagaaaactgatcaataaccaaataacttttataacactaaatcacaactgtgttagaaaaatgccctgagaaggtgataaaagcttgaaattattataacccttaagaaagtaaacacaaattcatattacatcttatatcctccctactaaaagagctaatcttgaagttttaactacagtttaggaaacggtgttttggctgggtgtggtggctcacatctgtaatcccagtactttgggaggctgaggtgggaggatcacttgagcccaggagttggaggttacagtgagctatgatcaagccactgcatcccagtctgggtgacagagcaagacctagctcaagaaaaaaattaaaaaacaaaaataaaaactgtcttttatcatttgcccagatgacacaacattgtcatttacttaatatttaacccatgataacctcatgtagattcttattttccagcaatttttaattgaccttgttaaatcaactttagcctaaagctgccttctcacttattttaagttcagcctaatctgtacatagtgaactgtaacctgaatcgaggtgtaaacaggctgtaacctactctcgtgccaatcactgagttttgtccagtcaaaggggaccacctattcaaaccatgtttgaataaggtaaacacccagctgtaataaattcagctgttgctgtacctcacttccatttcctgtgatcacttttctttttctgtctataaatcttctaccacgtggctgtgctggagtctctatgaacctactctggctcaagaggcttccttattcgcaaattgttctttgctcagttaaactctgttaaatttaatttggctaaggtttttagcaaccttttttcttattaaccaagagagtaatacttgtcttcctttcattatcatcattctgcatttgtacttgcagactcacaccatttgttttatactaatgaaaccaactttgcaaaaattataacagtgagaaaaccatgacaatgggaagatctgatctagcccactctcttcttgcctttagctttcaagctgccagacatttagtttatagtttagatgattagcccttccccaaaactcaaccacttttgtaaagctaatgagagactaccaggctaggaggatagaggagcctgaattttgctaaggtgaaagtgcagacataaatgattgccagccattattgtggaggtcacaagatatgcaacttcccaatttctcctgcagataacatcactactgtagaacctaagtttggccttctgagataccttttcaggtttttttttgcattgagatactgatgatggttccacctggacccaccaacagctcctgcggcaccacccagaagccattcagcctacaggaggtgaatttcccacacctctatgattgcaccccccaagcagtcagcagcaagctccctttgcctagccacattcatctcctcccccaaactacctttcaaaaacttttaacctgtgagccttcgatgagattgatctgagtaataactctttactgcaatgcgatggtttttgtgcagcaggtacggtatctatctcaccgttggagacattcttcaaggaccttgtaactgcacacttggaagtttgttaagggggtaaatctcatgttatgtggctgatttgttttgttttgacacagggtctcactctgtcacccaggctggagtacagtggtgtgatcataggtcactgcagcctgcagcacgcccaagcacaagaaatcctcctgcctcagcctctcaagtaactgggactgcaggcccgtgccaccaagcctgtttttttttttttgtagaaatgaggtctcgctttgttgcttaggatggtctggaactcctgagctcaagcttaagtgctgggattacaggcatgagccactgtacctggccatgtttttttttaatgtctcacacacacacacacacacacacacacacagcctgttgtatgggggcgggggaatgaggagagccattaaataaataagcacttaaaatagaatgtgactggtgctatcgtagatttaagtaccagatagatgctgtaccagaaacactgaaaagggacacctggcccagcctcgtgggagcgacagccaagaagtctttctggcagagctgactgctgagtagagttaatgggttgctaggaattagtattgcacagggccaatttacccattaggcatttagtattggggtcctgaaaaaaaaaattaactccaaaagaaaaaagtataaaatctaaattaataggtgcatcactatttaaacttaatatgcatttaaatgccattacattagaaactagaggagttgtgcatataaggagaaccctattctgaaggactttctacactcatacacaaaccttggagttgactcaagtccatgagaagccactggcagattctgtttgaaaaatcacagccaagttcgcagattagagaattccctctggtggccaccctttatcataggctttggaggcacttgaaggtccaagatggggtggttagaacttgacgtggcatcatcagtgcctgggaaggtcttctagcctctaatcttgagattttccagttctccattttcgtggccagcttgactcattcttacctttgaagtccctttgtttgggaggccgaggcaggtggatcacctgaggtcagtagttcgagaccaacctgactaatatggtgaacacccccgtctctactaaacatacaaaattagctgagtgtggtggcacatgcctgtaatcccatctactcaggaggctgaggcaggagaatcgcttgaacccagaaggtggagtttgcagtgagtgagaatgcaccactgcactccagcctgggcaacaagagcaaaactccgtctcaaaaaaaaaaaaaatccctgtttcatagtaggtagttattcagacatgagcagggcgggagagccccctgccccaccatgaatgtcagacaaccatcagatgatggtcaggcagttgttacactgtctctctaaaacagtaattggtcaaagccagcaccagcaaagacagtctcccaatagatagaaatatctcaaactggtgatcaacagtttcccattaagatctcaggagtcaggcaagtaggctcaagtatgtgcactaagaggcaaaatggcagagttcaactggtatgtgacctaggaacacttgactggtcaagaaggaatgcctcaagtgagcatgcgtacaactccagtaagcacactgtgcatgcagcccctccctagtgctggcagaccactgcgcatgcggaatgccagcatataaaaccccaatccaaaggtcaaaccaggcacttgaatctctccagtcacctgcttggcacttttccaagtgttctttactttcattcctgctctaaatcttgtctcggtctctcactctgccttatacccctcagttgaattatttcttctgaggaggcaagaactgaggctgctgcagactgatatggattcaccactgctaacacctcctggttggaactacaggaatagaactggaaagggaaaaaaggcagcattcaccacatcccaatcctgaatccaagagtctaagatagtcccccactcctatctcaggcttagaggattagattaatctcctggagggaagactcttccttgaaacatttttttttatctgcctgtagctattgggataattcgggaaatccacagggacakttcaagtcatctttgtcctctactttctgttgcactctcagccttgttctctttttagaaactgcatggtaactattatatagctaaagaagagcattctgmcctctgccctgggacttcctggatcctcctcttcttataaatacaagggcagagctggtatcccggggagccaggaagcagtgagcccaggagtcctcggccagccctgcctgcycaccaggaggatgaaggtctccgtggctgccctctcctgcctcatgcttgttgctgtccttggatcccaggcccagttcayaaatggtgagtccagtgagctttctcccaggtgaccaggtccatggtaactcaagctctgggacggagacatgttgtgactactctccagcccagacatggttatggaacttatttaaaaagcaccagcagggtatagacctggctctgtctgcagcctttggaccctggcggggaaaggtacacagatgactggtcccatttrgggccaattatttcccttttcacagcaaaaattatctgattttttcccttagctgatattttagctggaacaaaagaactgtaattaaattgtaaatttgtaaaaagaatcatacaattttatggtgctagaactgctatctaccatctggtgtaaaattatgatttgtgagaggaaaaggaaccagccaggtaagtgactcacccaagatcactgtctcacttgttcctgtggaatcttaatttgtggaggtgaatgtcaacgcaaagaggtcaatgacattgaaaaaagaatgtattatttacatttcccaagagaaggaggtacaccgtgmcacacggggccccaagggaagcatccagggcaggagtcacgggcaggagtcacgggcaggagtyacaaacaggagggaagggacaacctatgccagaacctttattggggtttctcgggggaaagcaaggcagcacagagcatacactttagggctgggtagtctgaataagcctttcaggctttggggtatagggatagtctctagctgtctagtactcatccttaggatgatttagagcagtggaaatactggcttggtgtgtgtgagttagcaaaggaggtggatgggcatatgggctcaggattttttgatttgtatatgaaaggtctaaacccttagctatctctatgaattggttagccctgcaatgggcagtctctcccgagctgtcaagatttttttttttttttttttttttgagatggagtttcactctgtctcccaggctggagtgcagtggtgcgatctcggatcactgaaagctctgcctmccaggttcaatgaattatccttcctcagcctccagagtagttgggattaaggcatgcgccaccaagcccagctgatttttgtgtctttttagtagaggcggggtttcaccatgttggccagactagtctccaactcctggcctcaggtgatccgcccacctcggcctcccaaagtgttgggattacaggtgtgagccaccgcgcctggccactgtaaagatttttttttttttttttttgagatggagtctcactctgtcgcccaggctggagtgcagtggcacgatctcagctcactgcaagctccgcctccccggttcacgccattctcctgcctcagcctcccgagtagctgggactacaggcgcctgccaccacgcccggctaattttttgtatttttagtagagatggggtttcaccatgttagccaggatggtctcaatctcctgatctcgttatctgcccacctcggcctcccaaagtgctgggattacaggcctgagccaccacgcctggctgcatttttctatttagcataatacaggtatgcaatcccttatcaaaatcctatcaggctagatgtattttggaatacagaatttctctggtttttaaaaggtaatacacgctaggcatggtggctcacctataatcccagcactttgggaggctgagctaggagaattgcttgaccacaggagttcaagaccagcctgggcatcatagcaagacctcatcactacaaaaaggtaaactattagctaggcattgtggctcgcacctgtagttccagcttctcaggaggctgaggcaggaggatcacttgagcccaggacctcaaggctgcagtgagttatgatcataccactgcgccccagcctgggtgacagaaaaagaccctgtctcaattaaaaaaaaaaaaaaaagtaatacatacctagatggtacttatccttggtggggccaaggaagactatttcaatcaaacacagcaatttttctgtagcaaacacatgaatatttctgctaactgggatgaataaataccayaatagactcacttcacttaaggggatactgtgccaccataaacgctgataaaacctctctgtttccagagccctataataaaaaattattccagaaatgtgtagaaaaacttgtagactgtgtcacatcatgtagacattccattaactgaaccgtgtkaggttcagttgcttttagtatttcagagtcaatacaaagttttcatgtctacattttcaaaaggtctctgaaaagtctcagggccctaatggaataaatgggccaggaggcaggcctagaacccagacaggtggtggtggtccagcttcagagcctctctgcctcaggaggaggatgagcaatggggtgggtggagatgttgaaacatactgctgccacccagtgatttccttccctgtactgtttctttcagatgcagagacagagttmatgatgtcaaagcttccactggaaaatccagtagttctgaacagtaagtgatcagatacggcatacatttaaaagcagccagcaggtgcaggtctgcactatgggatccattgtccctgtttacagaatgrgaggrgaatgagagggtcctgagggtggtgaatatctccaaggragatcaggacagggtagggggaccccctccatagatgccttctctgttcccctctggctgccccaagagcctgctcctttggagaagaaggtgctctctgatgcctgcaggtgtctgcagatgccttccccttctgggggaaattttcttggtcctgctgtggcccaccctgagtgccctcagacacatggcaaaaccctggggagggtctgaagcagggagaggccagcaagtgctrgccgaggaggagaaacatgtcttcagaggcttgtgccttctcaccctccactgtgctttcgaggagaaagatttgccctcagatgacgctttctcttgctgcaggctttcactttgctgctgactgctgcacctcctacatctcacaaagcatcccgtgttcactcatgaaaagttattttgaaacgagcagcgagtgctccaagccaggtgtcatgtaagtgccaagctcaccaaccatgtgttggggaagaagcagcccacagcatcttgcagggaggacacgacggatgggcgtccatcgggttccaccctctggatcctgccagatacagggcagctgtgtccttacgaggattctgcagggcatcagggatgagacactcccagtggagaggagatagggaaggaagaagaaagcaagcacaaggcttcccaaggacacttccatgagtcattaaggagtcccacaggctgagagggtctcaaaaggacactgtccctgagctgccatcagcagagaaaggaaaaaacaggctgtgttsactgggaaatctgaggagcagggaggatggggccccctgtctccatctgcccacacctcrgtttgtaatctttctctcccttgttccccagattcctcaccaagaaggggcggcaagtctgtgccaaacccagtggtccgggagttcaggattgcatgaaaaagctgaagccctactcaatataataataaagagacaaaagaggccagccacccacctccaacacctcctgtgagtttcttggtctgaaatacttaaaaaatatatatattgttgtgtctggtaatgaaagtaatgcatctaataaagagtattcaattttttaactttgcttgagttttaagaggaaataaactaatataaaactgaarcaactgctgagccccaacatgattaaatacaaattcaccttatatctcatcttctcccttctactgaaatagctaatcttcaaagggttggctacaatttcaagaaagtttcttttactccatcatttacccagttcacaccattttctactttacttaacatttgatccattataatcccataacaattcttatttttctcataatttccttttgatatttttctattaacccaaagagaaatactttttgtttccttatcattccacatttgcacttgcatatttacaccatcggtttcatggtaactacttcattcttcgagacagtcttcaaggaccttctaacttcctattccaacttgcagaaatgctttctggacctgccaaaataataataataataataataataataagtcatactgggatttcttctcatcacacacctgagttcattccaccatgacacgtagcccaaaacttcctcttcctcttccttccttcctaaaagggtttatttttcattttgctagaatatctttgaactgccttctgctttaaaagatgacaaaagcaaacactctcctttgctccatgggtgccagggcaggcatccccaactcaggcttggccaacctatgctccctttcagagatctgagcctggaacargtgttgcagagaagcagaaaaagagaggactcacaccagttgactcttgtggcatgattttggatgtggcattggagctggtctctctaggmttctacctcggcctcccaggttcaagcaattctcctgcctcagcctccctactagctgggattacgtgcctgccaccagacctgactaatttctgtatttttagtagagacagggtttcgccttgttggtcaggctggtctcaaactcctaacctcagatgatccacccacctcggcctcccaaagtactggaattamcggcatgagccactgcactcagcctctacctacttttcaagccttcctgatactacctaaaatctttgcagtaaagtcctttttgcttaatcaaccagagtcagtttgtatagctttccaacaaaaaactccaactgatatgaacaataaactttctgggactttgaaggtctaaaaactttggtctttaagtgtgaaaatggttcaactgaatatgaaagttcatgttgaaaataattttctctcagaataatgtagacattcttcaattgtcttctagcatctcagacagggccaaaattccaaagccaattgatttcttattccttagtaagaaaaaaaatttttagaccctctgggaatttttagaatttttttctttttctattgtctttatttttataatttcaacttttattttggattcaggggttacgcgtgcaggtttgttgcctgggcatattgcatgaagtttggggtacaactgatcccatcacccaggtactgagcatagcacccaatagtttttcaaccsttgcccccttccctccctccctcctgtagtagtccccagcgcctattgttgccatctttatgtccatgtgtaaccaatgtttagctcccacttacaagtgaaarcatgtggtatttggttttctgttcctgcattaattcagttaagataatggcctccaactttatccatgttgctccaaaggacatgatttcattctttttatggctacataagaagtagctcatggtgtatctgtaccacattttcttatccagtcgacactgatgggcgcctaggttgattccatgtctttgctattgtgaatagtgctctgatgaacatacgagggcttgtgtctttttctgtacaatgatttttattaatatatatccagtaatgggattgctgggttgaatggtagttctgttttaagttatttgagaaatcaccaaactgcttttcacagtggctgaactaatttacattcccaccaacagtgtatatctgttccctttttctctacagcrtcaccagcatgttatttttttgactttttactaatagccattctgactggtgtgagacagtaactcattttgggtttgatttgcatttctctgatgattagtgatattgagcattttttcatgtgtttgttggctgcttatatgtcttcttttgaggaacgtatgttcatgtcttttgcctattttttaatggggttgtttttggctgttcaactgtttaaggcacttacagattctggatattagacctttgctggatgcatagtttgcaaatattttttcccattctgtaggttttctgtttactctgttgatgagtttcttttgctgtacagaagctcttgagtttacttgagcacttgtcaatttttgtttttattgcaattgcttgtggggatttagtcataaattatttgccaaggccaatgtccagaatggtgtttcctaggttttcttctaaggttcttatagtttaaggtcttatatttgaattttgaatccatcttgagttattttatgtatatggtgaaaaataggggtccagtttcattcttatgcacatggctagccagctatcccagcaccatttattgaacagggaatccttacccctttgcttatttttgttgactctgtcaaagatcagatgactgtaggtgtgcagctttatttctggattttctattctgttctactggtctatgtatctgtttttgtaccaataccatgctgttttgtttactgtagccttatagtatactttgaagtctggtaatatgattcctctagctttgctttttgtttaggattgatttgaccatttggactctttttattggttccatatgaattttagaatagtttttctagttctatgaaaaatgacattggtagtttgatagaaacagcattgaatctgtagattgcctggacaatacagccattataatgatattgattcttccagtccatgagcatggaatgtttttccatttgttcatgtcatctatgatttctttcagcagtgttttgtaattttcattgtagagatctttcacctccttggttacatgtattactacgtttktgtgtgtgtgtgtgtgtgtgtgtggctattgtaaatgagattgcattcttgatttggcaytcagcttgaatgctattggtgtataaaaatgctactggtttttgcacattgattttgtgtcctgaaactttactgaagttgtttatcagttccaggagacttttggcagaggctttaggactttcatatcattggtgaggttgtcagcttaatgtctggcagacagagtaaggggatagggatgggagtagttttcttgtccttgaccagaagttatccagggcactgcccaattctctctctggtccactgtcccctccaagaggttcccacagcaaatatccttttttattttgaaaactgtgcttgtagctttatcctggggcaaatgccctacctgactatcctgaatgggaactagcaaggtcatagcttattcactcaatgcaaatgtcttctcccagtacccactgactctgatcttcacattatccagggttctgctgggaaaatcctctttttctatgatcttctccttgacctatatgaggatacatgttttttcagccttcttgtgatctgccatcaagctgacccatgttctttttttgttctttcttttttttgagatggagtcttgctctgttgcccaggctgaagtgtagtggcgtgatcttggttcactgtaacctccacctcccgggttcaagcaattctcctgcctcagcctcctgagtagctgggattacaggtgcctgccaccattcccggttaatttctgtagtttttatagagatggggtttcaccatgttggccagtctggtctcaaactcccgacctcaagtgatctacctgcctcggcctcccaaagttctgggattacaggtgtgagtcactgcacctggccccatgttctttatataaaacagaaatgtctcaccttatggtagaccaatgtcatattttctgactccttactgctactatgagttctatttatttttatatttcttctgtcatttcaacaagatttacagagatgaaaaagacaaacacagatgctcagagttctggcttactttgttttgtttattgagacaggctgtcactctgtcacccagtctggagtgcagtggcacaatcttggctcattcaccttggctcaacctcctgggctcaagtgattctcccacctcaggcccttgagtagctgggactacaggcrtgcaccactccacacccagctaattttgtttatttttttagagacatggtctcacttgttgcccaggctggtcttgaactcctgggctcaagtaatcctcctgcctcggcttcccaaaatgttgagattacaggtgtgagccaccacacctggcstctggcatacattttgatccagttatgaccttttatgtctctctcactgctccactgaatgctgttgaattcagaagctttgagttgaaagcagctcactggtacctaaatatatgactaggggatggcaatccggaagcttctggattctccatggagattttgtctcagagccttagaaaaaaatttaaatggttattcaattaaaattgtcctagacctaagtaggattcatgtggtttcactgggttctctctgacaggtcaggtttttagcttagaaggatgaaatgaggagggagagcgtctgggcagtgtggatgccaaagggccacttatgaaggtgttgggtcatggcaactcaacagaaatgagggatgaaaaccaagactttccattctttttttttttttttttttagatggagtctcactctgtcacccaggctggagtgcaggggtgccatcttggctcactacaacctccacctcctgggttcaagtgattctcctgcctcagcctcctgagtagctgggattacagggacccaccaccacgcccagcagatttttgtatttttagcagagacggggtttttccatgttggctgggctcgtctcaaactcctggcctcaaatgatctgcctgcctcagcctcccaaagttctgggattataggcgtgagccacccaccagacccrgcccaagattttccattctaaccaagcatctagccactcacagaaggtctttgaggtcttgaaggggaaaaaaacatgctatgtgcaggttaattgcataatacatactctgttctcgcagttcctcagaaacagcatgttcttttttgcttccttgctttgtgtggtgccctctgccaggcatgccctcctctcaactctgcccagcaaaactcaacccaacctcaatggcttagattaaatgctaccataaaaccttcccccttcatcccagccagaaggacccacctccatttctctggaatcttgaaacatrtatttattgccactcaaaaagatttttattgagtggctgctttaggttatgcattgtgctargcattaggaaaaccatgaaaaccaaacaaagtagactattgcccttcaagamtatgtcagtccagggccgggcacggtagctcacgcctgtaatcccagcactttgggaggccaaggtgggcagatctcctgaggtcaggagttcaagaccagcctggccaacatggtgaaacgccgtctgtactaaaaacacaaaaattagccagacgtggtggtgtgcacctgtaatcccagctactcgggaggctgaggcaggaaacttgcttgaaactggaaggcagaggttgcagtgagccgagatcatsccactgcactccagcctgggtgacagagtgagactctgtctcaaaaaaaataaaaaataaaaaagaatatgtcagtttatagagaagactgaaaataggaataagaatgatgcttgggtgcaaaaagtcatatctaattcattgctaagtctccacatttttatgcaacatcggagcaaaaagaggaggacatktatactagaggcaaccaacctgggactcaagtatccccaggccctagttggactggccagtgactgaagggaccaacataagattgaaccacagcatttagaaagctgtgtgatagatagggcttctgaaactttagcatgcataaaagccaccaggaaggcttgtgaaaacacagattgtgggctcccacccctagaaatctggttcagtaggacaggggtagggccaaagtgtcagcatgtttaacaagtttccaggtaacgctgatgctgcagaatgcagtggaaatttgaagaggactttgtaacttcaccattgtttgcagtattctgaaaggcacatatttctttagtaatcaaaaaataaaagagttgaaaaatgcgtcttaattgtcttttcaaggatgtgtaacaaaatgggccagctcttcacttgtgttgatatctgatttttttatgatgaagctcatcaaagctgtttaattataaaagaaatatggagttggaaaaagttttacacatggttaaatagtctgacgatcaatttggaatttttaaaagtaaaaatcttgagctgggtgcagtggctcatgcctataatcccagcactttgggaggccaaagtgggcagatcccttgaggccaggagtttgagaccagcctggccaacatggcaaaaacttcctctctactaaaaatacaaaaataagccaggtgtgatggtgcgcacttgtagtcccagttacttggaaggctgaggtggaaggatcacttgagcccgagaggtcaaggctgcagtgaggcaagatcgcaccactgtactccagcctggagtgacagtgacagagtgagaccctgtctcaaaaaaaaaaaaaaaaaaattggaaattgtacaaaatagctagaaaaaaaagtgcataaaagtcatcttaaaaatctaaatagagggctgggcacagtggctcatgcctgtaatcccagcagtttgggaagccaggagttcaagaccagcctggccaacagggtgaaaccccgtctctactaaaatacaaaaattagccaggtgtggtggcaggcgcctgtaatcccagctactcgggaggctgaggcagaagaatcacttgaacgtggaaggcggaggttgcggtgagctgagatcataccactgtactccagtctgggcaacaaagcaaaactccgtctcaaagaaaaaaaaaaaatctaaacagagcttcacagaaatcatcaagacataaaataggaaatagaaacattcatatttttattctttttagaaccagagacaagatttaaaagtaatataactcatcccctcaactgagggctcaaccagggccagggcagagaagatgatgcacatggttgaggccagtgggaccagaggccagaatacagccagtgtggccaggagatttgttacatacagggaactcagcaaataagtacatacattgaggttaatgggagcaggagtccccattgttagaggagggagggaaacatagaaacaggaaagactgaaataactctgtggtgtttacttggaattggacatagtggtataaacttttgttttttcatatagctagaaagaggacatagaaattgctaataataggacgagcgcagtggctcacgcctgtaatcccagcactttgggaggccaaggcgggtggatcacctgaggtcagaagttcaagaccagcctggccaacatggtgaaaccccatctctaaaaatacaaaaattacctgggcaaggtgacctgtacctgcagtcccagctactccagagggtgaggcaggaagatcacttgaaccccggaggtagaggtttcagtgagctgagaatgcaccacctcactcctgggtgacagagtgagactccatctcaaaaacaaaaacaaaaacaaaaacaaattgctaataatatatgaaatagatatacttgaaatagacataaatttaaatacatacttatacacatatgcttacatatatttccaggttctagccactaaaagctcagatctaaaagtgatgccattcccatagcaatgaacacaccaagcactcagattttggtttctcaaaatcatttttcagtaaaagaaactgagactcatggaagaaatggctaattccagagctgggccaaggaaagtacaagatgagtctggaacatctatttgtgccaaaaagtaagaaaacaagattaaagaataaaccctaaaattttctagagaggggaaacaccagatcaccacaaatgagtttcagaagaaacatattcttatattccattgtagaattctatacccaacaaaaatatcaatcaagtatgaaggctaaataatgacttcttcaggcaagcatgaactcagaaggtttatgtcctacagatccttcctgtactattcagttttttaaaccaatatatgtatgtgttgctttgaaaaacattttaaatatttttaaaataggctcttcatactcaacagggggcaacaggaggacatttaaggtctctaattatgttgccatcaaatttcattcatctggttgtattgcaattctcctttactttttttagtccctctttgagttctgagacctctgggatcagggtcatcttcaatccctccctccaagcctagcccaggacttggcatatgatactgtgtcaaagaagtgatgtggtcacaaaacctattcctttttcttcctaagcatacagatgatgtatattttccatccctttgtcattatgttggagccaggttacttgatgctggccatggaatgtgggtgaaagtaatttgtaccattttcagaactgatccacaaaaatctcccaatcctcctctgcttctccctttttgtatcaagcttggaggccttgtgctgaaaatggtggcatccaaggtagaaaaaggcctggttcctgaatgagtacatggaggatcccaacacacacaccatcatcccactactgacccacactggactgtaacatgagcaagaaataaacttttatttaattagtctgctggattgtttatgatagcagttggcacacacagactaatgtaggtaggaactcaatacttgctggaaaagtacaggaacttcctgtaagtctcctagaaacaacttggcaggttggctagtttccacaaaaacaagaagtaagcattatttctttccaactcacttttcctataaacaacttgtttcctgagattgttcctgataacaattattatcatttaacttgaagggtttacataatgttgttattgatgataagaaatatagaaaatttttaattgatgactgtctccacaactaaccatgagatttcagccatttcctataagatacacatatgtagacctggctcaatttgtttattcatccttcttttaaaatgtatattcataaagcacctggtatacactaggttctgcgtgaatgggcaaagataaataatagatgttctccatcctgatgattcagatgaggagaggagattaaataaccatctaaccacatcagcaagcagaatgggggatgtacctccaagaacagcatggtgagggcactaagctgagagcctgcrgagatgagatctgtcctgcatccaaatcactgtgtgcacatgagaaagtcactggtcctttctgattcccagcttccattcagtaaatggccagtttagacaaatcaaatggcagatacatagcatgcaagctgcactgcaacagaaactgcacgttggtcacagcgtatcttcccaatgtgcctggatatggcctcagaatcatttccaacacagagctccagtccaccactaatcaatgaaacctactagctatccctgaattagacattttctagggttcccaccaagcttctttgcagcaaaagtcagagaaaccaggagaaggtcccaaagagatccactatctgatttcagaaaggactaagactaaaggctttatagaaaacccataagcttttacagagctccgttgggagtcccatgtttctttatggcataatgggtgagaacacagacttggaagccaaaccacctgaatttgaaccccagttccatttaccaactgtcaaaagcttaggctttgattctgagcctgtttcctcaactgctgttctaaagattaaataggctaatattcataaggcawctgggacagtggcttgtgtgtatagcaaccattatataagtgaattatctactgagcaccacagcacttcttcactccatggtgtggtgaccagaatggagatgagacagagaactgcaggttctgcttcgagtttaagttaggatttcccttgaccaatgagacctgacttggaggagtcctggcctcattccattaccccaaacaccctctagtctctagatgaacagatcctgaatgtccaggccccacgtggcctgttctaaggcctgagatggaattggatacaggacacatccagccttgagatcttttgctaagtgtgasacagtgcccccagccctgtgctcatgttcatgcctagggaaaggcttctatcaaaagagttgaacttcttcccactggggatggaagaccatttcctcccttaaaccttggctctccctgcttccttcaggccaccaacaacacatgtgcaggatatgaaattgctgaggcatcactgctttcctacttcccttccaagtctcagctcccttattttaaaaaatatttggcctcaatgatcatttctcaacaattcctcaccgcaggagcctctgaagctcccaccaggccagctctcctcccacaacagcttcccacagcatgaagatcyccgtggctgccattcccttcttcctcctcatcaccatcgccctagggaccaagactgaatcctcctcacgtgagtgcaatgccttgtcttccttccaacctagagcctgcagggaaataagcaggagtgaggttggggctcaggggaagaccaggagcagggactcagaaaggagggctggtatcttcttgaaattgtgtgtatagcaacattatataaatgaattatctactgagcaccacagcacttcaccccatggtgtggtgagcaggatggagatgagacttaggactgtaggttctgcttaagagtttaagttgggatcttccagccttgaccaatgagacttgacttgggagactccaggcttcattccactaccccaaatgccctctagtctccaaataaacagatcctgaatctccaggcctcacatggccttgatctcttatcattgccccccaggaccagtccccccttgccctcaaggacatggagtgagaccagcctgcctctctactccctcaatttctctctctttgccgctaagcaaaagagtggcccaccccatttggggtatatttcctcagggagattaggagcagtgtcttgagcccctcaagggcatttttctattggcctcctgaggtttgggcccagcctgcttccagcgtcacctgtgcccagtgagtgcagcattgcttgggtatgggctggggggaaacacgacagtgtggggtccatcctaggcccccttttctcagctgatttcttagaataagctgcctttagagataaccaaaactatttatcactcttccattttacctactctccttttcagaaactggggggaaaccgaaggttgttaaaatacagctaaagttggtgggtatgtgcacagtttgacttgccctctccgatgtcatttgtcagctcagaggaacaaggtgggagagtataggagctctgactgggtctcaggaaacaggggccccttatgccgttctttggatcgtgaggatgctgcctggaatggagctggaaaacaggatgagacccttccacccagacatctggccaccctcagtgacctctgaggccattgtgatgcacatccatgattctatgaagcagggtcacataacatgcacacacctgatttctccactccataaccacaacatgtgcctgtttgtacagggctcttggcctacaatgtccttcctgctacctctataattcaagcttggggtggctgctgtcaccttgcttctcctataaaagccatgaaacttctcaatcagaaaatagatgaaaaaatcacccaatccagtgatttttaaaactttttagaccacaaaaccttttcttcaagcaatatcttccacagaggcccaatatgtaaaacagaaaaaatgggttgagtagggtacaagacaccactctcaaatgcagcarggcctccacaatagtccctgaggcccccagagctccagggagctcagtgtaaaaaccactgatgcagtccaagggcctcatttacagaggagggaacagggggaaagtaaaatggccacagtacacaggaagcacaggcaaggttaggttaggatttgggtgccctgactctgtggcctttgtccttggggcttgctgtgggcatcctgctctctctgcaggttgtcggttcaatggggacatgggcagggtggagcactaggaggggctgggtttgcattcccaaatggcatgtctccaaatccctattgggatttcttccaaatattcctcctatttggagcacctttcccgaataaggcatgaaggctgcatgatattggccaagtccctagccttctctgccagtcggcccccagagatggtgtaagaagatctgagtgtgctgctcttcaatcctggagttgaaagtcatccaccagtctttccaagaggggttgaagaaaaggaggaagggtgattgatgatgagggaggagaaaaagaagagcccaggagtaccatggagaaggagaagagaagatgaggaaagcctactctcccctccaagttctgaggggctgtctcctccttccttccctcctccatgccctcagcttgcaggagcagccaatggtatggcctttaacaaggggcccctcctcagcatctgatgctctctcctcagggggaccttaccacccctcagagtgctgcttcacctacactacctacaagatcccgcgtcagcggattatggattactatgagaccaacagccagtgctccragcccggaattgtgtaggtggtacacacacatcacactggggggagagggagccagcagggcctcctggagggaagcagggagtggtggtggaatggggacccccagcgtacctcccaggtgtgactacatggggagaggcagctgaggggcaatctgagcgctttctggctggagcctgcaggagccatggggaaactgaccccatggatggggagatgacagagaagggagaagaaggcaagagggcacttcctcagggggacacagagactagatgggtctaggggtcctaggaaccgaagagtatgtctcagagaggagactggctctaagctgcctctgtggaagaaaggaaaagcagtataggtcaggtggggaatttaggagggagggaagatgggctgtctcttccggccactgggcccctcggtttgtgatccttctccctcttgctccacagcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttccctggcctcattcctttctacgggatttactcattggccatgcactgaggacaccagggtgtggcaccctcggcatcaagcctcgctctgcagaagttttgctggagcctggtacaaaaaataggtcaggcctgcaatgcaggtagtgagaagcagaaagtgagaaagaaaagcagtgtaaagaccgtctcctcctcagcaacaacagtagcagaccccgttttcttaatgctttctatactccaagcactctgctaggcagtctgtatgcattatcttatttaagcttcatgacaagtgtaaaagctacaaatcatcatttgattttttaggtaacacttcataaagggctctctatagcagtcaaactccatagtccttttttctgtgctgttttcaaggcctttcttcactgctgtctggaataggaatgatgcatgaagacattttatccaacccctccccttcgcttacacacatcagattatactatattgttttactaacttttttatcccctagaaggcttagcagaaagcctagcccataccaggtgttcaggaaatggatggatggatggatggatgaaggaagggaagaatgtgtggatggaaggatgaagggaaggaggaatggatggagggagggaagcagggagggatgaagggagggaggaagggaggaagggagggaggaagggagggagggatggatggatggatggagagaaagagggagggagggatagagggacagatggaataagacagaaatcaagaggaggactatgctccaagaataagctctcaaacctatcttcagggcccaaggaggagctctgtgtacttggaataagagcttgcccagagtagggattatgaccaccctttcctggcctccagccttccacagataaggaagggcttgtgggccacattaagggccatatgggggcctgcatgccaaagtcacaaccaggcttctcaggccttgtcacctccataaacagaggtcaagaggatgccccacatacgtaccctccctgccctcacaaaaagccacagcttcaccaccaggtgaagccttgaacccaccaggagtaactgcattatacggtttacctatctatgagcagtcatgccaagcagaaagccccataaggatctgcacagtccctgtttctgcccctgcctcccactgccctcaacacctgaaacacatcacctatgcctctaaagcttgctgtccatcaacagcaaaatcccttatatctttgatctcttctctaaatgcagctttcaacatggaaaagggtcctgaggcacctgaagagagaggaagctgtgggacaggtccagccagagcccaggccagaggggcagaagctggagtcctggagcacagacgcaggttgtcaggtgcacagagttggagggtcccctgctggtcatggttggccatgggggcacccaggagggatcagcgagctggctacacctaaaaatcagtccaaagtccgaggtccaaagagataaataaaaacattgacaaataagtcaaacggtccagcaacaaatggggacccaaggatcaggcacattgttttttttttttttggagtattagcatacactgtgacatgaaagagtgtgagctcaatcatgtggccttggactgggagagggcatttccttctcagaggcaactaagccctacctttgcctcagtctgggctctgtaatcctgctttgtgctcatctccccaagactgatcacctgggggaagctggggtggttcaaccctgcctgcccttccccaacatacagatggtggcaggtaacatggtgaaatcaaacagatctggtttttcatccgcctatccacccaggtgaccttggacaatttatttagcctctaggcctcagtagtcccagggaagtaataatcgctacttcactattttaaggattatataagatagggcatgtaaggtagctgacacacattcgcccatttcttcacgtgaattcagattctactgaattcagctctgcaccaagtcccatcctctgctgccctctgtttcagcaaacactgaggcctgttgtttctcctcctctaccggctctgatgcggtcaaggtccagagagctgagtagttggcaagcggaccaccagcaacagacaacatcttcattcggctctccctgaagctgtactgcctcgctgagaggatgaaggtctccgaggctgccctgtctctccttgtcctcatccttatcattacttcggcttctcgcagccagccaagtgagtccacttgtctctgtagggcaggaacgagaaagggggatggagcagctggcagggaggtagtgccaagggcgctgtcgggtctctggcctcataagaccctgtgggctctccccaccttcatgcatagcttctgacctccaattctcccctttgtaagtagagctggggttggtccggatctttctggggtaagtagttccaggaaactgggtcaccatttcctcaggagtcccaagcgtggtgagcaggaatgatcattcaggaggagaggccaagaaagcagcagaaaatgcaacaagaagtgcatgcaatgaaagggagggggaggcacgcggatgagaaagaaaagtggcaggtgccctggaagaatgagtggcgagaggaaggaaggttcaaacaatcatgtgggtctaagtccaggaattgggagtctgaaccgagagagcccttcctcaacatggctggcacaggttgctgggactatcagacaaccaaaatgagtcccagtggaatggctgcttgggaatctatggtccccttctccatcccccagcctatgactaaataaaatctgcagaaaagaggaaaggggttgaaaggttttggagctgtggggaaagggagaattggggcctatggaggagggggtttgttttgcccctccgtatctcctccctctatcattgtttacgaggacctggtgacgggggtggggaggacaaagacgtgtacctgccctaggctgccccagccattcttttcgcttttgtttttttgtttgtttgcttgttgkgttttgttttgttttgttttgtttgtgatggagtttcgctcttgttgcccaggttggagcgcagtgtcgcgatctcggctcaccacaacctccgcctcccgagttcaagtgattctcctgcctcagcctcctgagtagctgggatcacaggcacacaccaccacgcccagctaatttttgtatttttagtagagacggggtttcaccatgttggtcaggctggtctcaaactcctgacctcgtgatctgcccacctcggcctcccaaagtgctaggattacaggtatgagccaccatgcctggcctcttttctctcttaaggtcaccctggcatgtagtctggcctgactctgcctgtgtaaacacaaaggagcaagggtcaagtgcaccatgtaatctgcccacatactctcaggatgaccctggtctttgtaaactttgctttgagaaccagtgatatgagcatcacttacagagggactgtgtgggaggggggaacagtgctctttgggagagtcaatcaggccagtgcagtgggttcaggcttcaagaaagagaaaatggcccacccaaagcatggatcagcaagatggtgctctcaagatgtcccaagctttgccactcactggaggcaaaggggtcaagctacaaaaagatttgcactctgaaggtttgggggctgggagagatctctggactgacctcttgtgtagtatccccaattgatgggtagtcaggacagctcaaaggaaacacagtgacaataaccaatcaagtccagtatcctgcatacatcaaagagatggggggaagcgccatttccaaggcaagaagagcagtcattactaccattggctcttaattataataagcactgattgagcctttctgtgtgccaggctctgagttaagggctttccaatcattttctcaccgaattctaaccatgatcctaggatacaagtaagtatcatttacccccacttaatagatgaggaaactgaaacctagggagattaagaaatttgcccatgattcaagtcaaaattcaaatcaagtcaaaattccaacccaagctgtctgaccccaaagcctaaatcatatactttttcctcctgctctaacttctgtctctaaaggctctactctctcacccttccccctaacctccgcctctccaatacctctaagatagagtccaaattcctcagtagctcagcaggtatgtgaccagaccctcctcctctctccagtttcatctctgcccattcatttcttcctaccttgcatgccagccacccaaactgcccagcactcccaagacacactgagcttcccctaccttcaggctttcctgcatttctttcttccagattctacaagtcctttgtgtgtctaaatccttttttttttttcttttgagatggagtcactctttcgcccaggctggggtgcagtggcgcaatcttggctcattgcaacctctgactcccgggtttaagtgattctcctgcctcagcctcccgaatagctgggattacaggcatgtgccaccatgcctggctaatttttgttagtagagacggggtttcaccatgttggccaggctggtctcaaacttctgacctcaggtgatccgcccgcctcggcctcccaaagtgctgggattacaggcatgagccaccacacccagccgtgtgtctaaatcctactcatcctttacgaatcaatgcaggcctcacttgctttgagacttcttcctcaaccaccaaggatgggttaggggcccttcattctgttcccatagcaccttatgccaaagtctgttctatcctggaccacattctgtggtagtgtttgtttaacttttcaatttctctttcaaccctgactagtctgtaagttacttaagggtagtgactgtatcttcctcatgtttttacccccatagagcccagcatataatactagctcaacacatgtttgcccgatcaagtcaccaataaacaaaagaatgagccagcttcctcccggttccttggcaagtgtgaataaccaagtcatttgtagttgacactcagctcagaggctgagggttctaaatgtatgtcccccaaagggattcatcttatgcacttcattaccagtcaagctatcattggtctcctctaacagacggctttgctatcagaggagtgaaacacaaatggtgggagacagaggtgggcagctgtggtctcccctctgcttccctggctcagcttgcaatgtgattccttcagaagttcctgagtgggtgaacaccccatccacctgctgcctgaagtattatgagaaagtgttgccaaggagactagtggtgggatacagaaaggccctcaactgtcacctgccagcaatcatgtaagcacgtccttttagatatttctgtggagagggacagggagcccaggggcaggaatgagatacatgggatcaagaggtctccatgctagaagcagtggagcagtggctaagggtttggcctttggctctcaggggcctgggattaattcctaattttgccacttttagctatgtggttcattatgaaacccaagcttgagggtctaggctgagtggagaagggactgagagaagggatggtaaggttctgaggccagagagagaggctgtctgagggaacccagccaggacaggcccagggaagctttaaagaacataaggtgagctccatgtgaaccagaggtgggggtgggcaccggactcctgcccgagtctgcagcccatgacggtctaattctgcctctgcagcttcgtcaccaagaggaaccgagaagtctgcaccaaccccaatgacgactgggtccaagagtacatcaaggatcccaa

SEQ ID NO: 17747 - DNA, 42975 bp, Homo sapiens
gagctgaggccagaatgtgagagagatctgcattttggggattagggcctagtcaggcaggtaggagatgatgttcaaaaagggaaaagaagcgtgatgaaagactggtttctacagagatagattagaaagctgaagcctgaaaaaacagtgaaggagacccatgcaaatttctaggccctggaggtccaaataaggttttctaagtccctcaggccatgacaggttcagtccagacttgtctcccagagtgtttctctgccatccctactctaactgggacttattggtggtgtttctctcctaaggccagatgctttgcacagaacattaggaaactccagatgtaaaggtaaggcacaactgagaatcacctgcccagggcagcaacacagtgtgaaggaaaacaggccactcaacccaaacttacacctgagacagaggcaacagaaaaatcagaaaaggactttagaacacatataatcaaaatctcagacctaaagacgacttttgaaataaaccataacatatgaagaggcacttatgaaacaagaacaggtagtttataaaaaagaaccagtcagagaccctggaaattttttaaaaagcaattactaaaataaaaaatgaaaactcagtcaacagtgctctggtttggatgttccctccaaaattcatgttgaaatttaattgccattgtgatggtattaagaggtggaaccattaagaagcgattaggccatgagggttctgccttcatgaatgcattaatgtcattatcagagtgggttcgttatcatgagcatgtgttgtaaaaatgaatttagctgtctcttgctgtgtgtcctcttgctcttccatcttcccccatggaatggtgtggcaagaaggcctttaccagatgccagcccctcgcccttggacttcccagcctccagaactataagaaatacatttattttcattataaattacccagtccatggtattgttataggaacagaaaatgcacttggggatattaggtcgtggagagtaaaaaaaaaaaaaaataagttccagtcaatcaaggcatcctcattctcaacattgcctgcattctaccctccaggggtcccctccatggcccttcatctgcccccaccccgcaactcagcctcatttcttcagccactttctcccccacatctctcttcccttcccatcagaccttcacatcctgcaagctaagccacctcaactagccatgccctcagggctcttactcaagcacccaccaagatgtttttcctaacaaagactgtccttttactaagaggaatctgatgtcagctgttagtctccgctcccccccaccccccatctctcggaataatcacctggtcagagagaagcccaagagcacggacatgccagctaaaggtggagcttggcaagggtgtccacagagtggccaggcccagcacagatccgaggggcttttaacaggcacaggcagagtgctaaggagatcactaccacccacccacccatccagccaggcccagataaacctctccttgttccaaatgaatgagcaaacagaaaaattccagtgtggagggaatacaacacccacaatgcagaaaatagcccacatccaaaatatgctcccctcagataactagtcaactgtgcaaactatctgcataatcctcacaataaagttgaagaacacaaaaccacttcatacaaagagttaggaaaaaaattcctataaggaggagcatgtaccatatttattcccactctgtttactaagcatgtattataatgagaaaaaaagctcaatctaaaatattgccaacaaagaatccattcctcacgttgcagtaaatgaagcgggctgaggtcagcctccttttatgctggctgccccaactctaaggagttgatgcgtcctactgttaacagcggaggatgtccaggttcttggcgtcttaaataaagaattggacaaaacacacacagagagcaaagaaggaatgaagggatttattgaaaatgaaagtacactccacagtgtgggggtgagcctgagcataggagcacaaaagccttgttacagaacttctgagagtttaaataccctctaggtgattccattggttacttggggcacacgttatgtagatggagagcctgttacagaacttctgagagtttaaacaccctctaggtgattccattggttacttggggcacacgttatgcagatggagaggatgaagttacaaagtcatttgcttggcctatgccctatggagaaggtatttcctatcataactgaagtgtgaatcagcctatgttccctgcactcagaccctattttcctgcctcctacctacagctgtgtggtcctgagctgtcacctcttccctttgaagctcaggttcctcatcggtaaaatgaggcagaaatactcactgctgagatgtgtgaggatcgcacaaactcagtgtctcaacatgttgtacgtgtgttttggccctctgagcccttgagggctgccccaggtggaaccctcttcacttttcttggagaactgaccatgggttgcagcaaagcctaaaatggttcctgtttcagccctgcctgggaagattcagctggaacctttaggctaggaaaagggagaaggaccctacccccactgtgcccgacctgagacaaatccacagaaaagcaatccttgctaactctgggcagtatgtggacaagatactaatttttaatctctgcatctccatgagaatgcaaggaccagcacagtgaagtgcccaatgattgccccctgaacaaacggagatgtcaagttcagaaaaaatcctggctgaggaagacagggaacattcccttgaaaaacaagggcagtcatccagacagagcaagaggagtggcaggataagaggaggcagacagggttgattccacagggctcctcctcaacacccatgaacctgagaagtaagtggtcagatgcgtttcaggccactggccagcagtggggtcatggcgggaactagtcccacctgaaggactctcatctccctacaatccccaaacgctgaggcatggggatgctcttccctccttgaagtgagggccccgaggctctcatactttaattacagtacttcagaccaagagcctgcagttgaggaggccagggtcatgaatcagctgccccccaaactccttatctcaccaacccaagctgcttacaacccctccagatatcccaggagccggggggaatgtcattcttcagggctgagggaacatctttgcaccctggggtagcagatgggaccacagggcatgtggaatgtcttagtctgtttcacactgctatacctgaggttgggtttgttttatttatttatttatttatttagagacggagtctcgctctgtcgcccaggctggagtgcagtggtgcgatctgggctcactgcaagctccgcctcccgggttcacaccattctcctgcctcaatcagcctcccgagtgaggggctgggactacaggtgcccgccaccacacctggctaatttttttgtttctttttttttttcagtagagatggggtttcaccgtgttagccaagatggtctcgatctgacctcgtgatccgcccgcctcggcctcccaaagtgctgggattacaggcgtgagccactgcgcccagccaaggtgggggaatttattttttaaaaaaagcaaaacaggtttatttggctcaaaattctggtggaaatttcaagattgggcagctgcacctggtgagggcctcatgctacttcaactcaaggcagcaagtagaaggggagaggcatgcacaaagagattacgtggccatatggcgagagaggaagcaagagacaaccgcaggaaggctgactctctaaccagctctcatgggaactcacccctccacaaaggacactaacctatccatgagggatccacccctattacccaaactcctcctactaggcaccacctcctaacactgcctcattgaggctcaaatttcaataccattttgggcaggggcagaccacatgcaaatcacagcatggggtaatagtgggggcaggttgacacagggctgctgcctacccagcaccagctgtctcttggccccttccagatcctggcaatctggctacaggcatgggcccagccttggacacagatgtggccacaggaagctgttagctctccagatctgatcagcctgggagagcggcacaacaaaggctcccaaaggagagtcgggatcctcagctagcctcagctctgctacccacccatatgtgcccagaacaggaaagatacgtgtttcttactcctccgggactcctaggtgaagctgagaccaggctcttcttgagtcctctcagctatggtgcaaccaccagcctagcaaggaatcagaaacatcttccggaagagtcagcaccatagagggtgctgaatgggcaatgaagcatcccggagatgaaacatctgggcagtgaggcatcccacaggtgttgggctatgcagtcactccctttctcagaccgaggcaagtacataagcactctgggcccctaatcaggggcctggggccaggtgggatgaaaacagcagtgtcctgccacctgaacaactgctactcacgcaggccccacctggcctctcagagggaggaacctgggactcctgaaccagattcaatttctccttcaacagccgggacttttcgctcctgactgcagaaaaacagcttcaatgtgaccatccttgatagtccgaggctgagtaaaatggcctgaggaggcaaaatctgaaaagctctattaggtggcaaactgctgtcactagaagagttgaggcccccttctcctcccctgcctgaccgccttcattcctgggaatggaacaggttcttggggcaagggtgaatcctcgagcaggtcccaggatcactatcctcacctccccgcggcactgaatggctatagctgtaaatgtgcgtccacggggtcactgtccagccaccaggaccaggtgcctggccatctggggaatcggaaaacgctcagcgggatgctctggccacctcccctgccctcagttaagatgtagagcgttcaacctaaaatgcctagaaacaaagcccaggcccgggaaggtcgaacgagtgcgacgccgctccctcaagctcttccctcggagccgtctcatttcccaaaactcccaaacacatcacagagagaggtgttgagccaggtggtcactcccttttccagaaccacagcaagaagttgagcctgctgggctcctaacgaaggccctggggcccggtgggatgaaaagccctattaggtagcaaacagctgtcactagaggggttgaggcccccttctcccctgcctgacgacgacggcggcaggaactcgaccggcgccggacagctcgcaacttgccttaccaagcgtaaatctcrgttcctcccaactacccgcggccacggcctccgcagcagagcgccggaagcagagacgcgtttcgggaggaaggtgcatgctgggagcggcggcgcatgctgggagctgtagtctgcgacgcaactcggccgaggtggctccctggtccctgaagctcccagagcccgcgtgttcaggcggtcccgacaccccggcccgagcctcaccggctggaggactgaacgcctgccggccctccgggtatgagcggaggccgggatagccctgggctccgccgcccccggaaggaaaaaatacagtgcggtccgccgcccgaccacgaaagagcggagctcgggagccccgccccctgggcctccgacgtccgtggcgctttccgtcgcgcgagtgcgattgggccgcctgtcacgtgacccgagaccccacgcccggttggctgccgcctggttaccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggtggggccgtgtggggtgcggtgggcgccgtttctggtttctgagatctccgctcctcgcagggagcggggcggggtgggcggccagggtagctccgaacgcagggtccgccgttgttctcctcagaagtgggcgcccggccccctcttttcgtacctccttcatacccccgcccagaacgagcaggactcggcgctaccctaaggacgctaaactaggtcgtggcctccgcctgcgagagctccaatccaggaggctcagagcgctgcgagaggcgttttaacagagccccaaaccccgccccacctgtttgctttcgccctgaagagcgtttgtgtctgctcctcccgcagagagggccgctcgtgcccctctgaagtggctaggccgagcccacaaagcaaagcgtgatagaatttcagttttggattttgtgcacctgcctttccagttgtaacacctagaaatggcacctccaagggatgccctggccgagtgctgtgttcatatttttagaaatggtttatctgctgaataagactgcccagggagcaaccttgccctaagtggatgcggtcttagcggagacaactgatggccgccagtcttcgaacagagctggaacttctgggctctcgtgactgagatggctttgacaggccacctggtttccttggacaacactgaagggcctgggaggaggcaagggtcagaccatgtagagccttgtcattggaatttgggttttattttgttaaaagattgattttaggtgcagctggaggccactagagggttttggtagaggagtggttctcttggatgtgtgtttttacaagctcactcttgctgctgggtgggaagtgggttgtcggggcaagaatgcaagggtccattgtagtggtcctggagaaagatgaaggggctcagattagcttgacgactgttaggatgtgggtttggagtagattggtttgagacgtaccttgcaggggggatcgagaggccatagtgactgattgaaatagagggtgaggatagtggagggatcaacatgccttctgggtttctggcctgaacaggtgggtggatggtggtcctgggacagagcctgggggtgacctagagttgggctttgctctcacgtcttcaggtggagctgtcctggaggcaggtggatctgtcctggaggcaggtggatacrgagcagggataggctagaggcattcttctgggaggcggagcatattagatggtttacagtccacagcctgggagagtgtctcgggggagtatcagtaaagaagaagggggccttggggctgagccttgaggaaccctaacatttcttggggtcaggcaggtgccctgacagatagacttgagaagcagcaggcagtgagggagaggacacccggggagcatgcggcctcacagaagctgagtggggaccacctcaggggcagcagatggctgttctgctgttgtgaatgctgctgagtagttggggaagagagttgggaccaagagaagcccagtgggtttgataacatagaggtgacagcgacattgatcgaggcagtttaggggccatgattggctcagaagctagaggagcctgtgtggagagtgaatgggaagcaggtagtgggcatggcagctctttcaagagctgtaatgaagagaagcctgaaggagactatggtgctgagagataatgtcttaaagaacatgggggtgggattctgcccggggagctggaagggaaggagttgtgagaggagcccaggctctgagggcaggagagagggtcaggtccagaagcaggaggcaaggtcgaagctcagaggggtgggcaagggcagtgtggatgttttgagtagacggggagaaaggggaaggtatatgatagttagggggtgtgggaaatggagcctgctagagaaacagtaagatttccagcaggatggaggacacatttgagatttaccagcatgagtaaaaagtgaaacttttcgaagccaacatttagctgttttgagaaggagcttgctagagtttgggatttttccagtaaggaaggaaggcaccccagaattaagctggacagaggcatttgaagccaggagctgaaggacacccgctgcaggaaaccaccttcctgtccctttttgggtaacactgatgatcggaaaagctccaccccaactcctgtcatctagagccttgggttcttagtttgaagggttccacagcaggcatgatctaactctggacaactttctgtatctcaggagatttgtgccacaccccggctgtttccagatgacccacgggaagggcaggtgaagcaggggctgctgggggattgctggttcctgtgtgcctgcgccgcgctgcagaagagcaggcacctcctggaccaggtgcggggccccttccctgtgtttgtcctggagccrgtttctttttgcgtttctccagcctgctgagtaccaggagsccttgcgaaagcagagctgtgccgcagccggatctcctgctgtgttgggggaaggcaggagagttccaaggcagaggctgaggactgcactctgtccctctgctgcaggsrggggtgccttggcctcgccagaaggctccatcagggaggttcgccctgctctgtgctctcctgaccccyggactccatggagtcagatcaccacgtttagaataaagagacaaatgtgccagctcacaggaggacrgggctggctggcagcctctgcctcagatctctcctcagctagctcgctggttttcttacaggttttgaatataagtttgcaaaaagttattaaacctgtttctgtgggtagacagatactctgggaggagaaggccttctcaggttttccttacctgggagtgttcaccgttttatgcttggcttgttgctaagtgttgctgattaatgcagcggcgtcaacagtgtgacctcattcagagtttcactcatgtcccaggccccatggtaagcgtgtcacagtcactggctttcagacacatggtcttaccagctttgactttttttttaaacgagagtgctaaaatcactgccattgtgtttctggccgtaaagtggcagagccaggaccgcaccaggtgcctggtgcccagcctgcactcccccgatgctgggtcagaatgcttacccctgaaggagccctgcrgtggacgctgtgggtgcaagcagctggcccagtgtcggggcgccaggctcccagcagcaggaggggctgctgttcctgtggtgacgtgttgcttgcagccagctcggtcaagaactgggtcactcatgcccttgaatgtcacatttgttttggcttcaggtcagatgcttttagtgagggcagcagagtgtgtcccgggatatgtggctccctcggtgtggtcctcaagttttgcaatgagaggtctgttaatttcatgtgggtgatgcagccctgtgcaggcgccgacatccaggtgtgccgwagagttctctgcgacatccaggtgtgccgtagagttctctgcgacatccaggtgtgccgtagagttctctgcgacatccaggtgtgccgtagagttctctgcgacatccaggtgtgcgttagagttctctgcagaccgcggtgcctgtggagcactcagctgtggccacaccgcggccgggacactggagtagcgccgggtggtgcttatatcacgctcgccttttgcttctccctgtgcatggcaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaagtgcgtgtgctgggggctgaagggcctggcctggggcaagtgggagctgccactaccatgggctgccccaggagggtctctgctcactctgggctgcagagcccccttcagttctgagggtctggcagctcattctgtgagtcaggctgacaggccaggtgcagagattcttcttttgggcctgtggwttgcccactccctgctttcccttcccttgttccaaagcccagcgtggagtcgttctccacagagaacatgtgtgccgtcctccttattttatcggccccagcaagaaagatgcttctttatatttgttgtggartggttgggacaggcagactcattgtgtagtcgttggggaggartgaggctaccccagcataccaacrcttgtgtatcacggtgcttgctggctcaggggaccaggaccctcaccatgagtcataattgaatagccttccctcttagaatgcatttgtcttcttgccaaaggcaactggactgacaggcaggcagggaagctggtgaacatgggaaggctggctggtgacatcagtgcccagtgagcccttccatcccaagggctgttttaggaaaagcagggttggagcttgagagccaagggatgtgggcatccatagcttccacgcctcctgccctgctcctgtgcccacaccggatgccagagagtttctgtgtgtgggcagaggactgcagggcgctcacgcttgctgygaagtaaggcrtttgaaggtgaggctaagccttgacttggtgaggatgaggaagaaggcagaggggagtaaagaggtgggattgaggcagcggttggacgatttggggtgctacagaccatgggaatcagagagggggccatgctcaatgccagaggctcactcccatggtgattgtgtcccctagggtccatgggtcctacgagcacctgtgggccgggcaggtggcggatgccctggtggacctgaccggcggcctggcagaaagatggaacctgaagggcgtagcaggaagcggaggccagcaggacaggmcrggccgctgggagcacaggacttgtcggcagctgctccacctgaaggaccagtgtctgatcagctgctgcgtgctcagccccagagcaggtgaggcrcgtggccarcatgggagggctgcagccagcgtgccccccactgccaggcctcaggcacactgtagctttttatgtgactggctacacagccctgtcaggactaagtgggaagaagtaagcttgttctcaagggtggtgtcctcagtttgtgaccttcccctrctgtcctcttccagagggacgtggcccttctctcccctgaccagtcctttccactagtgcgaggcaggaagaggtggcaccgagtcaaagcccactgtctgtgccatccctggcccagctggcaacctggcaaaatcaaaacctgttttttattttagtgatagataacattcgttaaaaacagtttgtctccaaaaaatgaaaggggccaggtgtggtggctcacacctgtaatcccagaactttgggaggctgaggtgggagtatcgctggagcccaggagttcaagagacccgcctgggcaacatggcaagatctcatctctacaaaaaatgaaggaaaaaaatcacttagatggaaccacatgtgacttttgagtgcgctctcagttttccatgagcacgcacggtttacgtgttcccttccgcaccgcttctcacactgccacacacgcgctgtcaaatgttcgccccatgagcgggtttgccacagtctcttaatcattcccctgatgttggatattaagatctctctggttttatataattataagcagtatcaatgaacatctttatcatttttttcatacttaggattattttwaaaatatgggttaaagaatatgaatatcacagtaaactgaaacaagttgtcataggccttggtctgggtcccccataagcagaccctgagatgaggttcaggagcacgttgagaggttcagagagcctggagggcgtgtactccccgccagccccgctggggtgccaggaaggacgctggcctcagagcctcccacctgggagtgagggcgctggtctggtgggcattagctcggggagctgttggttttgggtgctccagggtggggtagcgctaagtcctagcacttcaggctttagaggaagcccccaggcagagagagatggcagctggcactgactggaggtgcattggagcctgctgaggtggcaaggggccgcggcgtgggcgagactgaagtccttccaggagaccctcctctctagaccgttgccccgccacagatgtggccttcctctctgtttggctctttcttttctatgcccatctgtctcaaggtctctggccaggtggagctgttgcccccctgggcctccatgcctccagtgggcttctagccagggcactatctgaatgtcctacctctagcaggctttgccaagagaaacactctctagrtttctggcagttgcagatgcatctgtgcagcatgtttgagaactggtgctgtgccaggcatcgtgcacagaygggtacggacgatgactgaggcctagagaaggggatgacttacccagcaccagacccggatggcagccgagtcaggccccgtgtgcttgctcctggagatgctcctgagctgatgggtcacagctgctaagaaaggagctctcgtggtccatggggatctggggtctcccgtgtagccatagtggggtgggctggagcatctccagaggaggaggcagaggcctgtgtgtccttgtcagtttgggactccatggtgcccttcctgcctgtgcctgcgccattcctcatgcaggtgcccgggagctgggggagttycatgccttcattgtctcggacctgcgggagctccagggtcaggcgggccagtgcatcctgctgctgcggatccagaacccctggggccggcggtgctggcaggggctctggagagaggggtgagtgctggggcctggaccatgctgctgtcgggaggggggcccagtgccagtctggcctgtgtcctggtcaccttcagctgtcaggactgtacttggctgtctccagcaaggcccctgagtccctgctctcgtgacaccatgcttgtcttggctccaggcaatccttgtgaggcctgggaccaaggtggccattgggcctggggtttcaatagggcagacatcatcacgggctcgggcagcagtcctgggaagacgcatccagaggcgtgaagttcctctgggaaaagagagggctccagggtggccgctgcccagaaggccctgtgctgcagagctgcttcgggtgtgggaggggctgcagagctggggcacggggtygctggcaggaactcagggctctctgggtcccctccaggcttccccscagcctgccggcaagttgacactaccagttctcgggaggggcytctgctgagatgaggtttcttccaggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacaggtagtgccccgaggggctgtgctgggcacgtgctctrcctgccgaagtgaggaggctgggcwggtgcctgggttccccctgcccaggcccagtttggttctcttcagcgtggagagatgattctgtcccaggagccgggaggagggtgatgattctgtcccaggagcygggaggagggtgggcttgtgggaggggctggctctgtctgtggccgtagctgctgcttagaccctgccagggttcatgaggccaccrtggcgggaggccagcgaggagccgtgtcccacagctgatgcctggtgttttctcactagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtaactcagccccgtctggctcacgctcggttcagcaggtggtgtggaggcccatggaggtctgggttctaggactggctctgccgggacacatgtgactctgccacgggccccaccagtctcccccctccttgggctgttgcacggggttgacgtctgytggtgctcccagacccggctctgacctgagactgcaggtctttctgccttgccgtgtgcctcattggccaaaggaaagcaacagagtctgcagccagggcaggacccgcaggaggggcctggacccggggggctcctggcagcgccgtgcctttctgaggcaaggaggtagagccagcggctgaggacctgtcagggccagtcccagctctgcagcttgctgtgtgacctggcacacatcctctccctgcctccctcagtctcttcccctgcaagacggggtcctgacacggatctcatgggattgctctgaggcccaggcagtcccaggctcaaccactggttcacaaagtgtgttgtttccaggaagaacagatgggggcgcctgagggcaaagggcctgagtgtgggtcgaggatatgccggctgctcgctcaggggctgggttttcatcttgtgtgtcttgacagggtgtgacacttggcaccacactgttccctgtcccttcatggatgtggcccacatgatgttcctttcctcttgcaaaagaagttgctggaaggcccactgtccagcagcccccaggttgcctgggccacggtgcctttgtgggcccagctacaaggaggacttgcaggctcgtgtctgggacagatactggcgccagggccaagtgaagcccgggattggtgggcatctctagctggtccctgagagagggtggagggtgctgacaggccttggcgctttcatctgtcaactccagaggcccttgtgcttgcagcagggaggtcaaggccagggcgtctgaccccggccgctcctccacactgagcctcctgcacgtgctcacaggtagagaagcggcgggtcaatctgcctagggtcctgtccatgccccccgtggctggcaccgygtgccatgcatacgaccgggaggtccacctgcgttgtgagctctcaccgggctactacctggctgtccccagcaccttcctgaaggacgcgccaggggagttcctgctccgagtcttctctaccgggcgagtctcccttaggtgagaggaaccgcgcagtgctgctggctctccgaggccacaggcccttccaaggcaggatttgggcactttccctctgtggttggcaggtgtccatgtgggaactgaggccacygggaacctgctgccagcgccctcccatgtttgtcttcttggcagcgccatcagggcagtggccaagaacaccrcccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggcaagctccttgccccagggagggagggggagcagaaggggccctcagagaatttgcatcttggcctccattgtcccaacagagggctctgggctcagtcacttgggctccccctgcccttcgaggcgctgcctagaacccgcacagggccctctcccatctccaacctctcagaggcaaggccgaagatggcctctggaagggccgggggcctgggaggtgggcagggctgatccaggcagggcaggtttccagaggaggtggtgagtggggaggaagggagaagtttggagaggacaggaggccgaggttgagaccagcgggggtgggtcragccctggcttgggaacgcagggggctgatggactcaggagtgagaggaggggaggcccaggctggctggccacagcagcccctcgggtgtgaggaagtccacagtcactgagctcagccagcagcmccttgtccacttaccctgactcagaatgactgtgtcccaaggttcattctctgcagacatgtgtcccctggaatgcaggggccctgacgaggaaggcactgcaaccctcggttcacagtgggctgcctggggacccttggaccctcgctgtttgccctgggccaccggctcaggtcccctagagctctgaggaaaacacatgccagggccagtgggagcccttggggcgggctgggcagtcacaggtgttaaagcccctgatgatgtgacaggcctccaggygggggccccactgccggcaccttctggcaagggtggccaggccttggtgaggaggcgagtccagtgtccaggcctggcagcccctcctcagagaaggggctgtatgtgactcaagagggccaagggcatccgagcagatggccctgggctgggctccctaccccaaggctggccccctcagtctgagcctgcgctttcctcaggtcccagagggtggaaggagccaggacgcacccccactgctgctgcaggagccgctgctgagctgcgtgccacatcgctacgcccaggaggtgagccggctctgcctcctgcctgcrggcacctacaaggttgtgccctccacctacctgccggacacagagggggccttcacagtgaccatcgcaaccaggattgacaggtggggctctgggacttgggggcggccagctggaggctggggtgctggagtcttagtgctcgccygtccccccacgtctcctgcctgcccctcaccctcaagcccctatctgtcctggcagaccagrgctgtcctgcctacctggggacccttccttgctggtctgagcctggaaggagagtctagtgggaggtgggccaggagcacacagccacttgtgtgacaagtgcagtctgggagcgctgatctggtgtctctccacaggccatccattcacagccaggagatgctgggccagttcctccaagaggtgtgtatgcagccccgccagcccggctcacctgcctggggctgcctggtggcctagggtctacctgcaacctcaggcaggtggtttctgcctgggacgtgaggtgcccttgactcttcctgtgagagccccgggcggtgccttgaagggcagggggagctgaggctgcrtcccattccctggctgcactcggggtggggtgtgagaaggggcgagtgccaccgctgcccgggccccccatctgtcyttgcaggtctccrtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggrggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggccycacacccagagggtagggcagcagatcttctttataactatttattgttcgaatcacttttaggatgtaactttataaataaacatgagcgctgatgatttgcagatcagtcttgctccaggtagttccaggctgtgcctgctcttgccaagcaggctgtggggagggctgggtgcctgccgagatggtgaggatgaggatggcctctggaggggctgggggcctgggaggtgggcagagccaacccaggcagggcaggtttcagggggagatggtgagtggggaggaggggagaagtttggaggggcgggcccagggcatgccccaggccagggggctgaggttgaggctggccggggcaggtcaagccctggtcttgggggacacagactgatagactggggagtgaggggtggggagagccagcgaaggcactgccaaggctgtggcgaagaaggacatctcggaaacgggtgttagaaccggagttgcgcagagggaggaaccccaggttcacrtggactgggagccttggatctggacggctcctctgcctccagccagggttcacctgcgcagtgtcctrggattgtttatttccccaggcctctctccctcgtccctcacaccaaatgctgtgatgagagctgtagtgtcactgaacggtgcagaagacagttccagacatgggtggggagggctgtcactaagcccttttgttttagagacagggtcttgctctgttgctcaggctggagtgcagtggcatgatcatagctcactgcagcctcgaccttctgggctcaggtgatcctccctcttcagcctcccaggtgggtaggaaaacaggcgcacactccatgcctggttagttttttcaagttttgaatgcttaggggtcttagtatgtggttgcctaggctggcctcagtgatcctcctgccttggyctcccaaagcactaagattgcaggcatgaccgccaaccccagctctaatcccttttaaattccattcgcttcctgagtccctttgtgcctggggagaccccgtgtattggtcctttttcacattgctgtaaacaactctgagactggtaatttataaagaaaagaggtttgattgcctcagttccgaagactgtacaggaagcatggctggggaggcctcaggaaacttagaatcatggcggagggaaagcaggcagtctgcaggtgtctggagaaggaggaagagagcgaaggggaggtgctgtgcacttttaaatgaccagatcttaggagaactcactatcaccaaaacagcaagggggatatccgctcccatgatccaatcatctcccaccaggctcctccaacactggggattataattcgacatgagatttgggcaggaacacaaattcaaaccatagcacccagtgagcctgatttgggccttgctgccsgatcacgaccatctctggagtcctggtgtctgttcccactgggacctgtgccgctgtccccctctccacgccctggccacgccaagccaccctcctgactcacccacaggaagctgccctggccctggagcctgccccgtgagcccctctgcttgctggttcaatggccctccagcagcagtggctgtggcagctgggttctcggcatcttcagacacggattcttgagcagcaggatggggctccatctccctgcgtgcagagcctgccacagatctccctcatccactggcttctgtgctgacttcggatgaagccagtggtgccgcctattggggtacagcaactcagggcgaacagtgaggggcggctcaccaaagaaataccccgcagggcagtgcccaagccagaggcttgagctgggtcggagctgccctagatccctgggtttgtgggcggacaggtcctgtgcagggcgcctgatggtgcaggttgaggtgggacagttggggtcaaggtatttctcaggcacagtgcctatgaagggaagacagttgcagggactgtgtccatgtcaggatagactggtggggaccccgtgaagagttctggagcaaaccctgcctgcagggccccacctgggctggccaggcccttatgttgagcatcccttcccccaggccctcaggagccactgtccccgaggcaggccctgaaggtggcggcmamaccctcctgctgggcagctctgcccaaaggccacagccaggacctgcttcccgcgtcccaggstactgcctgagaggaggcctcgaaagcgcagggttccgtgactttagaggccatggttggcacccatcatcgccccagtgtagattggctccactcgacctggctgctttggccatttggtctaccagctggaaccatgttcctgggtgtggaaaacgctccctccgaagcctgcggagagccctgaggccttgtgcttccttctgatgggaggttccagaygcagttggaggggatgtctggcagggctctaacccccagccaacctaaacatttctggtgcagaaggccccggcctggtgttgtttgtccctggctgcctcctgctctgacrccatcagcatcctgttgccaaggtcatggatcagtgcggtgctcttcagggtgtccggccagctggggtctctgtcctgtattccggcagaggccccaggaraaacagcaaatgcctttgtccattccatacaaatttcatataaatgtgagcagcttctgatcttccgtggcgtattcgtccagttgatggccaaccctgggtacctggacctccaggacctgctgcactgggctgcccctcrgctgtgtgtgcactcgccacgtggccctccaggaatcccaycccacggggccacactgaaccaaatggagagagcagggccaccaccctctctccgcatgccacggctgctctgggacccgggcaggaggggacagtcttggccttccagtgtccctcttggccttcccacggccatctctaccccaaggatgcagcagagakatcggtcgctccccaggtgtcaatcccagtcacaggctcagagaccgggacatggccccgggtgggtctgtaggccctgtgggctcatgtgagctggtcytgggcaggactccattattaactgcctgtgatgtgtcccactgtcatggagccctggtgactcttggggaccagcatcagctyggggcctgtgtgctcagtggytcccagatgcctggatattctcttcctggtgcacatagtccccggggaggtccttgtcatgcacacttgctgatgtggggagtgtccttcatcttgcaggcctggccacctcttcagtcagcagatacctgggctgaaaaccgactcgggcagtgtgggcccaactggggctctatcggagtgaccaccctcagccctcctggacccctctgccggctccacctgagcgctgccctcgctggcagccctgcsttgctctgctgccattccrtaakccctgcaggcaggccccttggcgcccttcagccgtgttcatgattgtctcctggcctctgctgtttagaggtctaatgccctcygcccccggcgagccaaacccagtgatggtggttcctgccaccagcttcctgtggcaccgctgccactcccgccaggctcctggggcaccgccrccactcccgccaggctcctggggcaccgccggccactcccgccaggctcctggggcaccgccgsccactccckccaggctcctggggcaccgccgccactcccgccaggctcctggggcaccgccgccactcctgccagcctcctgcggcacagctgccactccctattaaccagcatggcacaggtgagcggtgtgaccttggtcttcccagggaaccagtgcttggcagctcacaccacacacgcctacgcctaccctccaccagccacagcagttgtggcatctctaccctgcccagcaaaagtggaagtgttgcctgtgccgctaggaacctccaggtttrctccacctccaggggccttgccagggtgtcaaacctgtgtctcgggacactgctgttaggtctccagcttccctatcaggcgcctcagcacccagtcctaccagtgctcccgcctcccgtccccagctggctgggcctgcagccccctcctgtgccccgagctggccgggcccgcagcccactccctggtcactggatgttgctgacacttcactcggtcagagccctagcacccaaggggggccagggcctgacgggggtggagcgaggggtgggccgcgtctstgcaggctcagaagcttcctaagaggctggagagtggaaccttcaggcaccacgcactgcctcctccctgcccacggtcctggkttctccagatggggccttggccttggctaggtgttgatcaggagctgggagtgctgcgccccgcccaacttctccaaactccagccagggcacctcagtgaggcctcagccacctgcgccttatttgcttcctccttggaggccctcgtgtctgttcattcatcaaacagcagctggggcccccagcagacccccttccccaactttcccactggacactggaaccagtttcacaactggactggacaggacgaccaccttgtgccaggcgccagctatctcccctgaccagtgatgggtcctcattgcccgtgggccgtgagtgacccagttccaaatcccaaattagtgactctcttctccaatgggggttggattctccagaagcagaggcagacatagaatttgggtgcaaggtatttcggagggaaggtggaagaggtggggttggtgagggagaagcctggagtgtcggtggccggggtgcccccacctggctgaaacgcctggtctttgtgccctgcctggctcagcctccccaggcagactaccccatggcatccctggacaaggctgcccccaagaacgctgcccacagcccagccatgggccttcccttggggctmccgccccggctcacacctgctggccagcgtatttactccttgctggctgcaccctctcagcagtggctgtgtagaccataaccctgggaacacctgcggggagaagcgcccttggcctggcggcttgggggagacacctggggtgtcaggagggaaggaaggcaagcaggggtgaggcactgtgggacttttcctgctttctgggccagtggccacaggccacccagtgacatttctctctcagcgtctgctggggtggactctgcagcggctgcagccagcctggatsggctcctcgcacagctctgcttgagggtgaaggccatctagaaaccctcagtcccctctcagcctcagagctgatagcgctgcctgaccatcagcaagcttgtaatcagcaccacctccagcatgcctgctcctggatctccgtgaggctcccctgcctgtgtcacccaggggcctctaggggtgctctggagctgggagccactgtccagcacttcctgccctctccggcctctcttggctgtctgccaagcagtcactcagtctcctattgaccactcgttttgccgcaaggctgctggtttacgtgaaaatagagaaagccaaagagtttcctcacccctgtaagatttactggctcttctggcattgcacctgcctgagttccttggtggggcccctctttgagttcctttgggctgctgtaacaaagcaccatagcctgggcagctcgtaaacagtggaaatgygttgctctttgttctggaggctgcaagtccaagattgaggcactggaagacctggtgcctggtgaggacctgcttcctggtccagagacagcaccttctctctgtgtcctgatgtggtggaagggcaaaggaactccctggggcccgttttatgtgggcactcatcccattcgtgacgcctctgccttcatgacctcatcacctaccagaggtccccaccttttcattcctcaccttggggatgaggacttcagtatgtgaatttcggggacataaatgtgtcatctatagaagggcccatctcttacacaaatgctgggtccccagtggcctgtgtcctagcaaatgagagccaccctgaaaaataaaatcctgtctccccaacgccagccctggcaaggcacccagaactctccggaatgcttgaaggcagggcctggcctttccatggggtccagggctgtggggtccctggcggtactgtgggcctgcagagyggggcatgtgggctgaagaccgtctccccaccatggtgggaarggacaaagggtggccctggcagatccggacgggcaggactgggtgtgtcccatgagagcacctccttcctggcctttcctgtggactttgtcccacaccacctgcctgggttccttcctttagtcacttccagctccaggcacagcagttggtgactccttggtgggagccgtgtcccacccggtcctgatactgccgtcttctctttcacagtcctccaggcttgggccagccttgggggcagcagagcttctggggtgagtgtcgagatcctgtgtcctgagagcggtagtcagggagagggctggtcggggcagggctgcccgggcaggacacaggatgcggccggccaggctggggccaaggtgttcagacctggactttgggctcgtgctttcttcatggttgcgccttgctcgctgtcccttggagtcttcatttggttttgctttttttgtttgtttgttttcacctaatttttgccagacttaagctagttttgctgccttttgaaactagtggaagaatcattttattcctggggataatttggggccttttgatcccaacgtgaagccctgcacatggctgcttcatcaggggaagggtcttttctgctttggaggaaaggctttggcaggcaggctgacctgggagtctccggagctctyggctctctgtagcatcctggggagctcagaccatggctgcagggctctggccatagcttgcaggccatctggttagtgctgccccccaaacccggccattcctctctagtccccagcaggtatagccagtgtccacatagacagcactgcctcagatctgggctgggaccacaacactcactcagggatcccagggaacatggcaccaggtttagtaggtttagtcgggcatatgcagtgtcccttacccaggtcaaggctcaggctgggcccatcttagctgcctgggacacccagtccttttatgaatctgccaggggaggagcagccaggcttgggctggggcctggatggacgtgacatcgggcactgtggcattgtgtgcctgtctctgtgttgcagctgacatgggctcattgctccttctccaagccctctgaggacatcaaaagcgtggacgcatcactttccaccatcttgctgcccactgtccctccatcctgaggcctcctaagcacatgtgtggggtggcaggcacactgctgatagctgtggatgcggccgtgacatccttcacccctgcccccatggcatgcatgatccattagggaggaccgtctgcacaaaggtaatccattgactcagacagggggttcatagaagaacaggtgagagtggcagggggggtattccttgaccagctgagggtcagccaagggcaggaaaggggctgggcaccctcagggaattgaaagaagctctctgtgcctgcagtgcggggagtgggcttggagaatatggcaagagctgaggctggagatgtaagcaggggccttaagtgttgtttaaggagcctgagtcttatctcctgggcaattgggagccactacatagtttaaagcagggcctaacatacatatgtttgaaatctttctctggctgaagtctcgaggatgaattggaagtagaggaccaactaaaaagttgttgcagacattaaggtggtgtcctgggttaggtgggaggtgatggagaggagaataggctagtgttgacatatacccaggaagcaaaaccattggggcatggtgcttaatgcttgattggattgatcacatagatgactatgaggaggactgacatatttcaatctatgaacgtggtatacccatccatttacttatttttaattttttaaaawttttttttttttttgagacaggatctcactctgtttgtccaggctgaagtccagtggcaggatttcagctcactgcagcctcaacctcctgggctcaggtgattctcccaccttagcctcccgagtagctgggactacaagcacagatcaccacacctggctaattttttgcatttttgttttttagtagaaacagggtttcgctatgttgcccaggctagtctcaaacgcctggactccaacaatccacccaccttggcctcccggagtgctgggattataggctggggccactgtgctgaaccctgtccatttatttggatcttctttaatttctcccagcaatattttgtaacttcaagcatacgtttcccacttgtgcctaggtactttgttttccaatgcttgtaaatggtattgtatctttagttttattttccaattgttttttgctagtatatagaagtgcattttttggtatattaatcttgtatcctgtaaccttgataatgcatttattagttcatagtgttttttgcttcttttgttcttttctggtaaatgccttaggattttctttttctcccgactccccgccttcctcctcttctttttcttctgccttaggattttctttttcttctttctcctccttctcttcctcctcctcctcctcctcttctttcttctttcttcttcttcttctcttytttgtttttaaattgagacaggggctcactctgttgcccaggctggagtacagtgatgcaatcttaactcactgtagtctcaaactcctgggctcaagygatcctcccacctcagcttcccaagtagccaggactacaggtgtgcaccatcatgcctggctaatttttatatgttttgtagagattgggtcttgctatgttgctcgggctggtcttgaactcctatcttcaagcgatcttctcacttcagcctccccacatgttgggattacaggcctgagctactgtgccaagctgaattttctacatgcatgattatgtcacatgtgaccataggtaattttacttcttccttttctatctgcttttttcccttgccttatttcctctggctgggacctccaataccgtttttaatagaaatgtgagagccacttcgtttgtttctgagtatagtgagaaagtttggtcttttaccattgcccagcttgaagtttcctatagtttatctataggtgatctttatcacgttgaggaagttctcttctctttctagtttgccgagagtttctmtyattcatggatgttgcattttgtcaaatatttttctgcatccattgagataaatatatacattttaccatttattctattaattgatgttctaatgctaaaataaaccttttatttcttgcatactttttcatgatgtgttatttgttttatatattgctggatttgatttgctaatattttattaaggattttatgtctatgtttatgcatgatattggcctgtagttttcttttcttgtaatatctttgtccagttttggtacagggtaaaacttgacttagaaaatgagctggccagtgtttctccttttttctgatgtggttaagattggtattattttattcttaagtgtttgatggaattcatcagtaacaccatctgggtgaggtattttctttgtagaaaggcttcaaattatgaattcaacaactttaatagatataagcttgttacattttatttttcttgtgtaaattttggcaagttgtgactttcagtagatgtttttccatttcatcaagatgtcaaatgtaatttcatgatgttcttactaatattcttgtattattcttctgatgtctgtagggtctgaagggatgtctcatcttttattcctgatattagtaatttgtggattttttttctttgatcaatctagccagagctttctcaatttttttttcttttcaaataaccaatctccattttattgattttcgtttttttctgctagtacatcaaattttcactctttcttatttcttctgcttacttgggtttcatttgttcttggtgttgttgttttctagattctcaaagtggaatcttaggtaatgattttagacctttcttctttcctaacatgaacactgagagctacagattttcctctaagcatcacactaaccttatctcacaaagaccggaaagttgcatttttatcatcacttagttcaaagtattttcttatgtctccttgattacttctttgatccctgagttatttaaatgtgttgcttaattttcaaatatttgggcattctttgtgtgtcttataccttgttgctattgatttctaattaagctctgttgtagttagagaacatattctgtataacttaaatctttttaattttatggaggcttaatttatggcctagcagatggactattttggaaaatgttcaatgtgcacytgaaaagawtatatattctgctgttgttgggcatagtgttctataaacatcagtttggataagatgattggtgttgctcagggctatcatattcttactaatttttggtttacttgttctgtgagttactgagatgagggtgtcataataaccgatcacaatcatgaatttgtctgtttatcctttcagttctatcagcttccttcattttttggattctttgtaattaggtacatacacatttagaattgttagatattcttgatgaattgacccttttttcatatgaaatatcctttttttttttttgagatggagtctcgctctgtcaaccaggctagagtgcagtggcgcaatctcagctcactgcaacctccgcctcctgggttcaagtgattctcctgcctcagcctcctgagtagctgggattacaggtgcccaccactgcgcctggctaatttttgtatttttagtagagacggggtttcaccatcttggccaggctggtctcaagctcctgaccttgtggtctgcccacctcagcctcccaaagtgctgggattacaggcgtgagccaacacgctggtccgtgaaatgtccctttttttattttgcaatattccctatactaaagtctactttgatgttaatatttttattcctgctttcttataattaatgcttgcattttataaatttttccattcttttacattgttttcattcttttacttttaacttttgtttatatttaaagtatatatcatatcaggcagacagcatattgtcatttcttgctttcttttcccctaagacgaagagtctcctgtcactcagcctggaatacagtggtaccatcagggctcactgcagcctcaaactcctagattcaagcaatcctcccatctcagcctcccaagtagctaggactacaggcatgtggcaccacacgtggctaagtttttaacttttttttttctttttttgagacagtcttggtctgtcacccaggctggagtgcagtggcatgatctcggctcactgcaacctccacctccctggttcaagtgattctcctgcctcagcctcccaagtagctgggactacaggcgcccgccaccacgcccggctaattttttttttttttagtagagatggggcttcactgtgttagccaggatggtcttgatctcctgacctcgtgatctgcctgtctcggccacccaaagtgctggggttacaggcatgagccactgcacccggcctgtctttttgtttttttgagatgargtctcactgtgtcacccaggctagtgtgcagtggcatgaactctgctcactacaacctccacttcccaggttcaagtgattctcatgcctcagcctcctgagtagctgggattacaggtgcgtgccactacgcccagctgtgtttttttgtttgtttgtttttgtttttgttttttttcggtagttttagtagagatggggatttccctatgttggttaggctggtctcgaactcctgaccccaaatgatccacccacctcggcctcacaaagttctggggttacaggcatgagacaccrtgcctggccaatagtctttgtcttttaactggattgtttacctcagtcacatttaatgtaatggttgatatggttgggtttgaacctaccatctgctatttgtttcctattcatctcctctgttctttgtactcattttccctcctctttttctgccttcttttggattagttgactattttgtatttcacttatctcttctagactattatacttccttgttttatcatttcattagctgcaatagggtttatgatatgcatatttaacttatttatgattgattggatgtaggaggaatggggggagaaagattccaaaatgacactgacatatgtggcctgggtaacaagaggaaccactctctgagatggagactttgaaggaagattagtttggggagtgatgaaagggctggatgatgtggtcagttttggacaagttgcatttaaagtgcttctgaggcatccaagaggagatacctggtagacatttctttacraggtccagagctcagggcagtgtccggggctggagctggctctaggggtgaagggcagaggggtgactgttgaatgaatgggaacaaggtagtctgtggatgcagaacgtgcgatgggacaggaagagtccaggaccaaaccctgaggagccccaacattttagggacccaaatgcaggacagtagagatgaaaggagaggccagcgaaggagcaaaacaaggargcgtgtgtcatggaggccacacgaggaagtggctttgtggttacttctgggacattggcagaaggatgtttcagggcaaagtgcaagggggcctcaaagatcatcttaagttctgttccttcactttcacggtgggtgcattggtgttcatttagatctactcaacatcttattaaaacattttttaaaaaggactagggactgggaggccgaggcgggcggatcatgaggtgaggagatcgagaccgtcctggctagcacagtgaaaccccgtctctactaaaaaaaaaaattagccgggtgtggtggcgggcgcctgtagtcycagctactcgggaggccgaggcaggagaatggcgtgaacccgggaggcggagcttgaagtgagtggagatcacgccactgcactccagcctgggcgacagagcgagactctgtctcaaaaaaaaaaaaaaaaaaaaaggactagggacttactgacttggccaaaggctgctggtgggtgcgtggaggtgctgcctgtcagctgtgctctgggctctagggacatgggagtccaaagggctctcacctcctcagtgagaggttctggtgggctgaccatggtgggatccagatttcagcaggtggaccccgagggggtgtgaggaaatggactctgtgagtgggaacttctctttcagaggaatttgcaagactggcctgagccgcacacggctcttcagcagggcttggcagccagcggggcctcgggaggaggcaaacagctgatcaaatccgggcttctccagaggaagaaggggaagggcaggtctggggaggtcagagcgtgggtgagaaccgtggccatgggtgggatccacatcccagcctgcagggcctcctggtgatggttctccagaattctgcgattggagctgtgctcacagagtcactgtccccgacctcccaggggcgcggacataacccagcctcagctgcagacagcagagactctgcacaactgcagaagctgagcaatcagcctcatcagtggcaattcctggaactccaacctcaactgtaacatgagctgtggcagaccttcagtaaccccagacraggagtgaggcagagcctgatagctcagggaccagctgggatgctcagtaaacaagagctccagaagatacgcggaacaggagaaggtgaagtgtggggacagcaggcgctgcaggccacccagaaggaggaggagaggggacaagaaacactgaccaggccttcaagatgaggagtgagcagagaggacagcagaacatgggaaaacctacctggcactatgagggtggagaggggagtgttggagggtgtgcatttgagtgcaagtgtgtaaaagaggccctggacaaggagtgaagaatctcatcagatggttaaagtgagggagcaccaagtaaaccataatgaaccataagtcatgtggaccccaaccctaatgctaatcataaacctaaacctcgtgtggcctggaaccctaacctgaacccaaatcctaaccataaccctaaccataaccataaatcatgtggactccaaccctaatgctaaccataaccctaaaattcaggcagaaccgaacctaactcgaacccaaaccctaacgaaaactctaaccctaaccctaactcaattcaaaccttaaccctaaacctaaccataacactaactccaccctattccgaaccttaaagctaattaacaatgcctcatatggacccgaaccctaaccctaaccgaaaccctaactctaaccctaaccctaactcaacccaaaccttaaccctaaccataacactaactccaactacaaccataaccctaaccaaaactctaaccctaaccctaactcaacccaaaccttacccctaaccataacactaactccaacaaccataaccctaaccgaaactctaaccctaaccctaactcaacccaaaccttaaccctaaccataacaccaactacaaccctaaccatatcccgagccctaaacctaattaacaatgcctcatgtgggccctaacgctaaccctaaccatgcctcatatggacccgaaccctaacccctaattccaaccctaaccctaagcctaaccctaacactaaccctagccaaaaccctagcactaaccctaactccaacccaaaccctaatcctaagtctcatgttgaccataacctggctcaaaccctaacctgaaccctaaccctaagccttgtattgaccacagcctggctctaaccctaaccctgactctagtcctcactgtaattctacctctagccttaattctaaccctaactccaatcctaaccctaatccaaatgcaccctctgatccaaacaactcttcagccaatgtcagacctcaccttaaccgtcaccttcacgatcaccattccagttctcccttcagacttcccagggacttgagccagcccctggcccccaggccttggtttccccacctgtgcagcatggatttggggctgagggtacaaagactggcacccacctgagccgttggaacaggcctgcccctggtccygaggaggactctgctctcccggttctccccttgcccatgtggaagggggctcatcccccagcatgggtgcttcctgcctggtgtccatctctgtgtgagttcctttagggagggaccgggtaggcgcagttggcatggcaccgccatgcccctggctcgggcttatgcgggctgacagtcctgtccctccacccagaggcccctccaatgatgtagcttatcagagtgtgtgtgtatgtgcacatgtgcatgtgtgtatgttgtatgtgtatatatctatgtatgtatatgtagtatctatatatatgtgtatgtgtatatatgtatatatgtgtgcatatatatgcatttgtgtgtgcttgtgtgtatgcatgtttatgtgtgtatttgtatatgtatctatgtgtgtttatatgcgagtgtgcatgtgtgtatgcagtgcttgtgtgatgtgtctgtttttatgtgtgtgcatgtgtatagtatatgtgcatgtgtgtatgtttacatgtgtctgtgtgtgtatgtatatgcctgtgcttgtgtgtgtgtgtgtgtacacatacacgtggacaggcgagggagaagctgtattgcaccaccacccaggcccttsgagcccaagtgcagtctccccagggctcacgaggccccagcacgctgccctcctgctcagatggtgcccaaaagccccttgccgagtcctctctaagcctcatgtagacccgtgagtcccttctccgtctgtttcccctgcctgtgatgcttagggatcgttcatttcagggccagtgaggaaaccccatcttctcctgcactgccgtggagttaaaggagaaggccacaacacactcccacgttttctacagactagcagtggggtgtttggccacctttggttttgaccttttattttggaaatgttcagactgaaataagcagaagtgtaataaccccttgtgcccatcaccccacctttggcaagagccaaagagtcacaactgattgtgcttcaccacactccatctatgggctcaaaatgttttgagataagtgccagacatcatatccttctatctacaaaaaatgccacatgaataaaagataaggacttttaaaaacacatgaccacagtaagcattatcacatctagccaagaaatgaacctttccttaattgcaacaaacaggagttaacttttacattttctctacttctacaattttttagagaacagtaaggtagactttattcaacggaggctaccacaatggagttttgcagcagggaagggagatgaggctcaattcccaccttatacgtttttaaaaagagcttatttggttgaattggatctgaggagtctggctgcaggccaaaatcctctgtgtgatcattcaggcccaaccgcagttgttgccagcaggccccacaggagaagcagccctcctgccccagacggcactttccacccttagcctcctccacggttccccaggccagatccttttgtttgagccttctgtttcgcctgcttggtagtgagatcatctccccatctgcctgatgtcatccagggggcaaaaatgggacgtagaggagccggcacctttttccttctgtttgcctcttgcctgcactattgcagtcgtgaatacaggcctgagggtgaccttccattgggctcgtggtcccaacctcgacagcagtgrctccacaggatgcatacgaggtccccgcggtcccrgccgacatacctgttgggttcttagttggcagcttcctcctccktctctctattccccycctaggtctcttgccctgtgcagcttcctgcagactggacttgcaaagtccagcctgtatsrctggagttcccatgcctgccaatctcctgtcgactgcgagtcagctccgatacttcaccagattcaggtgagagttttggttttttgacaagcccacttcatcagcagggcatgcatttctgccaggggkctcatgatatctggtggtctctttgtgaggccagcagccaccaatgatcacgaatgtggcaggaagctgccaagagaccccccagtgggtgattcctgcctcctgctgtcatgcaattccctcctgaagggtggctggacttactcacttataacaaacaatacagtaaaaaaaaaaaaaaaaaaaaaaagtgatgtgttgtctcttccgtgattaggttgaaagagaccatggcatctgtcttggatgcatactctctctcgctggctctggggtagccagatgccatgctgtgtgctgccctgtgaagaggcatggccagtaaggaactgagggcaggaaccagggaagatttggggtcctcaggccagctgcccattgggaatgaaactctaccaacagccacctgggggagctggaagtgaatctcatcttagctgagccttctgatgagactgcagccccagctgacacctggattgcagactcatgaaagacctgaaactctaccaacagccacctgggggagctggaagtgaatctcctcgtagctgagccttctgatgagactgcagccccggctgacacctggattgcagactcatgaaagacctgaaactctaccaacagccacctgggggagctggaagtgaatctcctcgtagctgagccttctgatgagactgcagccccggctgacacctggattgcagactcatgaaagaccctgagcagaggacccagtttggcagagcccgaattcctgacccacaggaactgggagataaaactctgtggttttaatcttctcattttagaggtaatttttttgtgtagcaataggtagctgacaatgcacagctaaaataatagataattaaccctaatgctagtttcattcatccatcagggtttgcaaagtagtgatattctacttctgtcttccttcattatttattagcagaaatgtatctataaaaagaagtgttccttcattaactctttggtcatgttgaggtacagtttgcataggaaaggcagggcaaatgcttgattctttcccttcctttcctcatttataaaataatgaactgttttcctggcatctttcaacaatgactaatgagtttttaaagtataattacaagttcatgagtttaaacattttttgatgttcccattaacattattatccttattgatattcagatcttcctgtctttgtccagtgccagcctatttgatttaactcctgagcccctttggcactgccctaataatctttgacagctactttgttctctggcataagaagacattccagaattacattagacatttcctaacccagattggacagcatacacttctctccaagagcccctcttcctcttcaagagaaatggtacttagagaccacagtctgggtgttaggtgtgcttgtggttactggatttgtcgtcatttttaggccttgtcagtggacagaactaaggcttttttttttgaaagacacattatgagtacaaatggatactttctatttaaattcggatttacatagtttttacttaatcttattgataatatatctgcatctcctttctcccacaccaaaaatctcaaacaatacccaacatagttattcatttgttttatcctgtaacacacacaatattttcaaaatgactttaccaacactaccatcaacagtatataaccactgaaaatagtttaaaattatttttagatacttttaaagtccttgggttgtgtcgacgtacagacaaaacagtgttttaaaattatttggaaaatgattacttaaaataatgaaaacttcttttgccattctttcttgttgtcaggctatatggatatacatccaaatgactggattttaaaatcacttggaagagtttggtaggttcatattgtcaacccataatgcaagtcagttagtttcattttgctttcaattttaagaattccttttacaagttaatttaattaaattaagtaattacacaaacatttgacatgagtctaaatccaaatctagaaaccaagatatggtcacagaagtccgtccctatccccatcccatttccacctgtttcctacaggtaacagtttaatttaaagcaaattttgtggcttatctttccatttgtaaaacatacagctgatggctccatctaaaaacacatcaattgtctatatgtacataaacatgctttttttcatttacaaatacattctggagatgaccatatgacagtgtgtagaaatatttctccctcctctttgcaagtgctcagtgtcctgtggtgtgaacacgcttcattcaacctgggcccttgggagagatgctgagtggttcccgggctgtccccactccacaccgtggcagtgaagagctgctgaagtacatgcttcatagtccttgcgtctctctgtgagtacattcctagaagtggggttattgggtcaaagagtaaatgcatctctaatttggctaaagatattgccaaatccacctgcctgggggtttgtgccaccttagagatcagtgatcaatgggtgatatccgaggacgtctttctattgtggtcagactcttggattttgacctgactaatggaggagaaatggtgttgcagtgaacttttgatttgtgtttctctttttatgatcgttttgagcttaatttgtgtttctctttttatgatcgttttgagcatcgtttcgtatctttaaggagcaatttacatctcctctgtgagcgtctactcccatctctatcagcaggcgtcttgcctggctccggaggaagtgtctctgaaggctggtggtcccaggatagggcaaaagaacgggagtgagaactctccacacagtgcttcttctggggttaaggaccctctgcctcagtggctcctgggcgtgattaaacttgccatttcctgggcccatcctagacaggctgctgcaagccagccaggccgggatcctgctgccccggggaggacgtggggaaaatccctgctggagggactgccccttccttgtccagccactgggtgtttatggttcagtttagggcggggatgacagcacacgacacacactccgctctcaagagttactcctccctccccgccagactcccccaaccggaggtctccccagagtggaggaccttccagcggctggcaggcggcctcaggcaggcagtggggagcctctgcaggttcccgagccaggaagtggcacttaggagtgaggatcttaggagcggggctcttggacaggagggcgagtgagttgggagggcctcaagcgggggcccgatggctctctctgctgagaagggagggccctagggatggggacagagagctggcagttgaagggccaaggagcaggcagcttcccagtcacagagccttgtgcagaggaaggggaaggagtccgagagggtggccctgctgtccagggccaagaaaagggaaagccgctggaaatagcagaaacctggctggggcagcacccaaggcccaccccgaggccaggtggggaccccagcggggcatctggcagcagtgggtccccaggagcaggcagtgggagccatcagggtgagtgagctggcgggggtggcccaggggctggggtcacctgccctcagcccaaggagcctcttctggcctttggtggccagggctgggatctccctgctggtggccagatgcctcgacaccccataggctgggtgaaggtggggcaggagttccaaggcgtggagacggcccctgagtgcccaggggcctcctgctgcaggtgggcagagctggaggctccactgtgagggtgcctggtgaagggaggcgtgggcacgggggaggcagggaagggccctgggtgcgacttgcagcccctcagaccctctcaggacccctcctgcccccatcgtggtcctctcagggcccctcaggatcccttccagacccctgggaccccgtgtcccctgctcgtcctgcggtggtgcccagctcctgccaagggccctgcacttgggctgtggggaccccctgtggggatggggccatcacaggaggctgagcacagggcggggtcttggctggaggggaccttaggccacaggtgctagtcttctgcagccaccccccaggacccctgcccgctacctcctctgccccacagctgacaggctttgccctcccctgcccctctgtggccacacactcagttctctatacacttttattatggaaaacatcaaatacacacaaaagcagggcatctaggacagagaccctgtgtcctggtccccagcccctcacagtgacaccgccaggctttaggcaagatcagtgggggaggggagtttcccagcaggacgtgcacttccagacctggttctgtgaagaggggaacagaaagtgctgagggtgacagggaaacctcgagaagagggaggtgtactcacatcctctctcggggtccacaactgagcccccacacagaggaccccactggtctgcctgagctgctgggtgggcaagtgaggcactggcctcgggggcacagcgcttgaagggacaccagaaaaacagtcataaagataaaccgtaatgtgttgttttatttcttatttatttatttatttatttttgagatggagtctccctctgtcgcccaggctggagtgcagtggcgtgatctcggctcaccacaacctccgcctcccgggttcaagcaattctcttgtctcagcttcccgagtagctgggactacaggcacgcgccaccacgcccagctaatttttgtatttttagtagagatggggtttcaccatgtcggccaggctggtcttgaactcctgacctcgtgatccccctgcctcggcctctcaaagtgctgggattacagatgtgagccactgcacccagccaatgtgttgttttagtaaaccaaaactatgcaaaggacgcatgaggatccaagcgactcatttaggatggcagcttcactgcaaaaggagtctcgattcagacctcaagacatgcttcgtgggtctcactcaggaaggaagtggaggcaagtcagaatgtggtgagaagagagggtttattgaaagttgctccattacagagcagggtgtcgtcagaaagcaagagggggaacaccccagctttaactttttctcatacaggggtctcgtctgtgtaaagactaagctaaactgtgcctaacatgtattattctattgatttaaagaaaactgtctgtcacggggtcttgctctgttgcaaccaggctggagtgcagtagcacgatctcagctcattgcaatctctgcctcccaggctcaggtgctcctcccgccttagcctcctgagtagctgggattacaggcatgcacccccatgcgtggctrattttttttttttttactttttgtaaagatggggtcttgctatgttgcccaggctggtctcaaacttctgggctcaagccaacctcccaccttggcctcccaaagtgctgggattagaggcctgagccaccgcgtccggccaagggtagttgtctggaaagcatatattgttctggataccagggcacttggacactttgctgtcatagaagtgtgtccacgcaggcgtcactggctgctgctttagctgtaaacatcgtatgaccatgggctgtggctggcaggtatgtgcctcattggtctcaaggtggagctgaacgtaaacggcttttctctggctctcccaggctcctgcttccctgacatcgcctcacagacttcccttcaaagcagggctgtccaatcttttggcttccccgggccgcattggaataagaagaattgccttgggccaaacatgaaatacactaacactcacgatagctgatgagcaaaaaaaggtctctgcgtaaatctcataatgttttaagaaagtttacaaatttgtgttgggccacattcaaagcccgcagcccgagtgttggacaagcttgctgcagaggctcccctagatagggctgcaggggtggcgtccggcagctctagctggagaagcaggaggaggggcaggaaggaatcctgttcggagctcctcgcgtcacacatacagcccagcggggtgaagtgggaggggctggcgctgctgcagggggctaaccttgggggtgagggggcagcctcggagaggaagctgcccaggagcagaggctgggggcggagggccccgggcagtgcccccgtgcccacagcaggaccctggctgccagttctccgcagagggccaggtggtctgaagctgcccagcagggagagaacaggcctggcctggactggaaacctgccatctggcctctcgaacctggggactccgggtgtcctcgaagaagggcctgagcagcagcagaggaccccaggcgaccgtgcctgagccgggcgccgacgacgactgagcacctgatacgtccccggcactcgcagccccgcggccggagtcgctgtgggtgagcggtcgtcgagcttcacagaggccgggctctgtgccagggccccgacagggcaggaagcagatagagtcccacaagcacaagcccagtgcgcagaaagggttacttaaaaaataagttctgtgataaaatcaaacagggtgaagggctggaaacaggtcatgagggcgcaaacaggtcgtgagggcgcaaacaggtcgtgagggcgcaaacaggtcgtgagggcgcaaacaggtcgtgagggtgcaaacaggtcgtgagggcgcaaacaggtcgtgagggcgcaaacaggtcgtgagggtgcaaacaggtcgtgagggcgcaaacaggtcgtgagggtgcaaacaggtcgtgagggtgcaaacaggtcgtgagggtgcagctttggggagagaggggccctgggggtgagcggggagctaggagagaaacagcgctctggaggggcccgggcaaggcctgcctgagtgggagggggcagagcacgagggcccaggctccaggctgggtgggactgccctgaagtgcctgcggagacagccaaggggcagatggagagaggtag

SEQ ID NO: 17748 - DNA, 14661 bp, Homo sapiens
aacaagaactggattaggtttcttcaaatgcatgtaatagaaatctactctagctaacctaatccaacagaaatttttttggaaagagatacaggagctcactggacgcaagagaacactgacaacacaggatagctcaggaatcagctaactttggggaccttagtagcaggaacttccctacagcttttcctgaacactttgctgaaatgaatgaagaccagttctgcatcctcgtaccaccttattcaccacgtgaaatcctaggaggagtacacttgtccgtgattaggtcacacccctgggctaggctcaggtaataaggcaaccgtccaatgggttcaccttgcccgctgcctagacagagccgatttatcatgatgggggaattgcgatagagaaagaggaattcacacagagccgactgtgtgggaggccagagttttactgttactcaaatcagtctccctgagcattcagggattggaatttttaagaacaacttggtgggtgggggaaagccagtgagccgrgagtgctgattgatcaggtcagagatgaaaatatgggaagctgaagctgtcctcttgtgctgagtcagttcctgggtgggggccacaagatcagatgagccagtttattgatctgggtggcgccagctgatccatcaagtgcagggtcggcaaaacgtctcaagcactgatcttacgggcagtccagggagggtcagaatcctgtagcctccagctgcatgactcctaaaccgtaatttctttctttttttttttttttttttttgagacagtcttgctcggtcggccaggctggagtgcagtggcgcggtctcggctcactgaaacctccgcctcccgggttcacgccattttcctgcctcagcctccggagcagctgggattacaggtgggagccaccacacccggctaatttttgtatctttagtggagatggggtttcaccacgttggtcaggctggtctcaaactcctgacctcaggtgacctgcccacctcggcctcccaaagtgctgggattacaggcgtgagccactgcgcccggactcctaaaccataattggtaatctcttggctagtttgttagtactacaaaggcagtctagttctcaggcaagaagtaggtttgttttgggaaagggctattaccgtctttgttttaaactataaactctaggccgggtgtgatggctcacgcctgtaactataaacaataaactaagttcctctcaaagttagttcagcctatgctcaggaaggaacaagcacagcttaaagcttagaagcaagatggagttgcttaggttagatctctttcactgtctcagtcataattttgcaaaggtggcttcaataacaggaagaatattagggaaggaacttatttatttatttattttattttgagacagggtctcaccctgtcacccaggccggagtgcagtgctgcaatcatggctttctgcagcctcgacctcccgggctcaaacagtcctcctacctcagccttttgagtggctgggaggtggagagaggaggactgcttgagcccagaagttcaagaccagcctgggtaacatagtgagaccctgtctctacaaaaaatttaaaacaatagctgggcatagtggcacatgcctgaggtcccagctactcaggagactgaggtgggaagatcgcttgagcctgggaggttgaggctgcagtgagccatgatggcaccactgtattccacctgggtgacaaagtgagaccctgtctcaaatcacaccaaaccaagcacacaaaaaaacacaaaaacctatctccgaagtggcaccacatccagatggttttttttttttttttttgagacggagtcttgctctgtcgcccaggctggagtgcagtggcacgatctcggctcactgcaagctctgcctcctgggttcatgccattctcctgcctcagcctcccaagtagctgggactacaggcgcccgccaccacgcccagctaatttttttggtattttttagtagagatggggtttcaccgtgttagccaggatggtctcgatctcctgacctcatgatccgcccgcctcagcctcccaaagtgctgggattacaggcgtgagccaccgtgcccagcctccagatgggtttataggtgaactccaccaatctatgtagaacagaaaatccctatctataactgttccagagaatatagttttccaatttattttacaaggctagcataaactctgatcataaaaccaaacaaacagaaaaacagacaaagatccccaaaagagatctataagccactcctattttctaacttagaggcaaaagtcctaaataaaatatgagcaggctggacgcagtggctcatgccggtaatcccagcactttgggaggtcgaagcaggctgatcacctgaggtcggaagatcaagaccagcctgatcaacatggagaaatccagtctccactaaaaatacaaaattagttgggcgtggtggcgtatgcctgtaatcccagctacttgggaggctgaggcaggagaatcacatgaacccaggaggcggaggtcgccakgagccgagatcactccattgaactccagcctgggcaacaagagcgaaaaaagagatcaagaccatcctggccaacatggtgaaatgccctctctactaaaaatacgaaaattagcccggcgtggtggtgtgcacctgtgatcccagctgctcgggaggctgaggcgggaggatcgcatgagcaggttgcagtgagcggagatggcgccgccgcgctccagcctgggtgagggtcaaaaagaaaaaaaaaaatcaacagcctctgggctcggggtccttattcaatttcatggcttctctccagacaaactcccacctcactttctatactacctcgtcttccccacattttccaatacctttgcagcgggcaaattatataaatggcaaatctatggattaactgcatctggcttaagtgtctatcccttgtccggtcaccagctggaagcagataggggcaggctcaggcggctgcatggagctcctactggggaacagtgcagggccacattctcatcacagaaggggcagtggaccaacaggcagggcatggtgtctgactttctgtaatagacatttaacctggtcttcggaagtcagaaaaggctttccagaggaaggaattctgagctggaacttgccaaataagtaaaagttaggcagaaggggataagggttgaagaaaaagttcaggcacaggagagaatgatcaagagtaagggcagagtgggaacagatggggctggacaggcaggcaaaggggagaccttgcaggaccctgcaggccatgttgggaactttagactttctcctgagatctatgaggagccattggtgaatttatttatttatttagagacagaatttcgctctttcgcccaggctggagtgagggggtgtgatctcagctcactgcaacctatgccccctggggctcaagctgttctcctgcctcagcctccctagtagctgggattacaggtgctggccaccacgtctggctaattttttgtatatttagtagagatgggttttcaccatgttggccaggctggtctcaaacccctgacctcaggtgatccacccgcctcggcctcccaaactgctaggattacaggtgtgagccactgtgcctggcccattggtggatttcaagcagtggaaggatatgagcaaatgtgcagttctgaaagaccactccagtggagaataaagagaagaaagggaattgggaagttgggagaccagcaaggaggctgttgcagggaagcagtagcgagaagatggtgccctgggcagggcatggtggctcacgcctgtactcctagcactttgggaggccgaggtgggaggatcgcttgagcccaggagtttgagaccagcctaggcaacaaacaaatgtttttctgtctctagaaaaaaatttttaaatcagccaggtgtggtggtgcatgcctgtagtcccaactccttgggaggctgaagcaggaggatcccttgggtccaggagtttgtccttgagtgaggcatgattgcgccactgcactccagcctgggagacagagcaaaggagaccagcctggacaacatggtaaaaccccgtctctactaaagatatgaaaaattagccgggcatgatggcgggtgcctgtaatcccagctactcaggaggctgaggcaggagaattgcttgaacccaggaggcagaggtggcagtgagccgagatggagccattgcactccagcctgggagacagggcaagactccatctcaaaaaaaaaaaaaaaaaaagaagaagaagaagaaaggaggaagaggaggaagaagaagaggaggaggaggatatgaacaagaaacaacaacaaccttggactaggaatgctggcaggatggtgtggatggagagtagatttgagagagacgggagataaaatcaccaggacttggtgatggggatgaaagacgggagacgttagagatgactattagggattttgtttgtgttgactgaatggttaggtaaatgagtggatgatggtgccactcaccaggctgagcaacacaggaggagaagccatttggagagagatggtgagttcagctttgaacatattgttttggtgtctgtgggacatccaagtagagatgtccagaaggcagctggacatatgtgcttgtgtctcaggagaagggtctggactagagacatagatttgagagtcattaggttgtaggtggtggttgaaggcaagggaatggatgaggataatctcaggtggttgcatagcgtaagaaaagaagagaatgccgggcgcggtggctcatgcctctaatcccagcacttcgggaagccaatgtgggtggatcacttgagatgaggagttcgagaccaggctgaccaacatggtgaaaccccgtctctactaaaaatataaaaattagctgggaatgaagacagcctaagcacaaactctgggggcagtttaattgttcaagaaggggaatctatgaaggagactgagaaggcccaaccaaacaggtaagaagaaaaccaagaaaattacagggtcatgtgtcacagaggccaaaaggagaatcccaaggggcgagtggccatgggtatgcaggctgccgaaataaagtaagatcacagtggagaagtttcccatggatgtagaggagggagagcattaaagaccttggtaagaaccgagtcaatggagtagcaggggaaagaaatcagcatagactggggtgagaaggcagagagaaaggtgggagagaattaaaagtaggcaactctcagaatgcagctgtgaagaggaagagaagcgggcatctggagaggtttttttgtttttaagatggagttttgctcttgtcacccaggctggagtacaatggcacgatctcggctcaccgcaacctctttccacctcccggtttcaagcgattctcctgcctcagcctcccgagtagctgggattacaggcatgcgccaccacgcctggctaatgtatttttagtagagacagggtttccccgtgttggtcaggctggtctcgaactcctgacttcaggtgatccgcccgcctcagcctcccaaagttctgggattacaggcatgagccacrcgcccggccctggagaggtttttaaaagatggcagaaggctgtttggaggagtccacccccatctcccctgtgtaaaaggaaagcggaagagagaaccacaaagagggcctgggggaaagccgtggagtgaggcgataagggcttgtgtccaggggattcccggtcactggaatccctatcaggcctgcatttcctcctcacccccatccccttccttgccactggcttagtcctccatggggctagaagagagaaggacggagtcgagtggcaccctagaagacgctctgtgccttcggaggtctttctgcctgcctgtaagccggggttggtgctggggcaggagaggrgtctgagggaggggaaagagccaaggacctggagctagtagttttaagttctgcaggcaagggtgggagatgggagtagggaggacaggaggtgtggatgctgtttctggaagcgaagctgcagggggaagggggctggggcctggggggatgcttccwggggatgcagggggatccactcaaggctcccttgcccacaggycctcatgcctctcctcctcttgctgctcctgctgccaagccccttacacccccaccccatctgtgaggtctccaaagtggccagccacctagaagtgaactgtgacaagaggaatctgacagcgctgcctccagacctgccgaaagacacaaccatcctccacctgagtgagaacctcctgtacaccttctccctggcaaccctgatgccttacactcrcytcactcagctgaacctagataggygcgagctcaccaagctccaggtcgatgggacgctgccagtgctggggaccctggatctatcccacaatcagctgcaaagcctgcccttgctagggcagacactgcctgctctcaccgtcctggacgtctccttcaaccggctgacctcgctgcctcttggtgccctgcgtggtcttggcgaactccaagagcyctacctgaaaggcaatgagctgaagaccctgcccccagggctcctgayrcccacacccaagctggagaagctcagtctggytaacaacaacttgactgagctccccgctgggctcctgaatgggctggagaatctcgacacccttctcctccaagagaactcgctgtatacaataccaaagggcttttttgggtcccacctcctgccttttgcttttctccacgggaacccctggttawgcaactgtgagatcctctattttcgtcgctggctgcaggacaatgctgaaaatgtctacgtatggaagcaagktgtggacgtcaagkccrtgacctctaaygtggccagtgtgcagtgtgacaattcagacaagtttcccgtctacaaatacccaggaaaggggtgccccacccttggtgatgaaggtgacacagacctatatgattactacccagaagaggacactgagggcgataaggtgcgtgccacaaggactgtggtcaagttccccaccaaagcccatacaaccccctggggtctattctactcatggtccactgcttctctagacagccaaatgccctcctccttgcatccaacacaagaatccactaaggagcagaccacattcccacctagrtgraccccaaatttcacacttcacatggaatccatcacattctccaaaactccaaaatccactactgaaccaaccccaagcccgaccacctcagagcccgtcccggagcccgccccaaacatgaccaccctggagcccactccaagcccgaccaccccagagcccacctcagagcccgcccccagcccgaccaccccggagcccaccccaatcccgaccatcgccacaagcccgaccatcctggtgtctgccacaagcctgatcactccaaaaagcacatttttaactaccacaaaacccgtatmactcttagaatccaccaaaaaaaccatccctgaacttgatcagccaccaaagctccgtggggtgctccaagggcatttggagagctccagaaatgacccttttctccaccccgacttttgctgcctcctccccctgggcttctatgtcttgggtctcttctgrctgctctttgcctctgtggtcctcatcctgctgctgagctgggttgggcatgtgaaaccacaggccctggactctggccaaggtgctgctctgaccacagccacacaaaccacacacctggagctgcagaggggacggcaagtgacagtgccccgggcctggctgctcttccttcgaggttcgcttcccactttccgctccagcctcttcctgtgggtacggcctaatggccgtgtggggcctctagtggcaggaaggaggccctcagctctgagtcagggtcgtggtcaggacctgctgagcacagtgagcattaggtactctggccacagcctctgagggtgggaggtttggggaccttgagagaagagcctgtgggctctcctattggaatctagttgggggttggaggggtaaggaacacagggtgataggggaggggtcttagttcctttttctgtatcagaagccctgtcttcacaacacaggcacacaatttcagtcccagccaaagcagaaggggtaatgacatggacttggcggggggacaagacaaagctcccgatgctgcatggggcgctgccagatctcacggtgaaccattttggcagaatacagcatggttcccacatgcatctatgcacagaagaaaatctggaaagtgatttatcaggatgtgagcactcgttgtgtctggatgttacaaatatgggtggttttattttctttttccctgtttagcattttctagttttccactattattgtatattatctgtataataaaaartaattttagggttgggagtgatggctcatgcctgtaatcctagcactttgggaggccgaggcgggtggatcaccagaggtagggagttcgagaccagcctggcaaacatggtgaaaccctgtctctactaaaaatacaaaaattagccaggcgtggtggtgcacacctataaccccagctactcgggagggtggggcaggagaatcgcttgaacctgggaggcggaagttgccgtgagccaagatcgtaccactgaactccagcctgggtaacagagtgagactccgtctaaaaaaaaaaaaaaaaaaaaaaaaaacttctggccgggtgcaggggctcatgcctgtaattccagcactctggaaggctgaggcgggtgggttgcttgaacccaggagtttggcccaggcttggcaacatggcaaaacccgacctctacaaaaaatacaaaacattagccaggtgtggtggcatgcacctgtggtcccaggtacccgggtggctgaggagggaggatcacctgagcctgggagatggaggctgcagtgagccctgaaggtgccactgtactccagcctgggtgacagagtgagagcctgtctcaaaacaacttggcttcttttggtgaagagtggctggggcacctgtcatgagaattcacaaggctccaaatgccctaccctggtcacaactacttatccaatagacctccagttacagcctacacttcccctgcctggggtgcctcctctcctccagggctggccacccaccaggccaccccaggcatcagatccagctcaaaaattgccttcctggagtttaatgacaactgctgggacctacctggcagcagcctgcagtactaggggcaaaggtgggtgcctgctttgcacctgcagcctcagaagtgcagctctcctcactgcccaggtcagcaggacagcaaggggtggaccctgcagcatgcaccatcttggtgtgactgaatagtcttgggtttcctgctctcaggctgggacacaggcaaatggaaccccatttcttttctcataaatcctgccattctctaaacacactggtgtggcttcctctcctgccttgtctccagcccaatccaaggcttggggcccagagaatgggactatggagacccccatccccctccagatggtcctgaagatctcccaaacctgaaagtctgaccgaatctctccccaggtggaggaccaactcctgagcttggcagtcagggagtgccaagcactgaccccatctgacagtccagcttcatctcaagggagatacctcacagtctgtgctccaactatcacaagcctatagatcacctgctccccaacagtgttttactctaagcctttgccctcagtccagccaggtgtgctatccttgccccatccccagccagtctaaccactcagtctgcaagtcactactcccaggcgaggccaggtgctccaagttaccctgcaacactattgctacactcagtttcccaactgctcctgtataatcttgtcttctggaccaggaactccttaaggacaaggtctaggcttcaggcatctcacaatagccaccaaggcgcaggacagtgtacacagaggcagcagcaggggcgccaggatgctgagctccacctcttctgctgatgaggctctgccaaagggacagctcccacctgctgcctgcctgtcccctagcctggcaagcactcctcagtttgaccttcccaaactctcttgtgccccaagaggttttaaggctccttgaaggctggcctgggaaccacacatcttctaaagaaatggacaaggttctcactctccccagccaaggacccagatcaggtctctggccagcattcccctttcctcaagcttccagtgcccacccacttaagccctggccttccacctgcactgcctccagcccacagtggtctgacttcctctctaagtctctttatttcctccctctttaggctgcagaagcagtcatcagaccgaggggcttttcctggggattatgtgagatgatctgggcatcggtggcattcttgggcgagtggctggaggaaacacaccgggcctgggatttgagtttttctggccctgtcagctgctgtggcatgacmgatttatacagcatttgcaaaaaaccagcggctgctttttctttaacaatttttcttaaaaactccagttcctattctccagcttctttgtccagtctcctcccctctcctagccaccccccagactctccagatttggggctggtgtcatcaatccaatttattaagtcctcaatgagggggaggaagggccacatctccctctgcaggccctttgaccatcttgatggcttctgctcctccctgtcccctcagctctgccttggtttccccactgacaaaggggatcttctgctgtcctgtgtgccctgaaactaaaacccagggggaggccagaaatcctcaggaagttttccagctccctgcaagaatagccaaggacagagaaatcacaggatcaggacgagcagggcaagctggagcagggggtagaacagaccaagtcctttaccgcagaggaagaaaccacactgtggaagggaaataaatagaggggtccagggcagcagagcccaggcccccagggcgcagtggctataggcgcagcaggcgagtgggagcccccggccgcttcagccactgaggaagagacgcttgtaggccttgttcatctgctccaagaagatgaaggtgaggacggtgtgggggcccaggcgggcatagtacggcgtgaagcccttccacaggctgaagaagccctcgtagcggacaactttgaacagcacgtcctagacacagacaggcagggcgctggggctaggactctaggtccccatccccctcacccagctgccttcacacctttcccaggggatccgacaccccctcccaggcccccagaatggcttcctcaccagcccgttcttgtattccggcttcccatcaatcatccgcatgttctggattctgcaggagaggaygcaggggcatgagagaccgaaagggcaccctcccacccacctccaggcccaggctgcacactcaccgggtcttggcaatgtccacaggcatggaggcagcagtggtgacaagaccgctgatcatgctggcacagaagtggcacaagatgttgtcagagaagtagcctgggggaggtgaggcgggggtggcagtcagctcagaggtggctcaggccaggctgggaactaagggcccagctctggatctcacctgagtccagtaagaactgcttggattgggagtaggaggcgagctgggcagcattgacgacgacggcccgagccatggtagggatgcagccctggagggaggggagcggggaagagtcagaaacccctaaaaccagacctcacagcccccaagtctccagcccctccactcacccgccacagtgtgaggacaccctcttcccgggtgattcgaatcagggcgttaaacacatttttgtagccacggcgctggtcagctggaagcctggtgggaaggcagaaagaggtcaagatcaggattgcccacaggtgcaaagaaaggaaggccagaacaggtaaacactctgctccagatccgggataaaaaactggtcctttcattctagattcgagggaatggggctggggttaggttcagacttggaactcaccggccatcggcagtcatgcggataagagccacttcggctggtgttcccacaaaggcaccagtggcacctgcggtcatgccaatcacagccttcagcagaaagccagggggagtaccatcagccccagtcaggcgctcaaacagcacggtatagatgccaaggcgggtagtggtgtaggtggcctgacgcagcaggccagccgacagcctgaggagcagaggggtcagcatatcaggccaaggtctagagctgccaacccacagtctaccctccatcctgaggccccaatacccagtgtaaatgcccctcaggccttctgccttcaggatactggtgagggcatggaagctggttttgtactctcgagtcttggccccttccccgctcaactgcatccggttcttcaccaggtccaggggctggacaaaaactgtagctcccatcctgggggaagacagaggtggagtgaagggccaggcattccagatctaccagtgcccactggagcctggcagcaagaggttacaaaggtcagggcctgccatgcgattcaagaatcaggatgctggtgagcatgtgtataagagtctatatgtacaccaagtgcaacgggtctgaaaagtctagttgtccagtaggggccatgcaatgaaagtgctccaagcagcttcatgacagtcaagcagtgacctggggctgcacgcagtccgacacagggaggggaggaaggggcatccaagatttaggactccaggtagtcctgcaggagccatttaatggcctggaaccccctgccgcccggccgagcttagcaatgcgctgggaaactcagctggcccggcgggggttgtgcaacgaccctgcatgcagtccataagggtcctgcaatggggccctagcagcccatcggggaactcgcaatacgctggagatcgcgctgaccccgtgccggcacagttcactgcaacagacccagagatgaaccgggcccggttccttttgcccttcccttcctcctcttttcccatccctggggcctgagcttacccggccaggcccccaaacaggaacttgacggacttaggggaggtacggggcttcccgtctatcccgccggccccggcactcgccgtcgccgccatcgccactcaatggccctcggctccgggtcccgtgcgcgcgcggccccgctcgcgcccaaggtgacaccgcgcgcgcaacagagcgagggcgcgcgcacgcccctccagctctcaggtccgacacccgctggaagccggcgcgggcgcaggcgcgcagcgcaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggtttgtaaactaggaggctccgggtttccgggcacttttattaggtcgtcttctgggccaccagtgccccttccatctccacaggcagtccctccatcgctaacctttttttaaccggccttttaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcggtgagtctgagggacggatggggaaagggcgctgaay

SEQ ID NO: 17749 - DNA, 14670 bp, Homo sapiens
atgtccctggttacctccctctcctgctcccatcctatgcactaattcttttttttttttttttaaggtggagtttcactcttgttgtccaggctggagtacaatggcacgaccttggctcactgcaatctctgcctccccggttcaagcgattctcccacctcggcctcccaagtagctgggattacaggcgcccgccaccatgcctggctaatttttgtatttttagtagagacgaggtttcaccacgttggccaggctggtctcaaactcctgacctcaggtgatctgcccgcctcagcctcccaaagtggtaggattacaggcgtgagccaccacgcccagctacctacgcactaattttctaccttcctcatgctcaaagtgacttctgtttttcacagagattaggcaatgaaggatgaataatttcaatttcccacctcctactgacaaacagtgacatctacaccaattctcctacacaaccaaggttaagatgccttctccagttcaaagctaatccctccacctgtgctcagattgctgtcctcccacctccattgagaccttgattcaccaaaccacacccctctcctacctgtgtctatggctcttcctccatggtaaataagcccacataagtctattccatttaaggaaagaggagggaggaagaaaaaaaagaggaagaaggaaaggacaaaccaaacaaaacactctcctctacacttacgtctcttttttatttcctctcttctttggttttgttttgttttgttttttgagacagattttcgctcttgtcacccaggctggagtgcaatggcgagatctcagctcactgtaacctccgcctcctgggttcaagtgattctccagcttcagcctcctgagtagcttggattacaggcacccaccaccatacccagctaatttttgtatttttagtagatacagggtttcaccatgttggccaggctggtctcgaactcttgacctcatgatccgcccgcctcggactcccaaagtgctgggattacaggcatgagctactgcacccagccctctctcactcttcattctttctttactttttgttttcaaagttatatatacatataaagaatcagatagtactacaagacctattacaataaaaagcagacccttcccactctaatttcctcctcctcagaggcaactactttcaccaccttttttttgagacagggtcttgctctgtcacccttggcatgatcacagcttactgcagcctcctcgatgccccaggctgaagagatcctcccacctcagcctcccaagtaactgggactacaggtgcaagccaccatgcccagctagtttttttaacttttttgattattttattaatttgtttttttgagacagagtctcactctgtcgccaaggctggagtgcagtggcactgtgtcggctcactgcaacctctgtctgctaggttcaagcaattctcctgcctcagcctcccgagtagctgggattacaggtgtccaccaccatgcccagctagtttttatatttttagtagagacggggtttcaccatgttggccaggttggtcttgaactcctgacctcaggtgatccacccaccgtggcttcccaaagtgttgggatgacaggcgtgagccaccgcgcccggccagtttttttattttttgtagagatggagtatcctcacgttgctcaggctacacctggcctactttcaccacctttagatgtttattttggcatttacctccctatctctaaacatgcttatttggcaacttcatgatttttgtttttgtttgttttttttgttttgagagagggtcacgctctgtcgcccaggctggagtgcaatggtgcaatctcagctcactgcaacctccgcctcccatgttcaagcgattctcttgtctcagcctcctgagtagctgggactacagatgcgtgccaccacgcccagctaatttttgtatttttagtagagatggggtttcaccatgttggccaggatggtttccaactcccaacctcaggtgatccgccagtcccggcctcccaaagtgctgggattataggcatgagccaccacacctggcttgtgtgacagatttttttcattacttccctcatggtttgatttttcaagggtgttttgtttgtttgtttgttttgtttttgagatggagtcttgctccaaattgcagtgttactgataccttctagtcttctgaaaataatgtttgtggaggaagggatcaagaaatgtagcaccatcatttaaattccctcaggaccaaccctactggacacataaacaatagcaacaacatctactttcaataaaatgttggcattgctctctgccaattaccttgagagcctgactctggaatgaaaagctctataccgaccctggccttgaactcctgacctcaagtgatcctcccgcctcgacctccaaaagtgctgggattgcaggcataagccaccatgcccagccaaggatgctttttcggattcaatcatgttttatactatctcttacctaaaagcttcaacagttgtccccacctccccctttttattttggtttctgtctttcatgttagaaagtttctttacatacctagaaatttttgctttctgctcacatttaagagcgggtgcttagcttgacatggtggctcacatctgcagtcccagctactcaggaggctgagacaggaagatcacttgagcccaggagttcaggactacaatgacctatgattgcgccactgcactctagcctgggtgacacagagaggccctatctcaagaaactaaaaaaaaaaaaaaaaagagtgaggtgccaagaagttgactagaatttccatgtacacagttgggacttgccaactgtgagtttcagtatgaggtgatctggccaactgactggttggagaacccctgacgttcacatcctaaggtcttttctcacttaccaaattccccagagaagagtcttccagtctcttacctggaaagtataagccttgtgctggagttctggaaactaccactcactatataaactttcgtttttgtttttgttttttcttggatacagggtctcactctgtcacccaggctggagagcagaggcgtgatgaggactccctgcagtctcaactcccaggctcaagcaatcctcccacctcaggcccctccaagtggctgggactatttttatactttttgtagagttagggtcccactatgttgcccaggctggtctaaaactcgtgggctcaagtgatcctcctgccttggcctccaaaagcgctagaattacaggcatgagccaactcacctggccctaaactttcacttaatctctgtttttcttttttggagactgagtctcactctgttgcccaggctggagtgcagtggcacaacctcggctcactgcaacctcctcagcctcccaagtagctgggattacaggcacccgccaccacgcccggctcattttttgtatttttagtagagacgggggtttcaccatgttgcccaggctggtctcgaacttctgacctcaggtgatccacccgcctaggcctcccaaagtgctgggaatacaagtgtgagccaccgcggccggcttaatctctgttttcaacgcagtacccttgccctcaactgtactcaggtgctctctaagctaaaaaacctgttttccatttccgacaaactccagtattctgatgggttgggggagatcggttgccaagatatatagagtcaataaagagatctggaggtctaacttcaaataatcctcctaattttagtaccactttcaccccagctgtaagcgatgctactaatttcatggtaaatcaggttgcttgtaagctttctttgctgctggcttagttaccacctcactgcaaaatgagtctgttttccagcatctgtctaaagttttgctattaactcctctccctttgactcctttttaaaacaactttaggccaggcacagtacgctcacacctgaaatcctggcactttgggaggccaaggcaggaggatcctttgagtccaggagttcaagaccagcataggcaacacaatgagaccctgtctctacaaaaaaaattaaaaattagccagatgtggtagcacacatctatggtcctgactcttcagaaggctgaagtgagaggtcacttgagcatgggagtttaaggctgcagtgagccatgactgagccactgcattccagcctgggcagcagagtgagaccttgtctcaaaaaataaaatttttttaaaaaagcaactttctgttattttattagcatttagggaaggattaagtcaaatgccggacccatcaagttttttgttttttgagacagggtcgcgttctgtcacccaggctggagtgcagtggcacaatccatggctcactgcagcctcgacctctcaggctcaagaaatcctcctatctcagcctcccaagaagctgggaatacaggcatcagccaccaagactggctattttttttaatttttaatttatactttttaaaaaattatttgaatttatttatttattagagatggagtttcactcttgtagcccaggctggagtgcaacagcgcaatctcagctcaccgcaatctccgcctcccaggttcaagtgattctcctgccttagcctcctgggtagctgggattacaggcatgcgccaccatgcccagctaattctgtatttttagtagagacggggtttctccatgttggtcaggctggtctcgaactcctgacctcaggtgatccacccgcctcggcctcccaaagtgctgggattacaggtgtgagccaccaaacccagcctttattttttaaatataggagatggggtctcactatattgcccaggctggtctcgaagtccttagttcaagtgatcctcccacctcagcctcccaaagagctgaaattacaggagtgagccaccatgcccagcccccaaatttttttataaagacagtatctcactatgttccccaggctagaccattcagtttaactgagtctaaccttcatgtgctaaccttgggcaaactagtttcattcttgataatctactataaactgttacaaacgatctttccaaaaaaggtaattctggtcataacacacttcttaaaaaccctttaaaggctcaaatgtcttcagactcaagtccaaagtacatagcttgcaagccttttcctgattccgctcctctctccagcctcaccattgtcatacctaacccccaccacgctccgttcactccaggcaggcagaatcccttgctggactccacatgcgctgttcccgtcacagcaccatgctgttgcctatgccgtctcccttttccactacaagctctcatccacgtagttcacctttaagattcagctcacgcctgtaatcccagcactttgggaggccgaagagggtggatcgcttgaggtcgagttcgagaccaacctggccaacatggtgaaaccccgtctctactaaaaataaaaaaatcagccgggcgtggtggcgggcgcctataatcccaggcacccgggaagctgaagcaggagaatcgcttgaacctgggaggtggaggttgcagggagggagatcttgcgactgcactccaacctggacgacagagtaagactgtctcataaataaataaacttgtgtagaataaactagaggccacagacagtgtcaagaagatggacaggtctgaatggcctcgggctaggggatattccactgtcgcctctgactacgggtggtcctgtggctgaggcgcagcgggccctgggagttgtagttcatcaagcggaccgaggaggcgaggctgcgctgagcatcctgggaatcgtagtgctcgctacacggtgccctctgcgcaggcgcwcaccgagagccacttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggttcgggatgcgacaacctggacagcggggagcgaaagcgtgaccgggctgcactggcagcctgacctgggacttggagcagggttgggragggaatcctacgtgcgtgcgcagcgaaagggcgggactgagaggggctggcctagggagaggctacactggcagtctccgtgtgtccccgccctctctccgccctggcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtcggtgtgtctggggggttctgcgagcgaaccccagctctgggtcaaagcctcaggcttgggtgatccagggtggagcattaactgggcaggaccagacctccccagccggccatccagagcgggtttcttcctctaaaaggaaagaatgggccgggcgcagtggcttgacagagttcgagaccagcctggccaacacggtgaaacctcgtctctactaaaaatataaaaattaggccaggctcggtggctcactcctgtaatcccagcactttgggaggctgaggcgggtggatcatctgaggtcaggagttcgagaccagcctggccaacatggtgaaactccgtctctactaaaaatacaaaaattagctgggctggtagcgggcacctgtaatcccagctacttggaagggtgaggcaggagaatcgcttgaacccaggaggtggaggttgcagtgagccaagattgcagcactgcactccagcctgggtgacaaagcaagactgtctcaaaaaaaaaaaaaaaaaaaaaagccgggcttggtggtgagtaccggtaaccccagctacttggaaggctgaggcaggagaatcgcttgaacccaggaggcggaggttgttgtacttagccgagatcatgccattgcactccagcctgggtaacagagcaaaaactctgtctcaaaaaataataaataataaaatgaaagaattaaaggtggccctgcatacctcactgggtaacatcacatgtgcctagcagaagatgtgtaaataatgctagaactacagaactttgtcactggaaacttggcctgacctccaggccacgaggtcccaaatccttatatcctgagaagagggacaggattgagaaggttctgaaatcgtcgcagggaccactaccattactaatttttacggtgtgccagatactctgcattactttatctaatcctcaacaactctaggaagtagttattgtcacccccattttacagacaagattaacataagttaaatgatttatttacccagctaccagatggcctaacaaattcaaactcagggaagaaatgagacgagacctgatgcctggttggagttagggtaaaggagatggtgctccattgatagtctgtcttgtaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagkatgagcaccaacataccctgctggtcaaagtaccctaggacaaaggggcaaatggtgggcatggaaaaactgaagcccgagcctgcccacagctatgccttggcctctccagcagggtgctcctgctctgcactccagaaacaccctgacaggctcagagaggagatggaaactgacatacccaacccacttcctcaaacacttcatgctgctgccccagccttcccgcagacttggcctaatgaaartacatacttcttcattcggagagacaaaacaagaactagagttttaatgataataaaagcaataataataaaagcaataacaataaaaacaagatcagactctcactggggtaggcaagggactgaggaggtgaaaccaacccgtatggtgtcccagcacggcacctgctaaggagggagggtgggaaagcccaggccttcgttgcgggtacaggaggatgcaggagagggctgaggtgggggaggaacaactggtgtactgggagagagatttgggacgagggggaaccatcagcaaaaaatgaagccaggaatcacagtaagggcgcaagggctgaggccagttgtttccataaagaagactcaatcattacaaaaataatttttagtagttaaaaaacacacatagggccaggcatggtggctcacacctttaatcccagcactttgggaggcctgggtgggcagatcaccaggtcaggagttcgagaccagcctggtcaacatggtgaaaccccgtctctactaaaaatacaaaaaattagccgggtgtggtggtgagcacctgtagtcccagctactcaggaggaggcaggagaatcgcttgaacctgggagatgggggttgcagtgagccgagatcatgccactgcactccagcctggatgacagagcgagactccgtctcaaaacaaagcaaagcaaaacaaaacaaaatacacatagaatttgtccaagttattatcacccagtgtgaaaagcagattttatagtataaccgtttttaaatgaggggcctaagagagggcagtggctggttagtcctatgttagatattaacaaatacgtgtaggctggatgtggtaggtgacgcctataatcctcgcaccttcagaggccaaggtgggaggatcacttgactcaggagttccataacagcctgggcaacatagagtccgtctctaaaaaacaaaaaacaaaaacaagtatgtatacagtgcctaccatgttgtcaggggtcagtctcctttattacactttttgtaagaataagccacagtttaccctcacaaacttccattcttggctcaggtattagagtcaggtgccacaggtatataatgaaccggcagatctggaaaggataaagaaattgagagatgagctctgagatcaaggacagtgtttgggggatgagagcttgaactagggaatcagatgaagacatcaacactatgacctggcccacagtaggtgctcagtgaaaatttgtgaattgaatgactggccctcacctccctccacagcttcatctcccactagcttgctctagccatcttctccatgatgttgctccaagcactagtccttgtgcctgtggtggcttccttccctctccactgtctacagtccccgactgactgtcctcagagggcccagagtcaaccttgtgcagacaaccttgatacttgtgtgccaaggccaggtttccagccacctgagagccactgggtcaggatgcctgtcaggaaggctctgggtccctggggggagggttcaaaggtccagtttacctggagaggactgcggtgactgccccctcctcctcttgcacagcacataggaaagggctgcggtgaggatgaagatgatggccaggaggcacaggaccggcactgtggctgatgtcctggctgtgggaccagcatttttttccggctgcttctggttctccccagcctcaggcccaactgccagactgtggcccgcagtgtgaatggtggtttcattgggacgagtgagctctttgtccgaggacagtgatcctactgggagggtggggcgctgagtggactgcaaggtggacaggagcatctgggcaggggtgtggatatctgaagatgccccctctgaggcctgagaaattggggggctggtaggaagtaaatgcttctggtgggccacaatccccgagtaagcatgtccacattctggaaaggaaagaaatgaggaatcaggactatcaggagacaaggtgaaaaagcagatagaggtgtaggggagaaaaagtaatatcttttcctcacccatcgcaagggtcaaggctgatacccctataaataaaaaacattaacaagagaaaagcctaacatttatttaatcacagttttacatgacataggaaccttcagaaacaaagacccgagaaaagtgcatttttatgcttaggcttgctgtgaagaatggacagctgtatagacgtatgattggattggccgggcgcggtggttcacgcctgtaatcccagcactttgggaggctgaggtgggtggatcacctgaggtcgggagttcgagaccagtctgaccaacatggagaaacccagtctctactaaaaatacaaaattagccaggcatggtgtcatgtgcctgtaatcccagctacatgggaggctgaggcagaatcgcttgaacccaggaggtggaggttgcagtgagccaagattgcacaactgcactccagcctgggcaacaagagcgaaactccatctcaaaaaaaaaaaagtatgattggacaaaaaggatatgatctaatggcaataaatggggggtgggggaccagcaaggcctgtccagattcttcttggcctccaagtatagggcaggacccctctgaaatgagagcctatgacctacttccacgtgaagttagagaattcctttatggccagctctcacagaaaaacagaaagagcagagtgagctacttacttctgctgttttcttaattaccaaggtgccatgttttggagtgtcatgttctgagctccaacagagggaagagtgagtcagggaggttatcacgctgaaggccagaagaggaaggcagatgacagacggaaaaggtaggggacaaggaagtgagcgaaccacgagacaagtgggtgtcatgaactgggaaatcagaagaccagggttggattccaagctctgctgtaaagtagctgtgtaacctcaagtagctgtgtaacctcaccccttgtccctaacctctccggaagtgatatcttccagctgtaaaatgaggataattgtagtaccaagggccagggttcctgggaggatgaaaggaaatcatagaggtctaggcagacttaaaggcagtatggatgacacagatcctacaaaactttagctaggacatggaagaaccttttgtattttaatggttgtatatttattttaagagaaaaatataaccaatgcatcaaacttgtgacttcacagatattattgcttaggataatttactatttaagttttctttctttttttttgttgcccaggctggagtgcaatggcctgatctcggctcactgcaacctccgcctccaggttcaagtgattctcctgcctcaacctcctgagtagctggaattacaggcacatgccaccatgcctggctaattttgtatttttagtagagatggggttttaccatgttggtcaggctggtctcaaactcctgacctcaggtgatccaccggcctcaacctcccaaagagctaggattacaggagtgagccaccgtcctggcctctacttaagttttcaaaactagtttgtgcacacttaaaagtaattcatttcattgtatgtaaatttgaactcaaaagaaaaaaaagcattaaaatattgaactctacttaatatacatgctgaaatgtcttgggatgaagtgcaatgatgtccacaatctgccttgaaatgcatcaagaggccgggcactgcggttcacacctgtaatcccagcactttgggaggctgaggcaggtggatcacctgaggtcaggagtttgagaccagcctgaccaacacggtgaaaccccatctctactaaaaaaatacaaaaattagctgggcatggtggcgggcacctgcaatcccagctactcggaaggctgtggcaggagaattgcttgaacctgggaggcggaggctgcagtgagctgagggcaccattgcactccagcctgggcgacagagcaagactccattaaaaaaaaaaaaaaaaaaaaaaaagaaatgcatcaagaaataaggtgatggatgatggatagaagaatgaatagatggatacttaataaagcaaatatcgtgtaattgctgtaaaattgatagtgtaaaatatatgtttatgtaaatatgtaaaatatacatatataaataaaattgtagaatctaggtggaggcactggatattcagtgtgccattctttcaacttttgtatatgtgtaaattttcataataaaatattggaaaagaaaaataggccaggtgtggtggctcacgcctgtaatcctagcacttttggaggccgaggcgggtggatcacaaggccaggagttcgagaccagcctggccaacatggtgaaaccctgtctctactaaaaatacaaaaattagccaggcttggtggtgcgcgcctgtaatcccagctactcaggaggctgaggcaggagaatctcttgaacctgggaggcagaggttgcagtgagccaagatcgtgccactgcactccagcctgggtgacagagtgagactccatctcaaaaaaataaaataaaatagtactttgatttcaagaaaaatattaataagtagacaatagcacacgtggtagaatgaattggcaaaactcatgaaggtgatggtgaatgatcaccccgtttggcaaacagggactcgagtctaagtactttggacaggatcagaagaaggttctaggaatgtgcggccccaggggaaaaggctcaggtaaagaaaactgtcaggtggaagctgctaagccctggaggcagagcctgaagagcagtggaaaagtctcacctttgagatcaagacagctcatcaattcctgaacccatgggtccttgttgcccccacacacgctccaggaaaggagctggaacctgcggaggagagacctgggcttagctgcggcgccttctttccttccccggctccttcctcattccagaggcgtgaagttgccaccaagaaagagccctttctcctgggactgggaaactccccagtaggtgagacggagtcatgaagtttcggggaatgagagcaaacggaacccggagatggggctcggtgagccgggaaggagttcaggctggaccagagagggtcctggaggcacctgcaaggaggggccgcccaggcgctgccctcgcagaggcaggtgaaattacctcgtgtagtatagacaccgatggtaagctctcaggtgtttccggagacgattcatgaactgaaccgatggcggggagtcggaagaaattcttttaccacaataacaacttccagtgacgctgccctcgttgccattgcctgcgcgggacggaggtggtcggcacccattcccaggcccagggtccccactccgctgttccctggcatccaatccacagccccatgacagcctctcggtggacccagggtcagagcgccaggctcaacccacacatcatcacgcccccgacaacatccataatcccgcccggagccaggcgtccccgggcctctgtccccaaccccaggcggctggctggctttcctcttgtccccgctgccttcatccactcaactccgtgggcctcgtgtcccctccccaactcacccccttcccgtgacaggggaatctgggtcccctgccccgcccccggctaacctggctgagtcaggtacaccagcaggagcagaagcaggagcaggagcacgcgggacccgggccgcaagtcccgtcccatctcggggctccgcggactctgcggggatggagccacctcgctctgactcccagacatgctccggcgcgtgacgtccagctggtgtctcaatggctttcgccggggaccggaggagacggcggccggagaggaggcgcgagccagctgcaccccccggccctgctgtgccccgaccgtgcgctcagtactcggcccgcgccatgccagcctctggacgcagggaaagccgaggaggtggagctcccgcgccctgcgcccccgcactgggcccggctccgtcgagggaaggccaggaatcttggaagaaaccgaaagaaaactccggcggcgggcgaggaggggcgggaggacgacggcccgaggagccgattcggttcggttcaggaggccgcccgcctggcccgtccgccgacctgtgaggcggctgcactgccggaccggccctcctcctccgaggcactttcacttccccgatccgggcgccgcgggacccagccgcgctgcatgagcctcccgggcggcccggtggagagagtcgccgccagccccggccgcgcgcacctgcggggcagccacccgcggacgcaccgagcccggggggcgtggccgcccgctgagccggcgagggctcgggcagccctgacgtcacaaccgcacccgcgcaccctccaccgcgaggtatttaccttcgaaaagtggtggcggctgcaggtaccggaggagtggggcgg

SEQ ID NO: 17750 - DNA, 18895 bp, Homo sapiens
cggcgggccccccgcccaggtttcttttctcctcggcgccttcgggtgggggcaggaggagcagagggagttggggatgggggtgggggcccgggcgccgggcgggccccgctcccttgagcaggcttgtaaaccaggtggaagatgaaggcattgcagtacctgcgggggcgcggggcgcagtcagggaccacggggcgggactcccaggggtcggcgctcccaggggtcggggctcccaggggcgcggtcagggaccagggggcggggctccaccgggcggtcagggaccagggggcggggcttgcccctctgagttccagggcgtggggctagactcagggttgggtctgttggagggtcgcggggtcttttgtgggttggggagattccgtgagctagatctaaagaggggtgtgctgggggatgtcgagacctcccatgggggcgacgagtagtggggacagagaaggcaggttgctgggctgggggcaggagggccccaggacagcagggactagggtagaggtgggccttcgaggatgtggagccagagagtaagagaagttaagggtcaggaaggaaatagggtcgcagacccttaccaggacatgcagttgtcggccgctctgaggcgaaagggggagcggaaggggttgggctggggagggctggtgccccctccagtggccaccgccatggtctggccgtccatcacacagctgtactcgctgctctcggtgaagaaggctggcactcggagggactggggtggagcgagagtcgctctgagaggcccctccccaaatccatcccagcagccagaatgacagaccgggctgaaagccgaggtccccggacagaccgggcggaggggagcagggggaggacggagacagacacagagagaggcagggggacccgtgggcactccccaggtttgtggagcaggtgatggtgaagaggaggagagcccagagactttcagaaaaggagatggggaggggccaggcaggaggggagagaagttcccttttgcccccattgcccacctgtaaccggggcagagacctcagccacgtatccttgagagcaaacccrgagttaaatcctgcagacagagaggagggagaagctggctcccacggtgggcttctctcccaccttccccacatgcctaaccctgagacccaggcttttaccaataaccaggtcaggcttgggcccctggaacaggtggtagggccttgctgacaccttgatctgcaggtccctgcggccccctttctccttagtgccagagctgggccgtgctgatatgccggaaccaggccggacagacacctccaggctgtcctgaggggccccaggagtggggtggaaaagccactggaagtcagggaactggaggatgcaccaggcaagatggggagtggggggcagaagggcaggacccaaccaggaggtcactggaggggtcagggctgaaaagcagggccccctcagccctcaccctctgcagggtaaaatgctgctcgtcgctttcggggggcaggccatcacctacaaactgcagctccagggccacatgggggagcaggaccaaaagctcctgaaggacagaaagaaagaaagatctggggtctaccctgtgcccacccccataccaaaatgcccaaccttcaggcctggggtgacttacccaaaacaccatgacaaggtcaaactccttcccggcctccaccacgtggatcttcagtgactgtttgttttggatgttgagctcagggactgggtgaaaaaccagcgctttaaggatgtggtccactctcactcccccatcctgctccaccccccactccgctctccttacaggactggggcaccaggtgggtgatgacgtagtacacggtcagcgggtaggtgagaagcacggctatgggggagtccaagctgaggccccgccatgtgtagtaatcctgccatgagcctggcaggagagggttgctagaggacctggccctggaccsccaccccctctagtctaacaaacctcttcttcacagccacccaggctctggttctccagtccctggccctacccctagcttccacagggcccctccagctcaccaaaaacaccccggggtggatgtgggggcacaggaggcatcagggcagtcccgtctccctggagaagctggtaggggtctcctgagaggatgaaagaargaggggcctggggtcagggagacccccacctgacccatctctttcttccttccaaaggggctgtattccctgagacagccgcagtaagaggaatgggggtttgcatagggatggggtttctgggtggagttggtaggggtgattccattgagggctgggaaaggcctgaaatggccctggtgctgttggtaggggtcagtgtgtatgtggagggatcatctgggacccagacaacttcttcccagtccttccctctaggccaaggggcccatgcctggagagaccccacgcaccaccgcgaagaaggctgagggatggcgtgttgcctcgggggtgtctggagaagcccgggcctggaatcagcatgctgagctgggtccaatagccaygagtgaggccccgagaggccaggaaggcctctttgttgaaggtttcactggtcacctctggagaaggagaaggggaggagttgaggtgctgggctagaaccccagacatttttttttttttgagacagagtcttgctctatcacccaagctagagtgcagtggcgtgatcacgggacactacagcctcgacctcttggactcaaacgattctcccacctcagtctcccgagaattgtgaccacaagcgagtgcaccatgcctgactaattttttctattttttgtagagacagagtctatgttgcccaggctgatctcaaattcctgggctcaagttggcctcccaaagtgctgggattacgggtgtgaaccattgcccggcctagaaccccagccttgaactctccctagcctcccgcgaggaccctggttctaagtctggttccagtcaggccgggaactaccatttctgagtgcctccagcgtaccaggcaccaagccaagataatccttgtaacaattccatgggccttctccgtatccctcatgaggacacggaagcttcaagaagtaaagtggtttgtttaaggycacactgcagttagtggtggagctgggaagcaagtaagtgtttgaatccctgtcccccaatccctgcacgctctcagggacccagacactcaggcctcggcttcagagaccctgtctccagccccaaacacccagcccctgcccttgttccagggatctaggctctagccccagacactcagccttcaactgcaggaccctgttcccagacatctaattcccagtctcaaagacctggtcccagtttcccccaaccattctgacctccttatggtacctgcrgtgtaggtaaaaggcagggttgccagttctcctgcccgctccatgaaggctgcaagccttgggcaccaaaatcggtgactcacatcatctgggcaccgctgccagtcagcccggagacaagcctctccacaatacaagacagcactacactgggggctggggacacagcgggtggtgggcacctagtgttaacctctgtaggtcctgtctgctgttcaactgcccagcagctgcccatatgtcactcggtctgtttgtcttacaccctctaaccgcctgtaacagtctgtattgtttcctctgcatcttctcatgtccctgcctctccttctgtctgctaggcgccccccaccaccctgccttccttctatttgcctattggggtcttcctctcccccagctttggggctgctcaccaaggtgtcagcttcgcttcaaagctgtgcctgtgacacacrtggcaggttcgagcacgaagggaagcaaaggtgaagcctggccggggaccccatgtccgcattggggttttggctaacttcacacctagccttgggaccaagctctccagctctctaaatgcagttgggggggagatggcatcaggctggaggaggtgcttgggaatccagggcccgagtcctccccagcctcagataccagatttctataccgatgcagccgggcatctcccacagtaagctgtcggggctttcggggatccccagagcccatgggacaggccatgctgtgacagaggagagcataggcccaaggagccaggtccttggtccctgagccccagcttgcggttccctgggctccatccactagcagatcaatgcccaagatggtgccatgctcatccgtcacaagtaagagacaggaaacgtgcaggggggcagcctctggggaaagagggaaaagttgaggtggtagggggcagcgagagacaaatgtggtcagggtcaggagtaccaaactcaaatacctacggggctaggcaagtaacctcactgagtaaagggctctgggtagagagggcacgctccttctaaaggggacagctgctacagaggaccagaatgcgctgccatgcagaaatgtaggcccactgtcagagcttgagatttttcttgggaatgtgtaaatccagacttctggatactttttttcttgcaatgtttaaacattaaattaaaaaaaaaaaccccactgtgggtcaataaaaacaccttttcaggccagattggcctgaaggccagcactcagaactagtggcaggggagggctcccgaagggaggatggctgggcaaggggtagggcagggccagccctgggttcttaccactcctctgtcccttcctcttctggggtcttgtttcgttctccaccctgtcctctcggcagccatccttgccacctcctgcctcccgggcagcctcctctgactctcctggagggtttgtttcctggggggactccctgctggtaggggctagctcccggtcctcctctggttccaccttctctgtgctgcctgcacccccgtcctctctcttctcttcttcttcatcttcctcctcttcctcctccccttcctccccatcctctaggctgacaaagctgatgtaggggctcaggtctcgcaggtggagtggagggttgtctcccaggagccaggcagtccccaggcctggtccaggacctggttctgccccttgccccaggctgatgcccacactatggttgggcaggacatggagcacccaaagggcagggtcctggggtagccttctgatctgggcctccagctgccggcagcggccctcaaggctagtccctacagctccacgctctgccacaaactttcggaaccagccgaagagaagggcagtgaaatcaaggaactcatcccggtatccagacacaaactccatgtcttcagcggcacagggccccggcccagactgagcaaaagaagggatatatggtgagggacaggagagcaatgatggagtttggggctgggtcacaaattgagggagagggtaggtttgagagtcacttagggttggatccgtggatatgctaggagcggagaagaggatttttcagggctgaggatgggagtttagggaggaaaatgggggctggacttgaaagtgggtgaccagggttggagaagactactcagggatgagatggtatttggggcttaaaattggagagttcacaccctcaaaagcagagtttaaattaaggctagagaggagagagggctaatcctatcgggaacggtttggtggggagggaagcattttggatgcgtctgtggggtatgggagtgggagcgagggggttccctgggctcggatctgcgtggcgggcagccccggtagacctagcccctcccggccgccccactcctccggtacctgcagccgccaccacttttcgaaggtaaatacctcgcggtggagggtgcgcgggtgcggttgtgacgtcagggctgcccgagccctcgccggctcagcgggcggccacgccccccgggctcggtgcgtccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgarmgcacggtcggggcacagcagggccggkgggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagaygggacgggacttgcggcccgggtcccgcgtgctcctgctcctgcttctgctcctgctggtgtacctgactcagccaggttagccgggggcggggcaggggacccagattcccctgtcacgggaagggggtgagttggggaggggacacgaggcccacggagttgagtggatgaaggcagcggggacaagaggaaagccagccagccgcctggggttggggacagaggcccggggacgcctggctccgggcgggattatggatgttgtcgggggcgtgatgatgtgtgggttgagcctggcgctctgaccctgggtccaccgagaggctgtcmtggggctgtggattggatgccagggaacagcggagtggggaccctgggcctgggaatgggtgccgaccacctccgtccygcgcaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggtaatttyacctgcctctgcgagggcagcgcctgggcggcccctccttgcaggtgcctccaggaccctctctggtccagcctgaactccttcccggctcaccgagccccatctccgggttccgtttgctctcattccccgaaacttcatgactccgtctcacctactggggagtttcccagtcccaggagaaagggctctttcttggtggcaacttcacgcctctggaatgaggaaggagccggggaaggaaagaaggcgccgcagctaagcccaggtctctcctccgcaggttccagctcctttcctggagcgtgtgtggrggcaacaaggacccatgggttcaggaattgatgagctgtcttgatctcaaaggtgagacttttccactgctcttcaggctctgcctccagggcttagcagcttccacctgacagttttctttacctgagccttttcccctggggccgcacattcctagaaccttcttctgatcctgtccaaagtacttagactcgagtccctgtttgccaaacggggtgatcattcaccatcaccttcatgagttttgccaattcattctaccacgtgtgctattgtctacttattaatatttttcttgaaatcaaagtactattttattttatttttttgagatggagtctcactctgtcacccaggctggagtgcagtggcacgatcttggctcactgcaacctctgcctcccaggttcaagagattctcctgcctcagcctcctgagtagctgggattacaggcgcgcaccaccaagcctggctaatttttgtatttttagtagagacagggtttcaccatgttggccaggctggtctcgaactcctggccttgtgatccacccgcctcggcctccaaaagtgctaggattacaggcgtgagccaccacacctggcctatttttcttttccaatattttattatgaaaatttacacatatacaaaagttgaaagaatggcacactgaatatccagtgcctccacctagattctacaattttatttatatatgtatattttacatatttacataaacatatattttacactatcaattttacagcaattacacgatatttgctttattaagtatccatctattcattcttctatccatcatccatcaccttatttcttgatgcatttcttttttttttttttttttttttttaatggagtcttgctctgtcgcccaggctggagtgcaatggtgccctcagctcactgcagcctccgcctcccaggttcaagcaattctcctgccacagccttccgagtagctgggattgcaggtgcccgccaccatgcccagctaatttttgtatttttttagtagagatggggtttcaccgtgttggtcaggctggtctcaaactcctgacctcaggtgatccacctgcctcagcctcccaaagtgctgggattacaggtgtgaaccgcagtgcccggcctcttgatgcatttcaaggcagattgtggacatcattgcacttcatcccaagacatttcagcatgtatattaagtagagttcaatattttaatgcttttttttcttttgagttcaaatttacatacaatgaaatgaattacttttaagtgtgcacaaactagttttgaaaacttaagtagaggccaggacggtggctcactcctgtaatcctagctctttgggaggttgaggccggtggatcacctgaggtcaggagtttgagaccagcctgaccaacatggtaaaaccccatctctactaaaaatacaaaattagccaggcatggtggcatgtgcctgtaattccagctactcaggaggttgaggcaggagaatcacttgaacctggaggcggaggttgcagtgagccgagatcaggccattgcactccagcctgggcaacaaaaaaaaagaaagaaaacttaaatagtaaattatcctaagcaataatatctgtgaagtcacaagtttgatgcattggttatatttttctcttaaaataaatatacaaccattaaaatacaaaaggttcttccatgtcctagctaaagttttgtaggatctgtgtcatccatactgcctttaagtctgcctagacctctatgatttcctttcatcctcccaggaaccctggcccttggtactacaattatcctcattttacagctggaagatatcacttccggagaggttagggacaaggggtgaggttacacagctacttgaggttacacagctactttacagcagagcttggaatccaaccctggtcttctgatttcccagttcatgacacccacttgtctcgtggttcgctcacttccttgtcccctaccttttccgtctgtcatctgccttcctcttctggccttcagcgtgataacctccctgactcactcttccctctgttggagctcagaacatgacactccaaaacatggcaccttggtaattaagaaaacagcagaagtaagtagctcactctgctctttctgtttttctgtgagagctggccataaaggaattctctaacttcacgtggaagtaggtcataggctctcatttcagaggggtcctgccctatacttggaggccaagaagaatctggacaggccttgctggtcccccaccccccatttattgccattagatcatatcctttttgtccaatcatacttttttttttttgagatggagtttcgctcttgttgcccaggctggartgcagttgtgcaatcttggctcactgcaacctccacctcctgggttcargcgattctgcctcagcctcccatgtagctgggattacaggcacatgacaccatgcctggctaattttgtatttttagtagagactgggtttctccatgttggtcagactggtctcgaactcccgacctcaggtgatccacccacctcagcctcccaaagtgctgggattacaggcgtgaaccaccgcgcccggccaatccaatcatacgtctatacagctgtccattcttcacagcaagcctaagcataaaaatgcacttttctcgggtctttgtttctgaaggttcctatgtcatgtaaaactgtgattaaataaatgttaggcttttctcttgttaatgttttttatttataggggtatcagccttgacccttgcgatgggtgaggaaaagatattactttttctcccctacacctctatctgctttttcaccttgtctcctgatagtcctgattcctcatttctttcctttccagaatgtggacatgcttactcggggattgtggcccaccagaagcatttacttcctaccagccccccaayttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagytgggcctgaggctggggagaaccagaagcagccggaaaaaaatgctggtcccacagccaggacatcagccacagtgccrgtcctgtgcctcctggccatcatcttcatcctcaccgcagccctttcctatgtgctgtgcaagaggaggagggggcagtcaccgcagtcctctccaggtaaactggacctttgaaccctccccccagggacccagagccttcctgacaggcatcctgacccagtggctctcaggtggctggaaacctggccttggcacacaagtatcaaggttgtctgcacaaggttgactctgggccctctgaggacagtcagtcggggactgtagacagtggagagggaaggaagccaccacaggcacaaggactagtgcttggagcaacatcatggagaagatggctagagcaagctagtgggagatgaagctgtggagggaggtgagggccagtcattcaattcacaaattttcactgagcacctactgtgggccaggtcatagtgttgatgtcttcatctgattccctagttcaagctmtcatcccccaaacactgtccttgatctcagagctcatctctcaatttctttatcctttccagatctgccggttcattatatacctgtggcacctgactctaatacctgagccaagaatggaagyttgtgagggtaaactgtggcttattcttacaaaaagtgtaataaaggagactgacccctgacaacatggtaggcactgtatacatacttgtttttgttttttgttttttagagacggactctatgttgcccaggctgttatggaactcctragtcaagtgatcctcccaccttggcctctgaaggtgygaggattataggcgtcacctaccacatccagcctacacgtatttgttaatatctaacataggactaaccagccactgccctctcttaggcccctcatttaaaaacggttatactataaaatctgcttttcacactgggtgataataacttggacaaattctatgtgtattttgttttgttttgctttgctttgttttgagacggagtctcgctctgtcatccaggctggagtgcagtggcatgatctcggctcactgcaacccccatctcccaggttcaagcgattctcctgcctcctcctragtagctgggactacaggtgctcaccaccacacccggctaattttttgtatttttagtagagacggggtttcaccatgttgaccaggctggtctcgaactcctgacctggtgatctgcccacccaggcctcccaaagtgctgggattaaaggtgtgagccaccatgcctggccctatgtgtgttttttaactactaaaaattatttttgtaatgattgagtcttctttatggaaacaactggcctcagcccttgcgcccttactgtgattcctggcttcattttttgctgatggttccccctcgtcccaaatctctctcccagtacaccagttgttcctcccccacctcagccctctcctgcatcctcctgtacccgcaacgaaggcctgggctttcccaccctccctccttagcaggtgccgtgctgggacaccatacgggttggtttcacctcctcagtcccttgcctaccccagtgagagtctgatcttgtttttattgttattgcttttattattattgcttttattatcattaaaactctagttcttgttttgtctctccgaatgaagaagtatgtaytttcattaggccaagtctgcgggaaggctggggcagcagcatgaagtgtttgaggaagtgggttgggtatgtcagtttccatctcctctctgagcctgtcagggtgtttctggagtgcagagcaggagcaccctgctggagaggccaaggcatagctgtgggcaggctcgggcttcagtttttccatgcccaccatttgcccctttgtcctagggtactttgaccagcagggtatgttggtgctcatmctccccaccctacatgttcccaggttctgtcccatggcacaggtgatggtctccctctcagctctgggtccatctccctggcctagttctccagcatctgctcacaggttcgagccacatcactgagcttgaggcgggcatagtccactcgcttcagagccatctgacagtccttcctcgaagagtagctggagccctcatggggctgccctgtggccacctacaagacagactatcaatggagcaccatctcctttaccctaactccaaccaggcatcaggtctcgtctcatttcttccctgagtttgaatttgttaggccatctggtagctgggtaaataaatcatttaacttatgttaatcttgtctgtaaaatgggggtgacaataactacttcctagagttgttgaggattagataaagtaatgcagagtatctggcacaccgtaaaaattagtaatggtagtggtccctgcgacgatttcagaaccttctcaatcctgtccctcttctcaggatataaggatttgggacctcgtggcctggaggtcaggccaagtttccagtgacaaagttctgtagttctagcattatttacacatcttctgctaggcacatgtgatgttacccagtgaggtatgcagggccacctttaattctttcattttattatttattattttttgagacagagtttttgctctgttacccaggctggagtgcaatggcatgatctcggctaagtacaacaacctccgcctcctgggttcaagcgattctcctgcctcagccttccaagtagctggggttaccggtactcaccaccaagcccggcttttttttttttttttttttttgagacagtcttgctttgtcacccaggctggagtgcagtgctgcaatcttggctcactgcaacctccacctcctgggttcaagcgattctcctgcctcacccttccaagtagctgggattacaggtgcccgctaccagcccagctaatttttgtatttttagtagagacggagtttcaccatgttggccaggctggtctcgaactcctgacctcagatgatccacccgcctcagcctcccaaagtgctgggattacaggagtgagccaccgagcctggcctaatttttatatttttagtagagacgaggtttcaccgtgttggccaggctggtctcgaactctgtcaagccactgcgcccggcccattctttccttttagaggaagaaacccgctctggatggccggctggggaggtctggtcctgcccagttaatgctccaccctggatcacccaagcctgaggctttgacccagagctggggttcgctcgcagaaccccccagacacaccgacctgggtgaggtagcggatctgagctgacagctccgcctccacgtgttgcactgaagcggtgaaggccgccgcctgccggtctaggagccgctcgttagttttttccttggacaattctaggatcacagtacctgccagggcggagagagggcggggacacacggagactgccagtgtagcctctccctaggccagcccctctcagtcccgccctttcgctgcgcacgcacgtaggattccctccccaaccctgctccaagtcccaggtcaggctgccagtgcagcccggtcacgctttcgctccccgctgtccaggttgtcgcatcccgaacctgcattctgaaggatggcgccgatttcccgttcaatgtcttccagagcgcgtagtctctcgttcgccaggctgtaggtagccattatcactctgggaattctcaccaagagtttctcctcagaaacgcgacgcttgttccggaagtggctctcggtgwgcgcctgcgcagagggcaccgtgtagcgagcactacgattcccaggatgctcagcgcagcctcgcctcctcggtccgcttgatgaactacaactcccagggcccgctgcgcctcagccacaggaccacccgtagtcagaggcgacagtggaatatcccctagcccgaggccattcagacctgtccatcttcttgacactgtctgtggcctctagtttattctacacaagtttatttatttatgagacagtcttactctgtcgtccaggttggagtgcagtcgcaagatctccctccctgcaacctccacctcccaggttcaagcgattctcctgcttcagcttcccgggtgcctgggattataggcgcccgccaccacgcccggctgatttttttatttttagtagagacggggtttcaccatgttggccaggttggtctcgaactcgacctcaagcgatccaccctcttcggcctcccaaagtgctgggattacaggcgtgagctgaatcttaaaggtgaactacgtggatgagagcttgtagtggaaaagggagacggcataggcaacagcatggtgctgtgacgggaacagcgcatgtggagtccagcaagggattctgcctgcctggagtgaacggagcgtggtgggggttaggtatgacaatggtgaggctggagagaggagcggaatcaggaaaaggcttgcaagctatgtactttggacttgagtctgaagacatttgagcctttaaagggtttttaagaagtgtgttatgaccagaattaccttttttggaaagatcgtttgtaacagtttatagtagattatcaagaatgaaactagtttgcccaaggttagcacatgaaggttagactcagttaaactgaatggtctagcctggggaacatagtgagatactgtctttataaaaaaatttgggggctgggcatggtggctcactcctgtaatttcagctctttgggaggctgaggtgggaggatcacttgaactaaggacttcgagaccagcctgggcaatatagtgagaccccatctcctatatttaaaaaataaaggctgggtttggtggctcacacctgtaatcccagcactttgggaggccgaggcgggtggatcacctgaggtcaggagttcgagaccagcctgaccaacatggagaaaccccgtctctactaaaaatacagaattagctgggcatggtggcgcatgcctgtaatcccagctacccaggaggctaaggcaggagaatcacttgaacctgggaggcggagattgcggtgagctgagattgcgctgttgcactccagcctgggctacaagagtgaaactccatctctaataaataaataaattcaaataattttttaaaaagtataaattaaaaattaaaaaaaatagccagtcttggtggctgatgcctgtattcccagcttcttgggaggctgagataggaggatttcttgagcctgagaggtcgaggctgcagtgagccatggattgtgccactgcactccagcctgggtgacagaacgcgaccctgtctcaaaaaacaaaaaacttgatgggtccggcatttgacttaatccttccctaaatgctaataaaataacagaaagttgcttttttaaaaaaattttattttttgagacaaggtctcactctgctgcccaggctggaatgcagtggctcagtcatggctcactgcagccttaaactcccatgctcaagtgacctctcacttcagccttctgaagagtcaggaccatagatgtgtgctaccacatctggctaatttttaattttttttgtagagacagggtctcattgtgttgcctatgctggtcttgaactcctggactcaaaggatcctcctgccttggcctcccaaagtgccaggatttcaggtgtgagcgtactgtgcctggcctaaagttgttttaaaaaggagtcaaagggagaggagttaatagcaaaactttagacagatgctggaaaacagactcattttgcagtgaggtggtaactaagccagcagcaaagaaagcttacaagcaacctgatttaccatgaaattagtagcatcgcttacagctggggtgaaagtggtactaaaattaggaggattatttgaagttagacctccagatctctttattgactctatatatcttggcaaccgatctcccccaacccatcagaatactggagtttgtcggaaatggaaaacaggttttttagcttagagagcacctgagtacagttgagggcaagggtactgcgttgaaaacagagattaagccggccgcggtggctcacacttgtattcccagcactttgggaggcctaggcgggtggatcacctgaggtcagaagttcgagaccagcctgggcaacatggtgaaacccccgtctctactaaaaatacaaaaaatgagccgggcgtggtggcgggtgcctgtaatcccagctacttgggaggctgaggaggttgcagtgagccgaggttgtgccactgcactccagcctgggcaacagagtgagactcagtctccaaaaaagaaaaacagagattaagtgaaagtttagggccaggtgagttggctcatgcctgtaattctagcgcttttggaggccaaggcaggaggatcacttgagcccacgagttttagaccagcctgggcaacatagtgggaccctaactctacaaaaagtataaaaatagtcccagccacttggaggggcctgaggtgggaggattgcttgagcctgggagttgagactgcagggagtcctcatcacgcctctgctctccagcctgggtgacagagtgagaccctgtatccaagaaaaaacaaaaacaaaaacgaaagtttatatagtgagtggtagtttccagaactccagcacaaggcttatactttccaggtaagagactggaagactcttctctggggaatttggtaagtgagaaaagaccttaggatgtgaacgtcaggggttctccaaccagtcagttggccagatcacctcatactgaaactcacagttggcaagtcccaactgtgtacatggaaattctagtcaacttcttggcacctcactctttttttttttttttttagtttcttgagatagggcctctctgtgtcacccaggctagagtgcagtggcgcaatcataggtcattgtagtcctgaactcctgggctcaagtgatcttcctgtctcagcctcctgagtagctgggactgcagatgtgagccaccatgtcaagctaagcacccgctcttaaatgtgagcagaaagcaaaaatttctaggtatgtaaagaaactttctaacatgaaagacagaaaccaaaataaaaagggggaggtggggacaactgttgaagcttttaggtaagagatagtataaaacatgattgaatccgaaaaagcatccttggctgggcatggtggcttatgcctgcaatcccagcacttttggaggtcgaggcgggaggatcacttgaggtcaggagttcaaggccagggtcggtatagagcttttcattccagagtcaggctctcaaggtaattggcagagagcaatgccaacattttattgaaagtagatgttgttgctattgtttatgtgtccagtagggttggtcctgagggaatttaaatgatggtgctacatttcttgatcccttcctccacaaacattattttcagaagactagaaggtatcagtaacactgcaatttggagcaagactccatctcaaaaacaaaacaaacaaacaaacaaaacacccttgaaaaatcaaaccatgagggaagtaatgaaaaaaatctgtcacacaagccaggtgtggtggctcatgcctataatcccagcactttgggaggccgggactggcggatcacctgaggttgggagttggaaaccatcctggccaacatggtgaaaccccatctctactaaaaatacaaaaattagctgggcgtggtggcacgcatctgtagtcccagctactcaggaggctgagacaagagaatcgcttgaacatgggaggcggaggttgcagtgagctgagattgcaccattgcactccagcctgggcgacagagcgtgaccctctctcaaaacaaaaaaaacaaacaaaaacaaaaatcatgaagttgccaaataagcatgtttagagatagggaggtaaatgccaaaataaacatctaaaggtggtgaaagtaggccaggtgtagcctgagcaacgtgaggatactccatctctacaaaaaataaaaaaactggc

SEQ ID NO: 17751 - DNA, 27890 bp, Homo sapiens
  misc_feature (1)...(27890): n = A,T,C or G, or insertion/deletion polymorphism (see Tables 1-2)
ctgtaatcccagcactttgggaggccaaggtgggcggatcacgaggtgaagagatcgagaccaccctggccaatatggtgaaacatggtatctactaaaaatacaaaaattagctgggcgtagtggcgctcgcctgtagtccacctacttgggaggctgaggcaggagaatcgcttgaacccaggaggtgaaggttgccgagagccaagatggcaccactgcactccagcctggtgacagagcaagactccatctcaaaaaaaaaaaaagaaagtgagatagccttattactgatatggagaaagttttagtggtccggatagaagattaaaccatccacaacattcccttaaaccaagcctaatccagaacaaggctcgaactttcttcaaatctgttaagggtgagagagataaggaagctgcaggaagctagcagagttggctcatgaggtttaaggaaagtagccatctccataacataagagtgcaaggtgaagcagcaagtgctgatggagaagctgcagcaagttatccagaagatccagctaagatcactgaagaaggtggcaacactaaacaacggattttcattgtagtttaaagtcttatattggaggaagataccatctaggactttcatagctggagaggagaagtcaatacctgccttcaaaacttcaaaggaaggctggacgcagtggctcacacctgtaatcccagcactttgggaggctgaggcaggtggatcacaaggtcaagagttcgagatcagcctggccaacatggtgaaaccccatctctactaaaaatacaaaaattagccaggcatggtggcacatgcctgtagtcccagctgctcggggggctgaggcaggagaatcacttgaacctgggaggcggaggttgcagtcagccaaaatcgtgccactgcactccagcctgggtgacaaagcgagactctgtctcaaaaacaacacaaaaaaaaacttcagagggcaagctgactctcatgagaagctaatgcagctggtgactttaagctgaagccagtgcccatttatcattctgaaaagcctagggcccttgagaacttggctaaatctactctgcctgtgtctttacatggaacaacaaagcctggatgacacatctgcttacatcatgatttactaaatattttaaacccactgttcatacctactgctcacaaaaacattcctttcaaaaatgactgttcatggagaatgcacctggtcacccaagagctctgatggagatgtacagggagattaatgctgttttcgtgactgctaacacatcattcattctgcagcccaaggatcaggagtaattttgacctgtcactgtaattattttaaaaaacagggccgaggcaggtgtatcacctgaggtcaggagttagagaccagcctggccatcatggtgaaaccccgtctctactaaaaatacaaaacttagctgggcgtgatggcaggtgcctgtaatcccagctactggggaggctgaggcaggagaatcacttgaccccaggaggaggaggttgcagtgagccgagatcacaccattgcactccagcctgagcaacagagcaagactctgtctaaataaataaataaataaataaaaataaacaggggcccagacatggtggctcattcctgtaatcccagtgctttaggaggtcaaggcaggaggatcacttgagcccaggtattcaaaacaagctgaataacataataacatagtgcaacctcatctctctacaaaaaatttaaaaattagccaatgcagtggtgtgcacctgcagtcctagctactcacaaggctgagccaggaggcccactcgaaccaaggagctcagggttgcagtgagctatgatcacaccactgtactctagcctgggcaacagagactctggctctaaaatttaaaataataataataataaagtaacaaagaaacaaatacatttcataaggctatatagctgccatagatagatctgggcaaaatgaactgaaaaccttctagaaaggagtcaccatttagatgccattaagaaaattcatgattgaggccaggcactgtggctcatgcctgtaatcctagcactttgggaggctgaggcrggcggatcacctgaggtcaggagttcgagaccagcttggccaacatggtgaaaccccgtctttttttttcctgagacagagtctcactgagtggcccagtctggagtgtagtggcatgatctcagctcactgcaacttccactcccaggttaaagcaattctcctgcctcagcctcccaagtagctgggattacaggcacccaccaccacacccagctaatttttgtattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggcctgaaacccatctctactaaaaatacaaaaattagccaggcgtggtggcgggcacctgtaatcccaactactcgggaggctgaggcaggagaatcgcttgaacccaggaggtggaggttgcggtgagcagagattgtgccactgtactccagcctgggcaacaagagcaagactcagtctcagaaaaaagaaaaagaaaaaagaaaattcatgattcaatggaggaagccaaaatatcaacataacaggagtttggaagaagttgattccaacccttatggatgactacaaggggttcaagacttcttggaggaactaactgcagatgtagtagaaattgaaagagaactagaattagaagtggagcctgggacgggcacggtggctcacgcctgtaatcccagtactttgggaggccgaggagggcagattacctgaggtcaggagttcgagaccagcctgcccaacaagacaaaaccccatctctactaaaagtataaaaattagccaggcatggtggcgggtgcctgtaatcccagctactcaggaggctgaggcaggagaatcacttgaacctgggaggtagagattgcagtgagccaagatcatgattctatctcaaaaaaaaaaaacacacacagaaggtaaattgttctgcaaagagaggtaatgggaatgtgggagttggcttggctactggcacagacagcagggaatcgggagtttgaaagaagatttacatttggcatacacgtgtgcccacgtggcctttcctactgcaaagggtgctgacaaaatcaagcccctgatccttcctgtggcatacataagaacaaaatggtagttgttagggacaaatcaaaatttaaaaataaaatggccaggtgcagtggctcacccctgtaatcccagcactttgggagggaggccaaggccagcggatcacttgagcccaagagtttgagaccagcttgggcaacatggcaaaaccccatctctacaaaaaatacaaaaattagtcgggcatgttggcacgggcctgtagtcccagctactggggaggctgaggcagtataatcaatcacctgaacctgggagatcaaggctgcagtgagccgtgatggcgcctttgcactccagtctgggtgacagagtgagaccctgtctaaaaacaaaacaaaacaaaaggctgctagtcagtttgggctactataacaaaacactggccaggcgcggtggctcacgcctgtaatctcagaactttgggaggccaaggggggcgggaatyacctgaggtcaggagttcgagaccagcctggccaacatggtaaaaccccatctctaccaaaaatacaaaaattagccaggcatggtggtgcgtgcctgtaatcccagctactcaggagactgagacaggagaatcgcttgaacctaggatgtggagattgcagtgagccaaggtagcgccattgcactcccgtctaggcaacagagcaagactctatctcaaaaaaaaaaaaaattaaaggcttagttctccatgttgaaagtaagggaagagacttctccaccctctcttttcttagaaaatttgctttagaaaacttgtaaaattttttttttttttttgagacaaagtctcactcttgttgcccaggctggagtacagtggcacaatctcagctcaccgcaacctccgcctcccgggttcaagcaattctcctgcctcagcctcccaagtaggtgggattacaggcatcctctaccacgcctggctaattttttgtatttttagtagagatggggtttccccatgttggccagactggtctcaaactcctgacctcaggtgatccacccacctcagcctcccaaagtgcggggattacaggcgtgagccaccgcacccagccagaaaacttgtaagttattttctgtgtcttcaaaacgtgtataaatatttttagaagccacacagcctcttgccagctttactacccagggatgtctttcacaaagacccaggagccatctccttgaaatgtaaacaccaagaaagatggagccttcatttcccagtttctgtgggagggtaggactaacttaaatggacactttgcttgagctgcaaaactatctgctgtcataaaaatctgaaaagctggctgggcatggtggctcacgcctgtaatcccagcactttgggaagccgaggtgggtggatcatctgaggtcaggagtttaagaccagcctggccaacatggcaaaacctcgtctctactaaaaatacaaaaactagccaggcttggtggtgcacacctgtaatcccagctactcaggaagctgaggcaagagaatcgcttgaacctgggaggtggaggttgcagtgagccgagatcacgccactgcactctagcctgggcaacagagcaagactctatctcaaaaaaaaaagagaagtttttcttctgattaagccagttagctaacatagatggtcatcacaattgccaggtgtctctagactgcactatatgtgacaaatggtgctatcgagtcctcctaaagattatttatagtttatcttgagaacacatatgtaatgggctgtatctgcttggctagataaaagtgagacttccttctgtctttgcagtctcttagcaaactgcctgtgatgtgctcacattctggtttaatgcttattcaataataaaactgttttctttcttcactactttcgtggagaggttttttctgggttgggagaaaattttgcttctaattatattctcccaacatagcgcatgtgcttaaaagggaaacaaaagcaggagggggaagggtctagagtgataagagctctagtgagaggctaggcctagagagggacatggagaaatagcatgcggagaggaacggtagaggagcaacgctaacattcagttgtaaataatacaatcatagcagctaatacatagagggactacacgccaagcactgttctcactgtttagccatattcactcatttagcatgcgcagtagcttgaatccggtttttcaattattcattccctctctctgcacgtggccgtagagtacactagagtgggcagaaaataagtcacaaaacagcaaagaaacagtgcttttggaagtaggtatgagacaaactcttttctaggcaaaagtaacccacgaaaatgtgtgtggaaaggccagatcctactattaggcaggatgggaatttgagccattttatttggatattacagaatggggtgaccccagaaaactggaagaactggggaccagcaaatggccgacctgcagtcctgagcagaggatgtaggccagagtggacctagaagataagaaagggaattgaatccagtaagggacagacactttatttttttatttttatttatttatttatttatttttgagatagagtctgatctggaggctggaaggcggggctaaaactcccactcacttacctcyaccaacaactaggccaccaagtcatttctgaggactggctcaagaaagcagatttaacttacactggcctagcccaggccaccagatgcatccacggagatccaaatgcatataatcacttgaatcaagatctagacagggacgcgtgcagcaggcttcatctgactgattcctgacacgggagagaaagcctaagctccgaatcatccttcaatgtttacaaaggccctaaatagcagtgggctaattgctgttcctggatttccaggagacctgagacccatgaaggagcaggaaagagcttggggataaaaaattaatctggaacctactggagcggaaggggctgcactcacctggaaaagacaaagttcttgggaactggccacgtaggccaggtccctaagcaattccatcccgcaccctaacaccccgactggtgttcctgggtccctaacattgtctgtacccgcttcggaggttggacaaaatgagtttttcactgccctgcctcaggcctctctcaaaggtctggcccatgatatttggtgtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccrcgggacatccccagaccccagcacggcctcccaggccgaccttccagaagccggcccactgccttccccgggtcccagcccagaaaagcggagaccttcccctccgtttggaagatggactcatcccctacttcctcctggctccmcagaagacctggagacctcgggaagtgttctcatctatgttcgctccaacccgggggctcagrcccacctcgatyccgccttcccgggaggtccaggaaggtcccgccgcacccaccccgttggcctcaccctggctcgggcccctttatcatcctgcagctacgctccgaccaggargcacagccagtccccacagccggctctaccgctctgctcgcaggtttgggctagtctggggcggggacttgggagcgcctaaaacttgcgaggagggcggggccgcagaccggtcctttaaaggttggaagtggccccgaggcgccggcagccctgggcggtcccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccsgcgcggggcgaggtcagcgcggggagcgaggggagctagggcagcggggaccccgggcccaggcccgggycgagctgggctcgcggcgggagggcgggaggctgggggcgaggtgacagcgcgacctcgcggactgggacttccacgaagctgggacgaggtgggcaagatyagggacagggtccgcagctgggatcccgggctgggctcaaccccatctccctttcccgcccctggtcccggcagcccccagctccttctcccagtgacccagagccaatgtaagtatgaggccagaggtcagacgtgaagctcctccaagaaccggcgcggggagagctcagttaatgggacccacgtgggcgatgctgctccagcatcagctccaggcgctgcgggccctcgtcctccacccgactccgggcgtctgagacccaaagagcaggttgtgcgggggcgggaacgaggcgatgctgtctttggaggccctgagaaactgaggttgcacaggagcgcrgctctgtcctcgaaacggcctcagtygggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccggtgagcaggcggcgtyggggaaggaggcacaaggtcycgggaactgctgcggggctaggagggcagagttaaggacggtcggagcagacttagaggakgtatgggcccagggcaggtgaaatgtagggatcccagggtgctggacagaaaacgggaaggagttatgaattcccaaagttttacacaggctaagagaggctgcgtgtgaggctggaggcagggagtaagtgatctggagatcccatcttccaagaaggcaaagacagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcasacagctaagggaagaaaacataggatgctggagagctggtttggttggaataacacggaagacacccgtgaaagacaagaagcacactggcccgcaggagaygaggaggaatgaggatggcaaatagtgaatttttttttttttttttttgagatggagtcttgctytgttgcccaggctggagtgcagtggygcsatcttggctcactgcaacctccacctcctgggttcacgccattctcctgcctcagcctcccgagtagctgggactacaggcaccccccaccacacccggctaattttttatattttttttagtagagatggagtttcaccgtattagccaggatggtctcgatctcctgacctcgtgatcygccctccttggcctctcaaagtgctgggattacaggcttgagccaccacgcccggcccaaatagtgaatttttaaccatgggtaatgagtaaaagagagatgaatccagagatgagtgagggcagtagggatggaacatcaaatctatgactttgagacaggtgagtgtaaatgcagaaaagacccagaataagtccatagatacagattatgatagtaaatccagaaagatgaggtttaaaaaaaaaaaagcaaatgtagaatcttttgaggacaggtgaaggcgtggcaggtgaggtttaagatgtgaaattaatcaaagcaatctgtagtagacagtaggtgtaggtgtataggtgactaagatttcatcaccttaattaaggtgatttttttccaaccatagatattgatgaagtaaggccaggtaggggaagatgagtgaaggagcaagaaatggtggcaaacaggaggtttttatctacaggcaaaggatgagggctgaaataagagaaagcaggagtgcaaagttggcaaagatgggataaacrtgtctggtggataatcaaatgaggcaaagccagagataaaagcaacagtgcatggctgaaaacatggaatacggctaaccacagggagatgaggacaagaggcgggcataggaccagacagagccgtgaggccaattgtcttgatgtctccccagcccgcctgccaggagacaatgctttggacatgttccagaagcatcgagagaaggaactgaaagacagacagcagatctactggtgaccacccaccccttaaactaaccccgccaccactgtcccaccccttccctgcccctgcccctgcccctggccccatcactgaccatgacatccttcctgaagctttgtccccaactcctagctgggccacctggaaggaagggttacccctgaccatcgctgcagaccgtaaggatgatctacctccaaatatgagattccatgaggagaagaggctggactttgaatggacactgaaggcagggtgagaaaaaggctagacctcgragtgaaataagggctgggagggccaagaatgatgatagacggtgagggactgagggatcagctgatgagttaagcctcaatacctgtcctagggctctggagatggccctcaaacrtgtttacaccctcctgagctcctggaactgcctagaagactttgatcagatcttctggggccagaagagtgccctggctggtcagtggttccccgaggtctccataatcccttaatggcccstctggatgactcatcacactccacagtcccccgtaactcttygcaagaagagaccttatcatatctggtcaactcagagaggccttgagaatgaaaacgcagaagctgggttcagggagggttatatacctgaacccctggggtagattttggagaagggatatgcaggctgtggtacatatatcctcctttcaccrcccaccaaagagaaggttcgccagtgctggcaggatgatgagttgttcagctaccagttcctcaatggtgccaaccccatgctgttgagacgctcgacctctctgccctccaggctagtgctgccctcrgggatggaagagcttcrggctcaactggagaaagaacttcaggtacctctccttcccctgcctggcactgttctctccttagtagtgtggtgagaacggacagagagaatccaaactgagtcagaggaaggctgcagtactgcrttgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgaggaagtgccatcaggtggggagaatcggggaggctttctagaaaaagagagcggggtttggaagcaatggactgtactgaggacaagcctaggcaaaatgtgtgcgtatgcatgtgtgtgctgtatgcggtggcaggggtagtaggggaagctctctggaatatttggcagaggaygtgagatttgaatagggaatgaaagagcatttgctgagctgataggagccaaaaccagagcgcagaccattcgggaatgatcagaaaggggcctggccatttgacaggtggtcagtttacaatgcctgtgatgccaactggattgagcaggcctggttccaaacccagatctgccaccacatccacacacaagacatctaccctcaccagactgtttcttcactttaagatgagaggaactggaccaggggctctagttctcccaacaggrctccggtactgatgcaggagaatggcaagaagctagactaaatctcttgccctttgccccggccccctgggggtagactttgaactctaaaaatggatacatccctcctgtccccagaatggttccctgtttgaagctgacttcatccttctggatggaattccagccaacgtgatccgaggagagaagcaatacctggctgcccccctcgttatgctgaagatggagcccaatgggaagctgcagcccatggtcatccaggtaagggccccagacctctcccacaacgttgcactctgttcacctcaacctctgctcccagggacccaacccccagctcttggctcccaaaccccatcctcactcagtgagacttgtcttcatgtcactatttgcctgtaccctcrtctcccctgcctcatccaactagaattactttttcaagagtcaaaatggcctcytggagttctcatcctgtatccaatggtcctcacacttcagtgtgcatcagaatcacctgaatgcctgttgaaatgcagatttctggatcccatgaccagactttctgattcagtatgtctggggtgggaactaagagtttgcgtttttataagttccaaagtgatgctgacactaccagttcaggactacactttcagaatcactatctcatctctcagtggcctctggctctgaaccctcgccatctcttgaatatcttttctygcaatttcttttttttttttgagacagaatctcactgtgtcactcaggctggaatacagttgtgtgatcttggctcactgcaacctgcgcctcctgggttcaagcaattctcccacctcagtccctccagtagctgggaccacaggcatgtgccaccatgtgggcctggctaatttttgtattttttgtagagatggggtttcgccatattgcccaggctggtcttgaacttctgggctcaagtaatctgcctgcctcggcctcccaaagtgctgggattacrgstgtgagccactgcacctggccttctctcactattcttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatatacggaatgggagttcaataatttctctttctcccagattcagcctcccarccccagctctccaaccccaacactgttcctgccctcagaccccccacttgcctggctcctggcaaagtcctgggtccgaaattcagatttccaactgcacgagatccagtatcacttgctgaacackcacctggtggctgaggtcatcgctgtcgccaccatgcggtgcctcccaggactgcaccccatcttcaaggtacttattaatctattaaatcacatatccctcagaccccagagagaggaacagccccatatcaaaagataytgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctcacagtagggcttgaacactgctagtaaaamaaaagccatattcctaccttagatctagtatttagccaraaaaacaagtgatgcccataagaaccaaccagagaacagtatctggtactagagtttgaaatcacaagggacagcctataacagtatagtattgatgaagaatgtttctacccaattgaggagtcagctaagtagaaacagaccaaaaggcaaggaagaacagccagcaagccgctcatacctgcccaacagyaaggtggatagagatgtaygttagcatggtaatgacaggaatgaaaaggaaagaatctaaaacgtagtgaagggaggaaatggtagctgcagcgtgcctgggtgcaagagagagaaaagccagaagtccaagcttctgccacacctgtaagtccctggggcaggtgtgttatactgacctagaaatactgtggttttaagagctgggtgtggtggttcacgcctgtaatcccagtgctttgggtggccaaagcagtatgattgcttaagaccaggagttcaagaccagcctgggcaacacagcaagtcccggtctctaaataaaaagaaagaaagaaagaaatactgtaattttataaaacagtgagttccatatatattgctgggagaaggcaaaataagacctgtgcttgcttaagaaaatgttcttaaaatcttgatgatactttatatacagggaacttggcagagggagcacaaaaatgatacaagcttacaaaccagagtaattgtcagaaacagtaaagttagaagaaaccagagtcagcaaaaatgaggtgtttggttttaggtacatggagtttgatgtattggcaagatatgcaagtatgtcctgggtaaaaacaaccaaattgtgtttcagctgggggcctccaccaagaccccccaagcctggccagtatagctgtgccgcctctggaattttccccttcggtaacatagacaagatggagaccagtctgatgaatggaatcttggatttcattcatctcatgctgtctcctgcttccccatcctctgctccacacgaacaagtgmagcctctattcacacttacaattccktttcctagttcagtcctctccgtgtctccactcaccacagtaatgccatgccccagcggacagctgagttgctggcagatgcacacaagggtcaagcctgcasatgtcttaacagtggcctatgcaggctctgactttggattgctggggtcttagtcctgaaccccggcctcaataatttccagatgtcctcacatgttccatcgtgaggttattaaaggttaaaatgacttaatggtgtgacacaagctaaatgctacaaaaaacattagttcttgcaaatttttttttttcagagacaagttctcactctgtcacccaggctggagtccagtggcgtaatcataactcactgcagcttcaaactcctgggctgaagcgatcctctaacctcagccttcagagtagctgggactacaggtgtgcaccaccatgcctggctaattttttttattttttgtagagacagggtttcrctatgtggcccaagctagtctcaaattcctgggctcaagcgatcctcctgcctcagyctcccaagtaacctggattgcaggcacatgccgccacacccagctagttcttgcaattattattattarggactgtttatccttaggcatcctttctcctcatgtggactttggcctttccgtgacatttggcatctttcatgaatcttctgaaaagcttcaggttaatgtgagctgctttggtatcttaacaccaaaggtgtcattggggtcattgccagtgtccagcatcaacaattcagacaagcaccaaaactgcttgaaacctgcatgttaactatgtggaaaggaagacaaacagtctaagataaaaagaaacgcatgtaaggaccatgcctttttttaatagctaaggaaaatattttaatatttttaatttaataaattttaattttaaataaataattaaaatttaaataaatttaaatttaaaatttaaatttaattttaaataaacatttaaatttttaattttaatattaaattaatttaatttaatattaatttaacttaatttaatttaatattaatttaacttaatttaattaatttaatattaaattaaattttaatatttttaattttaatattaatttaatttaatttaatttaatatttttaatttaatttaatttaatttaatttaattaaattaattaatttaattttaattttgcttcaatattaaattaaattttaatatttttattttaatattaaattaaaattttaatttaaaattaaatatttaatattaaattaatttaaatttaatattaaattttaatagctaaggaaaatattttaatattaaaaaaagaccatggccttttttcaatagctaaggaaaagcaggagaagaggggcccaacagtgcttaagtaggggtggagaaagatttgcttaaacaggtagctgaatatagctcttctagttctgacagaaagtattctccccatccatcccctaaagaaacccccaactgtgaaacaactaaaagatggagatgcagctttgatcataagcagagaggctagtttaagaggatgtgaatgacagaggaggtagcaaagaaaatcagaaagggctgattcataaggcacctatactcaaggtagaaacaatgaagcagacagctactattccaggactcttatgtgtaatagacactctccaacatcacttaggtgagcatcaccacagcccctgagataagagagtctattgctgccccctgttgacaaatgaagagattgcagattaaaaggttattaacttggccaagtctcaaatgaggagtaaagtgtaggttaaaatcctggtcagtctggctccagggcccaactcacagggaagttggagagcacaagagtgagtgatcagaacagcaggagatcagcctgtaaaggaaagcatcaagaggagaaggcgccatgctgggtgccaggccctaccaggaaggacccaagcatggcctccaccagtcacgccctccaatctcctcctctccagttcctgatcccccatatccgctacaccatggaaatcaacacccgggcccggacccaactcatctcagatggaggaatttttgataaggtgaggagggtacggggcatgggactgcctcatccatcyctccatgatctgccactttcaggatccaagatcaactatgtgtgaatgtcctcactcttaacctatgaacctgtcccttttatacccatgtctttttttttttttttttttttttttgagacagagtctagctctgtcgcccaggttggagtgcagtggcgccatctcggctcactgccatctccgcctcctgggttcaagcgattctcctgcctcagcctcccgagtagctgggattacaggcgcccgccaccatgcccagctaatttttatatttttagtagagatggggtttcactgtgttggccagactggtctcgaactcctgacctcatgatccacccacctcagcctcccaaagtgctgtatacccatgtcttaatatctgaaaatcccacatttgccccactttatggaagatgtgttggttctccagccctgtttccccctctaagacctgtgatctcctgtcccaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtgagtaaggaggagctgagaaatggtggggysgggggsgggggggctctggcctgaggccagcatggggcaaaagcaagaaggtccagaaaggagaagcagagaactcaatcctggggagagatgaggaaaagtgaggacacagtgggtggctctgaaaatgaggagactgggatgaggcagagagaggaggtgaggggagctgtggggggagactgggggaggtgtctggaaaaatcaggattttctgacgatgtatgacagcaaccatgcgaattcctagaactaaggacccacatcttccatgagatgctagtgtgtttagagggctgaggatgtcccaaaggcgaggtgtcttcccagatactgtggaagcattgggcagatgccacagaaagaggaatagaggtcagaggcgggggctttctgccctcaagtgccttttccccctgggcaggtatgtggaggggatcgtccacctcttctaccaragggatgacatagtgaagggggaccctgagctgcaggcctggtgtcgggagatcacggaggtggggctgtgccaggcccaggaccgaggtaagatccattctagagacagaagaagctcctgggagactctsccagggcgccttcccagccctgcccttctggggacaggaccccagcctctcatcacgcctcccttcctccctccacacgggaaagcatgtgtatcccattcccacctcctccgactcaggacaattctagagacccaagractgtcctcctcagagaccctggccatcaacccctagtcccactacaccccagtcacagatgcccctgaactgccatatcctggggccccccaggccatatccacagctgggaggggtctgcacagtccctgctgggctcatattctctcctgatggttccgttttcctaactgaggatgtaaatgggaagattttccctccgaagcccacaaggacccaccctggctttccctccctctcttcctgcctgccactgtgcagcacgcacagagggtccaggaataccgcacgcttgctacagtgcaaggtcagctcttgatgcaagctcaatcctatacatgctttgcctcaaacccaaactcagcaccctgatccttggggctcaggtttctttggctaatccaactcttccaccctaaccaccccttggccaaaatctagccactacctttagtcaactctcactccccacatttgaacctctgaggaagaaaaagcctttgctgagctcttaggtttaatcacacaggcaccagcctggactgctgtcactcatccttcggcccctccccctcacacttcagatctaggctgtgaataccatcctctgcctctgtgagacaactacagacatttactggggagcccttatggcgaatcctgggaatgtggcaaacctccttaccctggagggagcctctccctggggaatctgcaccaccctacccttccaggaccaaactctctctagttcttctcagtacagtcccttaggctcctagcagtttgggctactacaacaaaacactagctgggcacagtggctcacgcttgtaatcccagcactttgggaggctgaggtgggtggatcacgagstcaggagttcgagaccagcctggccaacatagtgaaacccgtctctactaaaaatacaaaaattagccaggcgtcgtggcacgcacctgtaatcccagctactcgggaggctgaggcaggagaatcgcttgaacttgggaggcggaggttgcagtgagctgagatcacgccattgcactccagcctgggcaacagagcgaaactccgtctcaaaaaaataaaataaaaaaaaccacacaccatagactgggtggcttataaacaacagaaatgtattcctcacagttctggaggctgaaagttcaagatcaggttctggtgagacccctcttccaggctgcccacagccgatttctccctgtatcctcacacagcagaaagatagcaagctagcactctgtcctctgctcataaaggtatcaaacccattcaggagggctgcaccctcacaccctaattatcatgtggggctccacctccaaataccatcacaataggattagatttcaatataaaaatttttcggagccaaagacattcagttcatgacacatgttaactttaacctccactaaccaccctcccccctgttctctttcagttctcatagctcacttttgtctagttttcccagcagacattttagaggctaaaattaaaaatgccatgggattagcagtcaggaacctgagttcaagatcagcctctgccttttcccaactatgcagtcctgacagtttattctctatgggctttgattttcttacctataaaatgagagtaattatatttattccacttaactgataagattattgggtctcccagcactttaggaggccaaggtgggcagatcacctgaggccaggagttccagaccagcctagccaacacggtgaaactccatctctactaaaaatacaaaaattagctgggcatggtggtgggagcctgtaatcccagctacttgggaggctgaggcaggagaatcacttgaacctgagaggcggaggttacagtgagccgagattgtgccactgcactccagcctgggcaacagagcaagactccgtctcaaaaaaaaaaaaaagattatcgggtctctgagcccccatatccactgcaaaatgagtggactgagataacctttgtgggagcccctctcagctgtgacactggaaatccatgacttattccccacattataacgcagacacttgtaattctgtcygggaataggattacgcattcctaaattatttatttattttttaatttttaaatagagacaggctcttgctctgtcacctgactaccagcaatcctcctgccttggcctcccaaagtgctgggattacaggcatgagtcaccgaccacgcatccctcaattggtttttttttttttttgagacagactctcgttgtgtcgcccaggctggagtgcagtggcgggatctcagctcgctgcaagctctgcctcccgggttcacgccattctcctgcctcagcctcccgagtacctgggactacaggtgcccgccaccacacctggctaacttttcgtatttttagtagagasggggtttcaccgtgttagccaggatggtctcgatctcctgacctcgtgatccgcccatcttggcctccccaagtgctgggactacaggcgtgagccaccgcgcccggccgcatccctcaattcttaaccactttttgaggcaagggatatttggtcactcagaacttttcagcccccaatccttccataacaataattattacttacttattgagcatttattacagaccaggtgattttgatacatcatctcatttataatgtaggtatcgtccatattttacaggtgaaaaaaactgaggttcaaataggttaagctggcctatggtaactaagtgtaagtgactgagccaggacttaaacgcatgtctgatgcaaatacgtctaaataaaataaacaaattcatcaattctaaaatatgggcatcccaaaacaacagcctttgttcctctcctcttatgctgtagcttctaactgctattcctttcctgcccaggtttccctgtctccttccagtcccagagtcaactctgccatttcctcaccatgtgcgtcttcacgtgcactgcccagcatgccgccatcaaccagggccaggtatggacagctgaaagcccaggtccctgaaggcaaggtgacctgagggagagatgggagttcaaaccctaagtaccagggttctagggttacagtttcttcctccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatytgagtcgccgccagccagacatggtgagaggggactctcgggagagggaaatgacagttggaaaggaaacatcagagtgaggggctgggctctaggtgcgtttgtctttagaaactgactgatcctttgttctgtctcaggtgcctctggggcaccacaaagaaaaatatttctcaggccccaagcccaaagctgtgctaaaccaattccgaacagatttggaaaagctrgaaaaggagattacagcccggaatgagcaacttgactggccctatgaatatctgaagcccagctgyatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaatgttacatcacaaagtagtcttcttttggtttattcaaccatttaaaatgcaaaaaaaatccacaaacaaatgtgctttgtttgagacatgcacagccaggctacagactggatttggcccttgaaccctgcactagcctgaggccctgaccctacttccaaaacatccaagatcatggagcagggggatttcttagaaaaatcagcttacctcagctaactctccattcccaggaactaaccttcatgcctggtggccaatgtacaaattcctgactcagttctttggcaaattccttccacccatatttctcctattcacccatgtaccccaaaagtccctgaataagaatcatgtttttggggcagaatacaaaccactgccccaaaatggcttctttctccaaacagtcccagatgaaaggcacataattcatgtcttaaggctacttttccagcccctttaatactctgggatctatgtgtttcccacattccaagttatctttcacaagccttttaagaacaacatgcacaaaataaatggacaagaactacaaagttattctagccaatgatagtgtttatttgttaggtcctggggtctcaaggtcaaatgatccctctcaattattctgaggtcactgtcctcactagagtgggtacaacttgctcactgcaaaactgtgttcttcaaacatccctacttcttttcttttctttttttttttttttttagaagtagtctctatcgcccaggcgggaatgcagtggcgccatctcagctcactgcaaccttcgcctcccgggttcaagggattatcccgcctcaccatcccgagtggctgggatcacaagctcatgccaccacatccagctaatttttgtaatttttagtagagacagggtttcgccatgttgacctggctggtctcgaactcccgacctcaggtgatccgcccgcctcgacattcctatttctaaataattattacagatctgtcactcaccagttaaacatacaaacggcttttttggaggggatgacctatttatatttttaaatcttatatcctaccttattcaaaagtcctatcagttttcctagtttagagaagcaaagtgacatttttgtgtacatttaacaggactgcttaccttcacaacctgctcagtcggctttccctggacttctcctaaccgcccatttttcctggatttggcaccgagagttacagtatttcacgtgcgatgataaaatgttacttaggagaaacagttccaataccaagaaacttcagcaattttaaagcattttaaagccacaaaaccatgcccgatccccaaaagggggtcctaactcctttacactgtcagaatctcaattttaaaagggaggagtagagaagagatagaaacgctctctgttggtgaaaatctgtcttacttaccatttccccaacacaggagagactaaggaatttcaggtaaaaatcagatggctccaatcctccgatactaagagcccatcgccccagttcccaggagttccgccagttagactttttcccccatggcctcgctaaggctagttcctcgtcacgtgacgtgacaggcttggtcacgtgacataccagctccttccattcccgtgtgcggggggagggggaccaacaaaccggaggccctcgctcttccaatactcacgccctagctacagaggtcaaggaaggtttccccaggagcagttttggtttcagacggcgccgtctcccgcgaaagtcctgagaggagcccagccttttccgcctgccgcccccggatgggatggttgaggccggggccacgccccctctgcccccctgcgagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttggtgaggggactccccggcaaggatcggagagggcctgaggggctccgggctgggagggctgggaggcgaggaaactctgggccgcaggcaggccggaggggccggggatctacaggccccggagaaggagacagactgaaattgaaaaatgggaactgttcgagaccagcctgaccaacatggtgaaaccccgtctccaataaaaatacaaaaattagccgggcgtggtggcgcccgcctgtaatcccagctactcaggaggctgaggcaggagaatcgcttgaatccgggaggcggagggtgcagtgagccgagatcgcgccactgcactccagcctgggtgacagagcgagactccgtccccaaagaaaaagaaaaaagggaactggagcggagggccctggagtgggaggagccagggctggtaaaggtggagacccctcaaggtaggagaaacaagagcggggttcctgagaggtgcttgagttgaatggaggacatgggaggaaaagagagtgcttgttccagaaatgtgtagctgggccttgttttcccagtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccaggtggctgagtccgaatccagtaaccaccacctcgttttggttaatctcaggctcgggtgttgtagcaacattggaaatgggaggggtttacgaagtgaacatgaggtcaggtgcctgaattcaacagtctacccattccccttttccagataatgctcggaatatttttcaatgtccattccgctgtgttgattgaggacgttcccttcacggagaaagattttgagtaagtattcgggtgggggaggcgggctgggagcaggtgggaggtggcgaggcctagggtcagaattacgtctgggaggcccggtgcttagggcccctaggttagaggacttggagaggagagcggctttcttgagaatgtggttaggagccagggagtcagacctcagcggccatcccaaacccaccaccttaggtgtgacctctttaggtattttacttttctgtgcttctcagtccacctctgcaaaatggctatgacagatctcaccccataggatggtcaagaagattgaataaagtaatacacgtaacagcgcctaaacaggtgtcgggcacatagtgctcagaaaatgttggctcctattaaagtttgacccctttgcttcattcccacccccaggaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgygggactgggtttcccgggcgagagactgaatcccttctcccatctctggcatccggcccccgtggagagggctgaggctggggggctgttccgtytctccacccttcgctgtgtcccgtatctcaataaagagaatctgctctcttcagccctgtgtctgtgcttgagtgggggcgagcacggggctgagactagaggtcggcctctgcctggaaagtcccgatctctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggttcgacctccctcgcggacagcgctccctggcggccacgggagggcgggccccccacttggctcgcggctcttccgccccgggcggggggcgggcgggagccgagcctggggtggggctaggggctccgggcgggacggggagggcgggcgccggccccccgtgacgctgccccgcccccaggtcggagagatcttctcggcggccggcgccgccttcacgaagctcggggagctgacgatgcagctgcatcccgtggccgactcttctcctgcggggtacgtgagcccggactgggacgtggacgctgagagcgggcgcttggactcggtcacagacacggaccctctctagcacagggacagacattagtttccctttgtgcstggcacagcacagagtcggtgttaataaatgatcgttgggtgagggaatgaatgacagataaaaatacagacaggcccatagcccagactcctgtttcacagttctccctgctgcgaacgggtcgaccacaaaccaccgccactcccaaccaccccagttcatggaattcccccagacggctgcaggctgtgttggtgggtctgttttgaaaagcccttcctggcgagttggtttcagtgtgctgtgtacagcagccgtttaacgttgatggtggaaaggggtgtctaaggtggaggtggttgtgatttcttgtgattggggtcctcccggttcccgcagggcctcaagagctttccgcctccccttacggaggacctctttatgcatccgtggaaggggtcccagaaatcggaaggaggcggctggttggctgtgggatgcatagcctgtgggcgggctccacaccccccctcccatttttgctatcccccctctccccttctgacagygcgaagtggacggagacggaaatagagatgctgagggctgctgtgaagcgatttggggacgatcttaatcacatcagctgtgtcatcaaggaacggacagtgtgagggagggtggctgccaraaaagggcgggtgggcmgccttcttcctccttacccaaggttccatcgtcctcagaactcctttccagctcagctgcttccctactttgtcactagttttttagaatccccttgaggactgaaagaatagaattgtcacagttggtcagaagttcctaaaatgytgtggtaatccttccaagaatgtgaatttaggttgcctgagatgctgttattgtatttgatgatggaagtcccctggttatttatataaatgtttgaggaccccactgcagtgtttccagggatatggtgaccctgaactagttgatcagtaaatctcaatccacctgtaaatcaccaagctctacctgatgtctctcccagaagagaattaggagatgggcctttcccactactcagttcagggactccactctccacactccatccatcctgagtgagtgtaaaacttcgagaaagtgagaaccctaccaatgggttggggccccgacctggattcttatgaagggactcccagaaccccttcccctcccgtcccctcttctgttagtctctctgatgactcctttcctaacctcttctctcttttcttcagggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtccccccataaagaaacagaaggctggtgagggctgtggagttgctgcctaggggttaaaggtcccatctgaggtttagtgagy

SEQ ID NO: 17752 - DNA, 40185 bp, Homo sapiens
  misc_feature (1)...(40185): n = A,T,C or G, or insertion/deletion polymorphism (see Tables 1-2)
cacactggctgatggtacagaggaggagaagggaggaggagggagaaagaagtcaggcgtgttcccatttgagcagctctcccctgcgggggctgacactctcggaggtgctcctgagcaccccagagccccgggcttgggctctcctcaacccggctcacctggggtgtgggtggcggtaggggtggtgtgccaagatgacgtgctcatctcaggacgacgtcagcttctgttgtgcagctgagaggtcttatgcctcacaaagatgctctggaatttccactgcttaagaaatgcaactttttaatcataagaaatgatatatggtgattgttgaaaatttgcaagatatgccaaggatatggaaaaataatctttaattttgccagccagaaataactattattaaaattgtttaggccaggcgcgatggctcacacctgcaatcccagcactttgggagccccagccgggcggatcacctgaggtcaggagtttgagaccagcctggctaacatggcaaaaccccgtctctactaaaaatacaaaaattagctgggcatggtggcacatgcctgtagtcccagctacttgggagactgaggcaggagaatcccttgaacccggaaggcagaggttgcaataagccagtagaaattaggagcttctgcttcttgttataaagcacttaagggttgcttaattttgtattagcaaattagatatttagaggacttgaagaaaatatataaaataatttttttttgagacggaatttcgctcttgtcacctacgttggagtgcagtggcctaagggatttgtcactcaattttttgctcagatatgcctttacgcatagtattaagcattttatttattcatatatatttttaatagagactgtgtgttgctgtgttgcccaggctggtctcagactctgaacacaagtgatcctcctgtgttggccttccaaagtgttagaattacaggtgtgagccaccgcgcctggttaacgaagcattttagaggcaaattgtgccacttctactatctggttttggtttaactctggggtcctgtttaactctattttttttcactgtggtctttttttttttctcttaagtttgcttcttagaaaatttcacacagcctgttttctgtaatatagtacagtttatcatttaatataaaatttcttctagacaaacaccagaagttgaaaagacaaaaagtatgaaataaatcctcaaaatagagtagttaggaaaaagaattataaatctggggcttttaaaatagttttttttccatctcagtcagaaactttaaagcagtcactttatcttccctgactcagtttctccacaagtgaaaagacataatagtccacagtgactagttaggatcctttatagtcaactgtgaatggctggaaacgtggacagctaatatgattccactattgtatgggagaggcatcatgtgaattagtgggaatcacctttattagtgaagaaaaaaatcacttgatgatttgtaggaatccggggagaatgctgagaatttgtggctgaaacttctcttaggaaaagagagagattgagtgagagcgagagcgagacagagagagagagagagagagaaagcgagaggcacatgctagaacaaagctcctttcatttgttcctgggagtggctgggtgtgtcaaatcatccctcagcctcgatgctgagtaatcaagtataatatttgcaaagcttcaacctataggtaagaaaaagcaccaacaaaacagtctcctaggttattaaatatttagtccaatgattacttgtgttgaactagaggaagttattgcttcatacaattgtataatgaatgaatgaataattcattctttgagctatgtatctcccctccaaaaaatctactcttttaaatatatagtcaataaaatggtttttgtggcaaataaagagaggggaaaacattatggattatttttgaaattatagagcaaatgctttttcctacaaacaggtgtattctttgtcactaaatttttttaaataaatcatttatttggttgggtgcggtggcttacgcctgtaatcccagcactttgggagtctgaggcaggtgggtcacaaggtcaggagatcaagatcatcctggctaacaaggtgaaaccccgtctctactaaaaaataaaataaaaaaaaaattagctgggcatggtggcgggcgcctgtagtcccagctacttgggaggctgaggcaggagaatggcatgaacccaggaggtggagcttgcagtgagccgagatcgtgccactgcactccagcctgggcgacagagcgagactccgtctcaaaaaaaaaaaaaaaaaaaaaaaaaaaaaaaaaaaaaaaagaatcatttattttacaaatgtaaagtgtttgggatgaatcagatgtactggtcttcatatacaaagagaactggaggaaaggtagctggtatttaaggaaatgtcaaactgacttcaaattttgggttgaattcatccttagttgaattcctgtcgggtagggttatttcccactcattcattctctacccactatgtgctaagtacccactatgtgccagatactattctaagttcttggactacatcagtgaaaaaaacagaccaaaaaaatctgcttagatttcagctgaaggaggccatcaacagtaaacataataagtgaattgtatagtatatcatatagaaaactataaaatctggccttatatctgcttcttataggttcaaagttcatcaagaagaagggagatcaaaaatactctggagttgactattcatgggcccacataaaaagcttttcatgaggcaagagactgaagattataacaggataataacaccatattgttatttttatgttgttgctctctgagttattagtatgagtagaaccttttttcttataagtctgatgcttctaagtccacttgttaacataattgacatgacaactttgttctttccaggcatttccttcaggatgtatgttttttttttttttttttttttttttttacagtataacaattagtgtaggtatctgacttatagaaatgcaaagctaaactgtagtcggcttgagatccatagttaggtcttattctgggtcttgcccagggtctgacacactcaaaaaatgcttattcagtcaatcacagactccaatcaaaatgtccagttaaaacagggaagcagagtagaaacctattgaatgcagaagactttattgaggccactctttcctaaaattaatcagcaggcatgttctccagaaactagtttgaaattctgtaatttaaaaaatgtgaactgcttgtataactccatcctctcccacttttctgttttctagtgtctttttaggtagaattctaaagaacttaaaattttggctgccgtggaaaagaatattactgggaaatgggtcttctcagtcaaatagaatcacagttttaatactctttccactgaatgggaaccacttttttttttcctgcaattttgcctaaatcaacagtgtgttttgtcaatgatgttacacctgagacttgtgagtccttgccttacttgggttcaatgagagggtgagaacattcacgtacagggtctgacctccagagatacttcaacaagtgaaagcttttgacaggaaatgttctgtttaatcttttgttaacatatctgtccaatataccttgtatcatcccagctctggacctccgttctcaggcttaaatggtctcctgatgtccaatgatgctgcctccatgatccttccccagtcatagccagactgaaaaggtcacacccatctctgaactacttttgtcatttgcacctctcttaagtcccttattacatgcctccagatactttcttttgtttcttgtcttcctactgtaccctttggggagagggaacatgtcttatagccccagtcgaatggtgcctctaattttcacccagttagaatcacccaaaggcatttcactttgctagaacttccttgggtattgttgaattcctgtcattggaaatgtttctgccccggttgagcaagcactgaacaggagtgttttagagggaattaaaacttcaaaaaggagaatagagaggctctaccatttaaatgcaagtcgcttgaaatctgtagaccacagtagcaagcacgaagcaggtattcaataaatgtggtgaattcaatgtcaataacatgctccagtcttttgtccactattccccgagcctacctaaccaatgggcaaagtggtactaattgccatcattaggaagcacatgctatgtgtcagaaagtatgtaagaattgtctcttcatccatctctgtctatatctcattttatcgatcttattgacaaatgagaactatatatagatctcattttacagatgaggaatctgaagctaaagggattaagcaatttgctcaggatttctcaagcaatgagtggttagacttagtttgcaaatttatgactctgctcccaaattctcattttccctcctacagctggataatagaatttttaagaagcatccttccacacctcctcacctatgaccttccctccacttgctccactgatgcctaaaattctgtttttggagttcacttagtttatgactttgattctggttaacattaaaatacccaggacatgggggaggggaagctgttatcaatcttagtttagtcagttaatatagcgagttgctcttattcattactcaacaagcacttattgactgcatactgtacatcaggtctgtaccaagctttggtgttataaaaatgaatgaagtttggcacttacctttaacattgttgtagtcacatataggagaatgtaagagattattatgaaacaatgtagtaaatgtacaatagggaattctagataagcacagcagagaagcaaccagctccgtttcaggtcctttcctgagactgattcggctggaagggagtaggtcccgccaaatgaagaagctgtgggaagacaggaggacaagaacaggctccacgaagagatttcagagcagagctgcgtactcctttttctttttgtttcttttgctctgtcacccaggctgaagtacagtggttagctcacggctcactgcagctttgacctcccaggctcaagtgatcctctcgtctcagctttccaagtaactgggaccacaggcatgcatcaccacactaggctattgttttacattttttgtagagatggggtctcaccatgttgcccaggttggtctcaaactcctgggctcaagcaatccgctcacgtcaacctccccaaatgctgggattacaggcgtgagccaccgcgccaggcctgagtaatcctaatcacaggattttaaaaagaaacttcctgcgccacccattaaacaatatctcctaccaatttggtagtaaatattttgctaatagtacctaatttttaggtaggcactgtgtttatacatatatccattccttcttttttgattgtctttctgtttaatgggcagctacctctcttggcatctagcagaatgagctgctgcagtttacacaaaaagaatggagatcagagtactttttgtgccaccaacgtgtctgagaaatttgtagtgttactatcatcacacattacttttatttcatcgaatatttcaccttccggtcctgcgtgggccgagaggattgccgtacgcatgtctgtacgtatgcatgtaactcacagccccttcctgcccgaacatgttggaggccttttggaagctgtgcagacaacagyaacttcagcctgaatcatytctttcaattgtggacaagctgccaagaggcttgagtaggagaggagtgccgccgaggcggggcggggcggggcgtggagctgggctggcagtgggcgtggcggtgctgcccaggtgagccaccgctgcttctgcccagacacggtcgcctccacatccaggtctttgtgctcctcgcttgcctgttccttttccacgcattttccaggataactgtgactccaggtaagcaaggtggggtagcagggctggtgacttccttttttcagggaaattcataaatatcgttatttgagctgatttgagatrgtgaacaaaayggacttaggtccattttggggctgttttcaaagacgggctgttgggttgagtactgtcgcctctcatcccccatgttggcagtatttccagctcccaaccctttgagcaccaggaacactgcagagggagtaaaatcacttaaccatacaaggtaagaatatgaagaagtcacgtggctcggaggttttggtggtagaggggtgcaaccgtgattcacggaggagaaaatacttctgaggacattttcaggcctactttggaactcagaatgaattttgcaatgctagtttcagaaagggtgtggtacccgcaaactggggaaagttgagaagtattggtgggtctggctggctcttctccctggctgacgttgtaaggctgagatttaggcatatggactgcccttctttttggcatttttaagcatcagatcgctgttcatctacttgcaactgcattcttctaagcggaaattattctcccttcagttttctgggtttcagcataactttaaacaagttacacatttcagatgcrtattcttggacttataaattgtaatagctgcttgtagtttcttactcatatgctgtacactttttcttatggcttcatttaagcatatcatactaaaaaccaacatgccaggytattccagagacttgtaaccagatcctcagagctgggggctcttagacatatttcagcccagccccctcattctgtagatgaggagcagaactcacagaggtgatctggtgtccaaaggcacacagcttgtaagtagcaccgctgagatcaaatcaggccttcacacttgcagctcgggatgtttccacaacaccgtgggttctgttaccatctttttcatcccctacatctcccgggaggttttcgataatgggttccaaacctcagtccctgtcagttagtgtaagtgttcgatgarttccttcatgggtggagatgaagcctgtctgaggaaaggagtctccaaaggaaatgagtcagcaggtttatatctttgcttcctaacgccttgaattgtgccacttcaatccctctgggttgyggattgactttggggctatgcagtctcagcgatttgggccattctggtgtggctgagtctggctgtaagtttactgcttggcaacagtgggctgggtcagtggtcaagatcaggcttctaaagagacaggagcagctatgatgcttcagarcaaagcagacgcccccctgccatgggaaattaaagcaattactaatagctgtattgtactttcttgcccacaaagcacttttcatatacattgattcacttaatcacttcgtttagtcctcatagtctttcacattgcagaaacttcaaaatatcctattttcttaatcctgcacatcctttgctcctcaaagacttagaatgtggacaacagaggttgtgttttttggcattccattactgatattataataggcaaggtttctcatggcattccctaaggactggttataccaaatacttgagagatgtttttcaccatgtctttccatctttaaaatgaggcaggccaggctaaatgatatctacratactctgacacagtaaaaacgtagttttttttttttttttcttgagatggagtcttgctttgtcacccaggatggagtgcagtggcacgatcttggctcaccgcaacctcaccctcccaggttcaagtgatttttctgtctcagcctcccaagtagctgggatgacaggcacgtgccaccacgcccggctaatttctatatttttggtagacacagggtttcaccatgttggccaggctggtctcgaactcctgacctcaagtgatctgcccgccttggcctcccaaagtgctgggattacaggtgtgagccactgtacccggccaaaagttaaggttttaagggatgaaaaaactatactcatagctctgtttaaatatgcacgcccgtgatgtgtgggtgaagagtgtggttgatggtctataagtaaaatgaacatatattgttcaaatcaggatatgtttgagagtaaacggggcactgttatcaatgtcaagacaacagacataaaccaggattgtcccaggcaaagtgggatgtatatatcctacccacaggacttttttctcacctaaatggtctaaagacaaaaaatgtgaggaccattggctcagatgcataaaaaacttaggaaatcttcatacaaagaccagtgacaagctataagtctagagaagtgagcacggccctacccccagcccagtacatgcgtctccattcactggggcctctctgaattgagtcagttctccctgtcccacgtttttgcaaggctaactcctacttatcctgtaggactcacctttaatgtgacttactcagttgtcactgtctctgaggaggtgtcactgaggtttctagtatggggggtctatcactcctggggatcccatagtgacttgggtgctcatcaaaacacttaaaacagtcatcataccactaactgacagctccttggaggcaggggctatgtcgttttcaccttttcttaatgcttaccctgacacaaattaggtactcagttaatacttactagatgaaagcaacgtcataccaagagtttacaacataagtggcagaaagggaacaagggcttcttcacgtaggaaaatcatagggaagaagttttgtgtcgattgaacaaaccatgcaggatatgttgatatcttcaaggggagacttcaggacatgcaggatttttggaactcgagagacttctgagagaacaaatgccagcaaagatgcaattaacaagaaagcaggtgatcaggtgtggcggggaagtgccaggctgggagctagaagcaatgaattctaggtctggttttgccactctcactccctgcgtgggtggcctgggagactcacttcatctttgtctgcctcattttcctcatctgtaaaatgaagaggtgtggccagcctagatcctctccaagatcttgtcccactttcaaggtttataatttgcacagattgcgaaagcaaggtacttggaaataagttcttaaaactgcatttgtattactgcttgaacttccatctatctcactttcctatggttaaaataaagttccttttaaacttttaagtgctgaaagatgtagcgttttctacattgcaactataaacgaagttctccttgttaaaatggttacagggttttcacagaaatggaagaagacccttgtgacaaggcaacagaatgaaaaaaaatttgtagcaattttagcactttcaacagaagtcattaggcacattaaatttattatataggaattgctaatctctactctggtacttgcaattttatagcatttgatcatgcaaaatggtctgtgtaggaagtttgtattttttccaggtcatgtattgttaacattgctgaggtttgtttaaatgctttgattgtcttgcaacacagtcatgtggcaactgtggccaaagtcatcttttgagctacctcagaccagatcaactttatagtgtttttaggtcacttgggactaatcacagagccactgatcagatttaccgggcagtatttgattgattacttagtgggtgattttttgcaactacaaccttttccatgtacagaccttttctgtttcctttagccagcatcaaacaatgctcttgccactgggaccccagatactaagggctgtatgaccttcccagacatgaaggagaattttctgagaaaggagccagtcagcataggaacaggaaggcagatctctttgcgttcatgcactgaggattagcatgcaaaggaagggactcactcaaagggaaggtccgccaatggtgagagaaagccccagagatgttaggatgtcagatgtgcactgatttacatctccaacagggacctggatctaagccttgaattgcaacacagcattaattgtattgtgtaattaactacactaaaagccacaatgatcttgtatccacaatcatttagactaaatgtatctcaaaatgttgtgacaagtgaatgaataatgctttagtgaaataaaatggtaaaatgaacatctcctcaccatttgatccactcctaagatccatttgtaggtgtttgcagccaaactccctcagcacattaagatcttaaacaccatctttctatacaaaggaaatcactaaaagtatagtttgttattgactatgcaaaattattctagtttctcttggaggataataaatacgtgcttggaggagctacttgtgtttgttaaagcagtttgtgtgttttcatattattatcagtgcgattagctctccactggtggaagtgttaagaagctttcagggatctgggtttaggcttctctatttggtgaagaaataactcattacttcttgtacatgttgagttttacttgtagatgaacttggcattactaatattaaatgtgctgtggaaggaagccaggtttcctattctgaaagtctgtccacagattccccaaaccttttgtgaagagtttctttatgttttcccagtggcaggcacactgggtgaaacactcaacaggctttcatttttgcctcagtataccctgctgacctcagtatacacctaatgccagtcacctttccctggggtgtgatgtcacctgtaggcccttgcccctgccctgaggggagaaggagtaaggttgtgggctttaaagaaaagtgagaggcccacctgacttcagggggcctcgtggtatatttgcaatgggaactggcctgagcgcatggctgtacttatcagggacatatggagaaggaggaagcccatggaaatgaccagtgagcatgaacagagtcaataaaacattatttttggataatgaactcgctttttcagactctgagatataatcgatttaagtccatcctacacacaagccatatatcccataaaagggagaattctgaagaaatgtttaaagaccaggagtcctctcctccatcttattctcgtctttgcattctgaatttgtgtccaggtataaggtgcaaattgcaatcctattcatcatgcctttgactcttgacacacgtttgggtactggccaaagggagtcctctatcttaagcagtggagcttactttctaatgccagggtgcatgtcctacctgaagaccttcaatgtcacattcggcccttgtgtctgtgtgtgtgcgcctgaggctttgggggaacacttcgagtttaatccctgtactgctcaccccggggtagtaatatcaattcatttcccttagaaacatgctgtcctggcttaggcagaacctcaggagttcatgtagttcagctctgctcccagaaagggaagccctgactgcctgaatttacctaattgtctttggagtcgatcagtaactaccagactaaataggtaggtagacctttattagaacagtgaagctttttaaatctgaggaccctgttacactcttaaaaattaccgaggaccccaaagaactgtttctttaaaaaaaatgtagattatatctatcactatttaccaaactagaaatgaaaaccagatacattttgaaatgttcatttactaatttattaaaataatataataattaaatactaatatgaataatatatatattaaaaaacattttctaaagtgaaaaaatgtaatgagaagagtgatattgtttttcatttttgcaaatctccttaatatttggcttaatagaagggatgtcatatagcctctggaaaactccgctgtctattagagattgagaatgataatgtcttagtattatcatgagaatagttttaacctcatggacctcctgaaagggtgttagggactgccaggagtcaagacacaacactttggaagttgctgtgttaaaattaaagagctctgagatgtgacaagatgcctagttgctgctatatccactttaccaggctacatattttgaaactgttccctcttttctttaactcccatattacttattataccactcacatgtcttgggcagctctgtattctagttatttgtctgcatatctgcccaaagagactatgagcttagagaaggaggaggtccactgatccttgtaacactctgggtagtgtcttacacacagatgcgtattataaacgcaaacaataaccgctgctgtttattaagtattgttatgtgctgggtgtcctgcaaaggcattagttactttaagggttttctagcacttctcacaaagcaccacaaaccaggcagcttaaagcaacagaagctttattcacccacaggcttggaggccagtactttgaaatgacgatgtcggcagggtcatgctgtctcaaaaggctccaggggagaatgttccatgactttctcttggtttctggtgttgccagcagttcttagcattctttggcttgtggaagcatccctccaatctctgcctccattgccatacggcatgcccttcacacaggtgaagacatttgtgtcttcacatcttccctctgtgtatgtctgtttctgtgtctctcctcttattcctttaaggacaccagtcatatcggattagggctcacctaactccaatgtaacttcatcttaactaattatatattagttaagaaataggacataccctgtttccacgtaaggtcacattcacaggtaatggggattaggacttaacatatctttttgggggacacaattcaacccattacacttactaaatattaaactgaacaatgcaaaactgctgcaattcgactgtttttgttttataaaagttttaactttgtagtttaactgaaatcctaatggaaacaatatgtgataaataaaaccaactgatgttgattagtgctgtcaacttttctgacatatgctggagaagagatgtgaccactgggctcccgacaatggccactgtggctgagcaggcccaagactgcagagtctaggcagagctggacacacagaggacctcacatgccttcagacatttgcctggaagtttcttcacaactgatcttacttttgaatttacagaaagttccytgtttcttctgagatcaattactttgtttaaatagaattcttatagtgttggcagaatgcagttgagaagacgttaaagatgctttagaaactaactgctcccttgtccttgcttccaggccckcaatggatgccctgcaactagcaaattcggcttttgcygttgatctgttcaaacaactatgtgaaaaggagccactgggcaatgtcctcttctctccaatctgtctctccacctctctgtcacttgctcaagtgggtgctaaaggtgacactgcaaatgaaattggacaggtaagccccaaaaccttgtttctactttaagtgggaatacagttattagaacccataggcagtgcctayggaaaaaaggaatgtagactttgtggccagaattggtcaagattcagaactgtgccattccaggactctcttaatcttttttttttttttttttttttgtgagacagggtcccactctgtcacccatgctggagtgcagtggtgcgatgttggctcactgcagcctccaggttcaagcgattgttgtgcctcagcctgccgagtagctgggatgacaggcgcgtgccacaacgccaggcaaatttttgtatttttagtagagacagggtttcaccatgtggccaggctggtctcgaactcctgacttcaggtgatccgcctgcctcggcctcccaaaatgctgggattacaggcatcttaatttatttttaaatgtgaaagctcgcttgtaggtaatgcaactcacatctgggacaggcaccaggctgtgatggagaacctggagatctgctgggtaatcacagctttttcattctgacttataatattttcaatttacaatggttttattgagatgtaacctcatcataaatcaagcagcatctgtatcgttttagggtttctttctggctatggttgattatctagctttgtaaagttcttagaccttcaaatgagacaattttcctgattgttccgttttaagtcctcakgtacttttacataataggtgaatgttcttctaattctatttcattattactcttaygctaatcattctaggttcaatagaatttcttttctattagctcataagcatttaaaaaggcaacaccttcttgtattcatatgtgtccagaaagtatggcccataaragttatttaggtaaggatgaagaatttacacttgggacttgaagcagcttcactcctgygaagaggagatgtatcttgacatcaagccacatctctgaactgcgcaactccactatccctacccaatctcccattcctcatttctcatctaccattagagaaaggccagcgaaagagaacttccgggtagtgggtctgttcctcagtaattcctcaagctcttctcagtatatgcaactggttccccagcagtagttacctgggctcttaaattttctggtctccttcatccatctttaggcatgagagttatgcactgtctgggaccagcatttgaccctgcaatgctgaggctatgtaattcattgggacaatgtgccggtttggcagcgttcgttatctgggttgtggaatcacagcatggccattatgagttatggagcgaggagggtgtcatcttatgctgacattacatgttgtggtgttgcaaggcagaaaagatgctggactattgsttggaacaataaaaaaaaaaaaggaamaaaatacaatgatttaagccctccaaatgatagtatcctggttttaaatggcttacaatattattacaagaataattaacagtttgaatccatataatattttacgtgttttacatataagtaatcctcattaacaactcaggaaagcaggtattttcagcccattttacggagaggaaaggaggctctgaagagttggagaagattctctgaagagttggagaagaggtggtgaaggctgggattcacaggcagggccatctgactctagccagcccagggcagcccaccatttattgtagctgcccatcagaaatgacacatctatttacctggcatttgctaaagcacccagagggactagacagactctggctagaggcacttgtcctgaaatctgattcctgcctgatgatggtgtctcttgtatcaatctctctctctggtctttgaattggatagaaattataacccagcttcatcgttctccaagtttggaaatccttctgtgtgagtattaagggcatcactttgaagaaaggacaaatgttctcgatggttgatttggaagagtacctttatggtagtgtttctcagtggggacaatttgtcctccccttcccactctgggataatctggcaatgtctggagacattctgggttctcacaaataggaggaggatgccactggcatctagtaggtcagcgatgctgctaagcatcctgcagtgcccaggacagccccacaaagactcatccagcctgaatgtcaatagtgctgaggtygaggagccttactttacgggaactaggcaggaggagtctgtatgcccaaggacgttggtcattatcacgtgtccacttcagtacagcactactcagaggcaatgytttttgggtaacggatttttctcttaacaggttcttcattttgaaaatgtcaaagatrtaccctttggatttcaaacagtaacatcggatgtaaacaaacttagttccttttactcactgaaactaatmaagcggctctacgtagacaaatctctgaatctttctacagtaagttgtttaaagcaagtagcaagacttaactytttacaaggagtggcattttcatgctgttagacctayaactttttttcagtgaaattcctttctaggatgttcacttgtgatttgaggctttaaataaataaatcctagtggagaggttgagtatagtgggaatcaattgcagtcacatcttctaactcaaaatacagagaagcttatgggctttccttttctctctcaaataaatcttaccctttcttttaccttcctctgagagaatggagaacagagtaattaactctctaataaatgtagctccatagacaatgagctgtcttacagagtgtaagacagctaatgatttaaacttctttctccttaaagagcagggcatatggcctgggacaatgttttaagctctccacctcattttttatgcacacattcttctgatgtttctcaaaatcagtaagaaaaataataactatgaattcacaattttcatcagtcacaaattagttttgttggctgggctgrtcagatggggatctccacaggcagctctggttatataagtttagccattgctctaaggaatcatacaaacaccactacggtacccattgttgtaatatttaaaaatctgtatttgaaacacacagacaatattctagactacatgmagtttccctctgtacttcagtaacacagagttgatttagttcctgtttggatggtcagaatttcaaggtttccaaatcgaaaagctagactaccagcttttaaatattttaccatgattttgcaactttctgcagtaggtatttttgtggttaagatcttttgaggacatgggttactagatattgtgagtatattttttgttgcttaaagatacatacacacaaccatttttcttccaacaatcatctgaagaatttaaaaaaaaaaactgagatgtgagttgaagcctgagcatacaacatttctagaagctccctaaatgatcattaaagagacaattaacacatttttattgctggcagtgaggacaatggaggccctccttcatctggctgaggctttctaatgttttcaggtgagattggttctgtcagtcaatggtgacagtgagtcccaaggttgatttgcaattaactgaagctaagttaattggctaaggctgaagctgctctgaagaaattcaagaagccctgtgcttggaagtgaactgacatgacactgaatcaagttatatttagtttcactgaacttccatgcaacatctggaatgatcttaaccagactaggagttgtaaagttttgttttgtttttttccttggagatggagtctttctctgttgcccaggctggggtgcagcggcatgatctcggctcattacaaaagattttttaaaagactgctttccattgctcctgctaggtgcacagcatctgcaaatttactagttaaaggtccaaacaagtgtgctctgtggaggatctcttgcataagaactatctgggtgttaaaagggcaagttcttcaggcccttttaacacccaggtagttctgattgaacccaggtagttctgattaaacccaggtagttctgattgtcaaggtgggaatggggtttagggttgcacattttaaataagcattagaataagaactcctgttatgttctctcctgcattgtgtttccaaccttaatttgcagatggcacacctggaaattttgttaaaatgcattctgattcagtatgtctggggtggggtctgagattctttatttctaacaaggtctcaggtgatgctgtacaccaccttggaccacagtttgagtagcaagggtctacaggatatttagttcagcaaagacaagagttttctgctcataattctgttttctatacatttcctatattctaatatatatgtatctgtagacatacaaaattttcatgtttctgaaattacaacccataagagaattgggcatatttaacatagtgttttccccaaagctgatattaaattgatagatgcatttaataattgaaattgtcttataattgaaaaaaatgaaacattcaatacaaagaaattcactgacttctacatgaggtttcaattcatatagtgttaccaattttgaaagtgtacatatagcagttgatattyaataatccttttgttagaagagaataacaatgcaatagcttgactacagactctgattttatgaactgcatgtttttcaggagttcatcagctctacgaagagaccstatgcaaaggaattggaaactgttgacttcaaagataaattggaagaaacgaaaggtcagatcaacaactcaattaaggatctcacagatggcaagtaccctttaattgttctgctatcaatcaccaagtaaacagggccttccatctcataaatgtttgctccaaggataaaaaaaacatctggaggattctctggatatttttactacacaagctaaattctttcccttcaagcctgtaaacaacttggatttctgggcaattcttgtatcatctcatcacttggtagaaactgttgatgcttcagtgttagtttactttgtcttgctctctgacgagctgtcacaggccctagtggaatcctagctgcgcctctaacaaagtatgactttgggccaatcatgaggccatttttcagtctggaaatagagggactggattataacttcatgatccccgaggcccctttcagctgacaaattttacaaatttgttaaggaaaaagggacataggcaacatatgtaaaagaaaaaccggctggacgcggtggctcacgcctgtaatcccagcaytttgggaggccaaggcgggcggatcacraggtcaggagatcgagaccatcctggctaacacggtgaaaccctgtctctactaaaaatacaaaaaattagccgggcgtggtggcgggcgcctgtagtcccagctactcgggaggctgagacaggagaatggcgtgaacccgggaggcggagcttgcagtgagcagagatcgcgccactgcactccagcctgggcgacagagtgagactctgtcttaaaaaaagaaaaccaaaccaaacaaaaccgtagtgtcagcttgtcctcggtgccgcagctccccatgctggtcgttcctctgatagccccggggtccaagaagctcctaggttctttctccggctcagtgcttcccccaggcgtctccctcgtcggactcctsgtccctcccttaaaattgccggtgagtcgtcttccttgctggaaaagaattagggttatgatgattttgagggcaaatcagtgactttgtccccctccccagtggatatatttataattgcatctggagggacccgttgggaggccgggccgaatctagtcatgaaagaatgaagcctaggcagtcgctgctgtctagggagggatacacttccggggcaagggagacccacttcctgcgagaatgactrgcgcccccagctactctgtctctgtactgactgaggaagttctaacaggacagtaactgcaggatgagaacatgggaagaacagggtctctggagtcattcagcacctaggttcaaatccagacactggtacttactaactgatatttggacacaaagcttcaatttactgaactgtaaaatgaggcacatgttacctgatttartttttaaaattgtattatattgtgttttatttcaataggttttggggaacaggtggtttttggttacatggataagctctttagtggttacttctgagattttggtgtacccatcacccaagcagtgtacactgtgtgcaatgtgtagtcttctatctctcacctccttccactcttcccccaccccacaaagtccattatgtcattattatgcctttgcatcctcatagcttagctcccacttataagtgagaacatacaatgtttggttttccattcctaagttacttcacttagaataatggtcttcagaccaggcatggtggctcatgccataatcccagcactttgggaggccaaggcagctggatcacctgaggtcaggagctcaggaccagtctggccaacatggtgaaaccccgtctctactaaaaatacaaaaatcagctgggcatggtgtcacgcacctgtagtcccagctacttgggaggctgaggcaggataatcgcttgaacctgggaggcggaggttgcaatgagctgagatcgcgccattgcactccagcctgggtgagaagagagaaactgcgtctcccaaaaaaaaaaaaaaaaaaaaaaaagaataatggtcttcagctccatctaggttgctgtgaatgccattctttctttcattttttttttgagatagaatgttgctctgtcgcccaggctggagtgcagcggcacgatcttggcttactgtaacctccgcctcccaggttcaagggattctcctgtctcagcctcccaagtagctggggctacaggtgcgtgccactacgcccagctaatctttgtatttttagtagagatggggtttcaccatgttggccaggctggtctcaaactcctgacctcaggtgatccacccgcctcagcctcccaaagtgctgggattacaggtgtcagccaccgcatccagccatgaaaagacttctgagtttgaaatgggaggctcagggttgaagttgaagctctgtcgtttaccggctcccacacttctttgttcttcaggtttcttcaataacactaatatatatttaacatattatatagcattggcaggaccagttacataatttgcatggtccagggcaaaagtaaaaatgctgggcttcttgtttaaacatttattaagaattttgaggtagtgacagctgaacattaaaccaagtgcagggtccttcacacaggggtcacaggcctgtgaagtgggccctgaacattggtctgaaaattggagattaggtgaatgaaaaccctttataaaaaacctgtgggctattcaaatgtgaggagttctttttattaagggatcactccccttgaattgttttggctattgggatttagctttataataactgcaattgtgattgagccctatggtgattacagttgaccttgaggcaatcagcctgcccgcaaggagtgcaattgagagagtggatggagagctgtggggtgaaggggacaaccttcagacatgttttccagctgaggaaactagaacagctccttggcctctctgagcctcagtttactgcactgtaaaatggagataatgatctttgccttataggaccattgtgaaaagactgagataatatatgtgaaattctgccataaagaaagtgattacgtattttcattcaagagcacaggctttggagtcagaaagagctggctttgaaycctgaatccacccttgtttatatatcatccttgaaagtgacttatcatcgctgagtctcagcttcctcattcataaagtaggaagaaatatatataatrtgtatcaaatagcttgtatactgcctgacacagaataggcattcagaatggtagctgtgctttccttcttatttctcttcctttcttccctgctccttcattctcctctgctgacctctttggtagatctggttgtgtcaaggtagaaggagagaaargagtccttctgaaatttgatggttggaaccatcaggccttacatggtgtgactccatgaagtggtaaatactcagtgaatatgcatgtgaatttcagatgtagtttggaagaataattctgctacttgtgttttcctaaaattgttgcaggccactttgagaacattttagctgacaacagtgtgaacgaccagaccaaaatccttgtggttaatgctgcctactttgttggcaartggatgaagaaatttyctgaatcagaaacaaaagaatgtcctttcagastcaacaaggtatgtggggcagcrtgtagcagtaaaaggagcccaattatagatgtgaaaaatgayagggacagagtggggcataaatccattccaatgaggaacctgagggcacggccggcaaagtgcctttcctgagatgaacagctggaaggtaagtggtacaaaaagagccagaatccagaggccccccctcctcttttccataatgtcttcaaggatctgagctgagtgaaactttatagaatttgtaacccagcgaggaaagctaagtcaccagctgaaaaatagctacaaacatctgagaactttagcagaaaaggaaaagaccaaactctgttatcagaggactttggattatcatgaaaccttgacatctaggaatcttgttcctgattgattaacttctctaacatctcatttccttatcggttgatagcgaagtatattgttctgggattttaatttataatttataagatgctttgatggctgggcgtggtggctcatgcctgtaatcccatgactttgggaagccgaggagggcagatcacctgaggtcaggagttggagaccagcctggccaacatggtgaaaccctgtctctactaaaaatacaaaaattagctgggcatggtcgtgggtgcctgtaatctcagctacatgggaggctgaggcaggagaatcagaccctgggagacagaggttgcagtcagccgagactgcaccactgcactccagcttgggcaacaagagtgaaactccacctcaagaaaaacaaacaaacaaacaaacaaacaaacaacaagaccagatgctttcaggcacttgttggctgtgaaaaaacaaagtatggcttactcattgacatcactggaagtcattatgggaagaattaagggcctgttttgcaggccagtctcattgatactgttgaagtaaatatgttaaataattaatagagggtgggcacagtggctcatgcctgtaatcccagcaccttgggaagtcgaggcaggcagatcacgaggtcaggagtttgagaccagcctgaccaacatagtaaaaccccatctctactaaaaatacaaaaattagctgggcatggtggcatgtgcctgtaatcccagctgctcaggaggctgagacaggagaatggcttgaacccaggaggcagaggttgcagtgagctgagattgtgccactgcactccagcctgggtgacaaagtgagactccatctcaaaaaaaaaaaaaaaaaaaaaaaagaaatgggtaaagtacctcttttgtaaatgagaycaaggaactgagactggaaatttgacccattttattggaaaacccagacatctatatgatgatgtgatgtggtctccgtgggtgggatctgacttgtgttagactggaagcagcacttcagttagtacaatacttgaaggtagcttagttacctgtagctcctacgcgtcagttctagttttcatgcttctcccagtagttagagtacttagcatcaatatcttgtttttgccaaatatagtagcaccttcttaatgctagcatccatgaggaaaagccctgcaagatacaatctatgcctgggttagccggatggcttccattactctttctttctttgttcccatggaatttttattcatactctcccctgtccactgccagaatttgcttttccacagtgaaatctgtttacttacatagatcccctactagcgcatgggatttttaaggtagggacaatgccttattcacctcagtgtctacaatttctggccaagtccctaacacatcagtaggtgctcagcaaatttgctgaatgaatgatcagtccctaagggtcagtttgcttaaacaatcaatagcagacaaaacctgactggcctttgggactaccatggtttcctatgcaagacccattgggcattttcactgggagaagacaatgatgactgttactgctccttaccaactcaaaatatccatgggagctgagggatgggtaggaggtcctcctaacttcctgartttagcttcccaactgcagtggtcttctcaaagctgactgcagagacaggattgaccctgcacacaagaggtctgtctgagattctagagacatagcttatgctcttcacactcttgtgttttgcacacacaggtccttgagttttaagcatggctttttgaccttctcagtattgtcttttatctggagtggaagtggaacgtgactttacccagcctctactgtgagttagggaggggtgttggccccactggccctgacggcatccacacagcctttgctgtcatagagtgacccttctggctcctttgattagtgattggctctcctccatagcaagggctggcaaagggttcctaactctgtttaagtgaaatctgaaacrggttgccaatggtgcctctcttcaagaccccagagccagcctggaaggaacaccatgaaaatgttgcaatagtcaatgagtagaatgtggacttttgtgtcaaccacactaagggtcgtacttttttcattaagaaagtattaacgtgtgttttttgagaagggaggaagaatgtgtgctattcctttattcttgctattaaatcataaagctgggttatataagatcctggaaactcagcctttatgaacagaattaataaaagtttgaaatgtcattgatctctcagtgtttcacttgataaagcaataaaatgctattcayagctgcatgaggctmcacccttcttttgaatgcagatgctattacttctcctttgttttctttgaattgctttgtccaccctagaactttttgagtgacattactaaaccttttcttatgccccgtggtgtctccggtaagggttagactaaattggtgaagttatatcattaaaagtttagtatagtacttattctgataaagatatctatccatatatatctatattagtatatatgttgtattatattttctggggtagatagtctttatttggtcctcttttcagaagatatgtcgtctcaacatgtgtttcagaaaataaagtacctgtagtcagtgccgataagtgaaattgatgacagtttttggaggccacaactatgtgcacattcagaaactatgagcagtctaacctgttggagatttttagacaaatttctttaggaggaatatattttaagacaatatcctctttaggagaaataaagggaagaattatctgttaacctccaaagtagtatgttttcctataattctgtttttggttacacatagagttgaagtcttccattatttatcagccaaatattcagtgasaaactacaagctggggtagaaaatgagacttagtttctgccttgactgtattctagttggggtgggaagtggaaagacaatcactagataatatttctaacactgtggcaagtgttaaaatagaggtatatacaaaagtaaaataaataacgtttagctctgctggagagaggtattggggaaggttcagcttagtatttgaagataccagatgcaagtttactggagtattatccttgcaggcttgatatgaagyttgaaatttctccccaaagagatttagttaacaggcaaatatcccatgggaggtatatgtcaataggttatacaacattactgtcagtcttttacaacttagcgtgaattaattttccttcaggaaatcagtcatctctggagcagagacaggaggccaggtgttaataggagcaaagagaagaaaaggcctgggcagtgcttggasataaaagacctgaacgatcagacccttccatgggctccctttaagaagagcagggagagaccaagggctaaagttgggagactgagaaaatgcagcccaccggggcattacttatttctccagctctgatccgctgttgtactaggggtctaatccggcctgtgtctgcctccttcttgaatagcccagagcattcatctaaacagccttcctacagcagctccccactttaggtgtggccagacaggagttctagaccaggttgtctcctgggacattgacaccgcagccaagtttattggtgctgaggcagacacagttggtgtggttggttcaggggctagcattggaatagcgtttggcagcttgatcattggttattccaggaacccatctctcaagcagcagctcttctcctatgcgattctgggctttgccctgtctgaggccatggggctcttctgtttgayggtcgccttccttatcctcttcgccatgtgaagctctgtgggggtcacctgcctgtccctgctgctgcggctgcacaccattcttggtgctgggctgtgctaagctttaccattgaacacaacgtttctgaaaaaaaaaaaaaaagagccaagcatacagtggagctcaaagggacttagagataattttaaaaagacttagagataattttaaagaacattttcctttttaaaaattatgcaatactccaagcattcagaaaatgatagagaataataaaacgaacacccatataccgatcaatcatctttttgaacttaatattttgccttaattatttcagatattttaaagaaaaaatataacaacagttgcattgctttgtatgtatcccttcactgctcactccactgtcctgttcctctttcttcctccccagtggtaaccattattctgaatttacaakttcttcattctactgacaagaatactgaggcctggagagattgagtgatttgctcaaggccacagaatctgtttatgtcacatttgggactaaaaaccaaggttcttatcttcaatttagactttgttaattagctcagatctgagtaggtggcagtacagtggggagtgggcaattcaaaccaaagacaaacagagaggtcacaacaaatattgttttgttctgctatgtgctaagtttgttgttgttattgttctgttttgttttgagatggagtctcgctctgttgcccaggctggagtgagtgcagtggtatgatcttggctcacaccaacttctggctcccaggctcaagcaattctcctccctcagtttcccaagaagctgagattacaggcgtgtgccaccatgcctggctgacttttgtattttttagtagagacaaggtttcaccatgttggccaggctggtcttgaactcctgacctcaagtggtctcccaaggtgcaggattacaggcatgaggcaccgtgcccagccagtttttgaaattaggcattttattaggaaaagccgtataaatggttatgtgggtttgcagtagaatttactttcaagtcagctccacyaggaatagtttaaagatctcataggcatctgtaaagaataacaaacgttgcctatatktacagccatacagtcttatttttaaggtttgatctatgcaaatacagtattatatatacttcatgtaatgtgtaacatgtagattataaagtatatgaataacttttcaaaggaacacaaactcttcacaggacagtctctggtttcagtgcaatacagtttggatctgagtggatgatgaattataagccataataatctgacactgtgtcaagagcaaatttgtgtatatatatatatgtacatatatatttatgtgtttgcctatatatgtgtatatatgtgcatgtgtrtatatatgtatggggtatatatatatagtatgtatatataagtgtgtatatataggtgtgtgtatatgtatatgtatgtatatgtatgtatgcatatatatgtatatgtgtatatataggtgtatgtatatatgtatgtgtatctgtatatatataggtgtaggtatatatgtatgtgtgtctgtatatatacatgtgggtatatatrtgtgtgtgtgtgcgygygtgtgtgtrtatatatatatatatatatttatgcatgtgtaaattgaaaagtaagcagtccaaattttcccttttacagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaaggtaaggagaaggcaggtgctctccacaaaggcaccccctgccttggcaaagagttgtgccaacaggtctgtgtgggccgtgagagctgggccggtagccctcccttattgccactggctcagtcacctccaaggacccatggttctttctggggcctttcctccttaatattaacaacagccaaaatttatttggcacttacagtgttctagggactgtgctaagttgcctaygtgcattatctcatttaattcttacagcaggctgatgagttagagactgttaccacactcttgtttaccagtgagggagctgaggcacagaggggtgggtaactggttacataattagtcaagggtgtgtgcaggatcaggatttgggcccaggtagttggagccaggttcttaactgaaggctagagtgtctccctcacctcctaggcagttaaggcactacgttgctacgcactgccaggtccactatcatgtgacctgatgtcaagcatcctctctcttgctctttctttttttttwaaattagtagatgttatttttagagtagatctatgcctacagaaaaataagcagaaagtacaaggagttcccatatactccccttcccgtcccaggcctacagtttcacctgttattagcatcttgcattagtttggtatgtttgttacaattgatgagccaatactgacatattactattattattattattattattattattgttttagagacagggtcttgctccattgcccaggctggagtgcagtggcatgatggtagctcactctaacctcaaactcctgggcaggctggagtgcagtggcatgatggtagctcactctaacctcaaactcctgggctcaagtgatcctcctgcctcagcctcccaagtagctgggactaaaggcacacagcactatgcctggctttttttttttttgtaaaggtgggatctcactgtgttgtccaggctggtcttgaaatcctggcctcaagcaatcctcagcctcagcctcctgaagtgctaggattayaggcatgagccaccacacctggccttcacaatttacgttacggttcactctttgtgttgtacatttatgagattttaatacgtacacatatatgcttcaaaattttgaattatgcagatactattttatagtacacattatatataagtattttattttatatgataagggttattatattattttatttatatagatttttaaggcacaaagtttaaataagagtagcagttttctctgcaggtgaatggagttttagcttcctctctgctccctcacctctgcttagctggctgaggcctgttctccctttagtccctccctggcttccattctagctccaccccgcctggcctcaacccttggccaggaaggaagaaggggctctttgaaggcctggatcacttgctatatatccacatgggcctcagtgatttgctgactttccaggggaccatccagtctccagcttgctcctttggttgccattatgttttagccaccactttattaactgaattataattcctgtccttcttcttctttggtgcattaytctctctgttttttttctttccattttatgctttgatctttcagccattatccagctgtcttggattttacctttcgttcttaaaacgccctccaataaacatcaattattttcttcttcttcttctttttttatttcaataatttatttttcttttttttaattatacattaagttttagggtacatgtgcacaatgtgcaggtttgttacatgtatatacatgtgccatgttggtgtgctgcacccattaagttgtcatttatattaggtatatctcccaatgctatccctcccccctccccccaccccacaacaggccctggtgtgtggtgttccccttcctgtttccaggtgttctcatggttcaattcccacctatgagtgagaacatgcagtgtttggtttgttgtccttgtgatagtttgctgataatgatggtttccagcttcatccgtgtccctacaaaggacacgaactcatcattttttatggctgcatagtattccatggtgtatatgggccacgttttcttaatccagtctatcattattggacatttgggttggttccaagtctttgctattgtgaatagtgttccaataarcatacgtgtgcatgtgtctttatagcagcatgatttataatcctttgagtatacacccactaatgggatggctgggttaaatggtatttctagttctagatccttgaggaaytgccacactgacttccacagtggttgaacttgtttacggtcccaccaacagtgtaaaagtgttcctatttctccatatcctttccagcacctcttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcacatcctttgcccacttgttgatggggttgtttgattttttcttgtaaatttgtttgagttctttgtagattctggatattagccctttgtcagatragtagattgcaaaaattttctcccattctgtaggttgcctgttcactctgatggtagtttcttttgctgtgcagaagctctttagtttaattagatcccatttgtcaattttggctttcaattattttcttcttaaagtatagaactaaagaaaatgaccttttgagttttggaaatgattttttttttttttttgagatggagtcttgctctgtcccccaggctggagtgcagtggcatgatctcagctcactgcaagctccgcctccygggttcatgccattctccttcctcagcctccygagtagctgggactacaggtgcctgccacgacgcttggctaattttttgtatttttagtagagacgggctttcactgtgttagccaggatggtctcgatctcctgacctcgtgatccacccacctcggcttcccaaagtgctgggattgcaggcrtgagccactgcgcccagccgcatctctctcattttttaaaacagctaaaatggatgcattcactacctatgaccctagggcatggctcagagttagttcaaattcccattaaaaaaaaaaagtaactttagctttaatttaattttctaaatctgatgccattcctagtacatgaatattctggatttcctcgtagagaaattacaataagcattcaagaaatatgtgtaaaaagctttctaattttatattcatttcactattgtgtatgcaacatcatgatccaggcatttgtttctataaatctactctctaacttaaggttgggtgcggtggctcacacctttaatcccagcactttgggaggctgaggctggcacatcacttgaagccaggagtttgagaccagcttggccaacatgatgaaaccctgtctctactacaaatacaaaagaaaatttagctgggcatggtggagtgtgcctgtaatcccagctactcgagaggctgaggcacgagaattgcttgaacccaggaggcagaggttgcaatgagcgacgatcacactattacactccagcccgggtgacagaacaagattgtctaaaaaaaacccaaacaaacaaacaaacaaacaaaaaactactctctaacttaaaatgaaaaaacagaaccctgtcctcataaatttcagtgcacatggaacactgttataggctggggaggaggaggacacagctgggtggctgctgggtctcctgagtcacataccaaaaacttctgggccatctttgatgttccacccagactgctttgaarctgggcttatcataacaccttatgttttcaatygagccaggtcttttacagttggaaataaataaaaataatttcttttcatttttgtccttcagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagygaagacacatctgatttctctggaatgtcagagaccaagggagtggccctatcaaatgttntccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgcyttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctahaaatcamcaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgacttgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccrtgttgcaggttcatggattacttctctataaaaaatatgtatttaccaaaaattttgtgacattccttctcccatctcttccttgacmtgcattgtaaatagsttcttcttgttctgagattcaatattgaatttttcctatgctattgacaataaaatattattgaactacatgtcttgttttttttttcctattaagttagactattttgaaatagaaccaagccgtgcgtttacaaaagcatccctgaagcaggcagatcacaaggtcaagagattgagaccatcctggccaacatagtgaaaccccgtctctactaaaaatacaaaaattagctgggcgtggtggcgcccacctgtagacccagctactcaggaggctgaggcaggagaatcgcttgaacctgggaggcggaggttgcagtgagccaagatcaggccactgcactctagcctggcgacagagcaaaactccgtctcaaaaaaaaaaaacaaaacaaaaactcaaaacataaaaacaacaaaaacaaaacaaaacaaaaagaacaaaccccaaaaaaccccaaagcatccctgtaggtaaaatgctcttttgaagattgaggcagactaaaaagaaataagaataattacttcctcttttcccttgttttcctttcttcctagccctcagctctgacttctttctcccacactcctttcatcctagggagtaaaagaccagggcagtgctagaatgactctcaactgcataaacatctataatggaatcagacaccttgggacatagagatcttcccagcccttttcactctaaacccaccctcaaaagtcattatattaggacactgtatgtgcttaaaacattgtttcttcttatgaagagtgtttttctcaatgccatgcacatttgttttaaattagttatggtgtccctgaacctaatattcaacatagcctcttttctgtccctattgtgtgcttgaactaaacgtgtctcctctttcaacaaatgatgagtacaaaagctgacaaatgcccccacatccttaaaagattatttgtgtgggattgctgggggtggtcaaagccagattttgcccgcttggttcatcatccctcttatccaggctatgaaatacaaaatgtgagatgactgtgaaaaacattagtgagtttttagaggaagggagagatttgtgcctctttaaaccaagaatgcagggagcttaaagtgtctcctgcaatttggaaaacactgaaaattttggtcatcttatctgggacagtcttaattcagtgatttttcaaccaggggaaattctgccccctaggggacattttcattgtcacarctggggtactgtcatctagtggatagtctggggggttttgtctaggatgaggaggaagatgaaagagggtcggtttggaaaggaagaattcagtgcattctgcaagcaccctgcccagcccagctcactagcaaactggtcacaggtatattatctcattttgtcctctccacagacctttcaggaggaaaccatgatcccatcttataaatgaggacgctgagacagagaatggatagacaacctactcaaggtcacagagctaatgcatgttggtggctatatttgaactcatgaagacagactccagagctggacttcctaacctctctgctccatgccctcttccaactgacagcgatccctgacaggggtcactgaatgaacctgaaagaattcctctcttccagaccttctctatttaggaggagttccaaatatttgtcatatcctggcagtcctttccttgtcaactaaaacatccctagagtcagagacagtccaccagtaaggggcccaattactgcctttgcttattctcacagtgaccctgaagttaagggccatgcctatctattttatgaggaaatatgggcttagaagaattggataatgcctccaaatgggtaaatagcagggcttggatttgtgaacattatgactatgaaaacatatatttagttatttccttactgatgaatattcagctagtttctggtttttctgttatagataatattactatggacacctctatacttaatcatctgtaattattattattattattattttttgaggcagtctctctctctgttgcccaggctggagtgcagtggtgcaatcttggctcactacaacttccctccctcccaggttcaagtgattctcatgcctcagcctcctgagtagctgggactacaggcatctgccaccccacctggctaattttttgtatttttagtagagacggggtttcaccatgttggctaggctggtcttgaaatcctgacttcaggtgatctgcccgccttggcctcccaaagtgctgggattacaagcgtgagccactatctgtttaagatttctaaaatctttgtgattgatatgttatgaatatatcacaatttattcattctactcttgatggacatgtgggtatttccaggtttgggctattacaaatagtaccattgtgaatattctagtacatgttttttggtgaaatatgtgtgcattcctgattgttacacacacacatatatatattatatatatatacattttatatatatataaaatgtatatatatattttagtggttttcccagtgcctctctatctttcattatgattgtataataattatgagtgattactttttccaactatgactcctaccatcaccactgccattcttggagaaattattatgagccagacactttgctagacatgacatatgttataattcagcttccacagcaaccctatggggcaccatttgaggtgaaaggtgctaaagttcagacatgcgacacaaaaaagcttgctgagcacagatggctactgagttatatggttaggacttaaaccccagctctctgactccacagtccatactttttaatcactatgatttgattatattacaaaacttacttgtatttggccataaaaaagaattaaatcatgtcatttgcagaaacatggatggaactgaaggtcattatctgaagtaaaataagacagattaatcatcttaggtgaaataacccacataaaaagacaaatattaaatgttctcacttatatgtgagagctacgatatttgatcacatggaggtagagtgtggaaagatagagatcagagactgggaggggtgagctgggggaggaggggaagatgaagaaaagtggcttaaagggtacaaacatatagtgagatcgaaggaatagagtcaatgtttgatttcagagtagggtgactgtacttaacaaaaatgtattgtacttgggtgatggacagccacataccctgacttgatcactacacattttacacatgacatggaacaaaatttcatgtgtgcccatacatttttacaaataaaaaatgaaagagacctaaagtccctttagcctgtttagtgttggttgctttgcatcaagaaattgatgattcataggaaaaaacaaaacaaaaagcttcaagggcagattttcctctatgttaaaaatgaaatgttatgttgaatagaagacaaatgaatgtagataaaaataaaagttaaatgtttacataataagtaaacattccataaatacttgcttttcaaatatgtctggttaaatgtaatttttggaaaattctgtttctttctcaggagtcctgttcagtcaactgtatggcatttgtgatttatatcagattaaaaagacttcccttctaagttttagctcttggactagaaaccactagcacaacattcttaccctcaaccccaccctacagtcatggaagatttaggtgatgggcgtttccctgttcttttgtccttgtcaccatcctctgccagacagtaacagctgcttgagtttgtgaaagctttttgagaaaagagatcaaactgtttcactaacggcaaatgactattcctctcccaaggcctggaacagacaaaggaaatggcattattctccattagagatgagatagatacagacgtgtccctggaacttctgaccgcatttgaggagtcttgccagttgcacgtggcctgaaatgacagccctccctgtctctatcacaggctgctttgcacttctcacatctcctgggacaggatctatcacacagtaaaataaataccaaggcatattttcaatggatggaaaatagagtttgaatgggcaggtgatctatgtgtttgtgttggttgcctcttgcatctaatgagggcttctctgatgacataaaacaagatcgtcttgtgtttctgaaagtgtgtctggaggaacagtagttgtgtagggtatgagaagctgctatgaaataggagtccgtggttgaaaaatcttgaaaaagctgttttgaaccaaattaaacaggttctgcagtactcttcaagctttcaagaagttgatgtggccgggcgcagtggctcacgcctgtaatcccagcattttgggaggctgaggcaggtgggtcacctgaggtcaggagttcgagtccagcctggccaacgtggtgaaaccctgactctactaaaaatacaaaaattagctaggaggctgaggcaggagaatcacttgaaccaggaaggcggaggttgcagtgaaaggagattgcaccattgcactgcagcctgggcaacagagcaagactctgcctcaaaaaaaaaaaaaaaaaaattgacgcagttgacgtcttttctgaatatctggaggagggtacagtgtctcgttccttatttattttattttatttttagagacggagtctcgctctgttgcccaggctggagtgcagtggcatgatctcggctcactgcaagctctgcctctcgggttcacgccattctcctgcctcagtctccagagtagctgggactacaggtacacgccaccacgcccggctaatttttgtatttttagtagagacggggtttcactgtgttagccaggatggtctcgatctcctacctcacgatccgcccaccttggcctcccaaagtgctgggattacaggcagtgagctaccgtgcccgtcctggtttcttaaatttatacgacctctaaacctggtagtcaccctgcatcttggaggacaattgtttagtagagtgagttttgggaaaagtcaacttagctgggaaatagacttagtaagaaaaatcaagatttttccggttgccatgtggatactatggaaagaaccctggtgtgggaggaagccctggattccagcaaccaaaccactcctatcaatacctgtatatgagggagggagggtctttatctcagggatttctgagattcctcttgaagctaatagttcacggggcccaaacaaatcctccatcctgagccatccctcacccatccatctatgtggagacggctgccatttccatccctaaaagcatggtcaagggtctgacactcctctctgacactaggaacaaaggttgtcctcccaaaggtgaagaggcatgattgctatgtgcgccgcccccctccccccaactttggcaggaaaatgagaacaagtgaggcaaagactcacttgttatgtcaattctaggaccacatattagtggtgaaatgactttttctttccagcaatcccaaagttactgagggaggtaggaaatgtcaagacaatgcaaccaacttctcttccacaccatatagctgcttttcccctgcccaaatataaacacagacttgcctctttcttgcaggctgcctagtcttttactgtttattcaggctgttgcccacacgagcaccattgcatacaggtgtgtaggtagatccctgcacaaggatatcctacagagatggttagagggagctgaagtcaagcttgtagtccacttgcatagcagggctccagggtgtggggctgtgcctgtctgagaaagggtcacctcttttgcattcacaaaaagatagggtataggctagcagtggccctgttcagtactcagaaaaatttgcagaagaaaaaagagcatcattacatcttcagtactactatcattaccattactgacatcatcatcatcaattcgatatgttaccttgctaaga

SEQ ID NO: 17753 - DNA, 101046 bp, Homo sapiens
  misc_feature (1)...(101046): n = A,T,C or G, or insertion/deletion polymorphism (see Tables 1-2)
tcagaagtaatcctaaatcaagacaatggggacaaaattcaagaatatcagttatcagtataaatgtgaaataaccaaattctctgcttaaaggagaagacagattggcctgaaaaaccaagggaaaaaaaaaacaaaaacaacaaaccgtccagctataacgtatatgcttaaagcaaaaggaacaaagagaggctgaaaataaagggacaaggtaaaaaatagcaggctagtgcaaacatggaggagagacaacactactatcagccaaggtgggaattaaagtaaaaataagcagaataacagggataacaagctataatgataaaagaaacaatttatagggaagatgtaatattcataagcctgtatattcaaataatcactgtagataaacacataaagcaaggactaggaaaaatacaaacttaaaaaaaaaaattcaagtgagaaactttaatagagttctctgagaaccggacagattcagtaaacacagtatgtgcaaggacagagaagaactgagtaatacaacaaatacatctgatttagcagacatagagaaatttgaatcaataccttaaaaaatgtttgaagtcatgtatctaccataaaaaaaagcctaaacaaaatttgaaaaacatttttacagtcaatgttctcaaataattatctgcttaaattgggtggaaaaagatgaaaagtaactcccagtaatttgttacattactggatatccccaggatcaaggagggtaacaaaagcaaagccataagcaatctctagaaagcaatggaaggaagataaaagcaaaacttaggagataaaacaggaaatcaataaagagaaaaaatgaattatgagggggggaaaaagaagggtaaacaaatccaaaagctggttttctttttgttttttgagatggagttttgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaccttggacaagaccaaagtcatttaactattccaagcctctatagagaaaagggaaaacaatttgttttatgaagacagcacagttttaataacaaacccagatggagacataagaaaggaacaaaggaatgaatgaacgccataggccaatctcactcacaaatataaatgcaaaaatcctgaatacaatatttgctagcaattagattccaggaatgtatcaaaagcatctaccaatattaatccaacaacacagtataggggaaaaaaaatcatgcattaatagatgctgatgaggcatatgaaattcagcaaccaatcataatgaaaacagtaagaaaactgctggcagagtgtggtggctcacgcctgtaataccagcactttgggaagctgaggcaggaggagcgcttgagctcaggagttcaagaccagtctggacaacatggtgaaacactgtctctacaaaaaatacaaaaaaattagctgggtgtggtggcgggcacccgtaatcccagctaagtgggagactgaggtgggaggatcccttgagcccaggaggtgaaggctgtagtgagccgagatggtgctgctgcactccagcctgggtgacagagtgagactgtctcaaaaaaagaaaaaaaggaaaactgcttaaatctaattcaggatatttctgaaaaccaaaggcaaatactgttttctaaacaatagaaaattaaatctatttaaattacaaccgataattcggcaggaatgcccttccataattatttttaagcacttacatgaaaacttttacatgaagacctatacaaaaagcaaacaaaacccccatgtgctatccattatccagcttcaacaattagcaactgaaggtcaataatgtttcatctatttccacaatcatcaatgccactgcctggatgattatgaagcagatacgagatgtaacatttcatttatattccactacacatatctaaaaataagggcttcctaaaatgacaaaccttacacatagctagttctttaatgcaatcaaatatccaatcagtattcatattctctattctctcatttttttcatgtgaatcaagatccaagtaagatccagatattgcaatttcaccatgattatttaatactaccttggtgagtttactgaatataatgaaacaagaaaatcaaaagaaaacacttttttgctgattggactgaatacacagaaaatacaaatactcggctgggtgcggtagctcatgcctgtaatcccagcattttgggaggccaagacgggcatatcacgaggtcaaaagattgagaccatcctggccaacatggtgaaaccccgtctctaccaaaaatacaaaaattagccaggtgtggtggcgcctgcctgtaatcccagctacccaggaggctgaggcagaatcacttgaacccgggaggtggagggtgcagtgagctgagatcgcaccactgcactccagcctggcaacagagcaagactttgtctcaaaaaaaaaaaaaaaaagaaaatacaaatactctggttaaaaaaattctagaatacgataatttagtaaggtagctaaatataagatctcaagtaagtcaagtaccagcaacaaatatcaaggaatagaaatgggggcacatcatttacaacagaatttttaaaaatccaaacaagtagggaccaaactagaaaacaggtcctacataaatcaaatcatttttattttccccaaatgagtatgttatttagtccatttctaactggaatccctaayggtgtggcttttttcttaaaggattggataaaatgagctttaagttcacatggaaagattaaatgccaatgctgaggatagaaaagagcaggcacttaccttatcacctattacatgtatctgatttcaaacccacacagtgcaacatagaaataccatagagcacctctcccgcacctccacagaacccctcagcctcactgaaccctgtgcacacatatgggaaaatggagaaactatttgtcttaaactgacatttcaactttgctttgactttaccaagtttctcctgccatcttttttttttcctgtttttttttttctgaaacataacttggatccacaatgttttctctcataatttattaactaatgtgaaatggaaggtgaaagaggaattatgaacctctgaagcacatggttttcagtgagaaagccttgatccagcaacacaaactgccaagcactgtgattaacttaaacactgggtgcaaattggaccaaaaatgtagtcaaatgaaaattttgttccttcagatcgtgtttattccacatgccagaagttgtttaaagttctttaatcttgacccacagcttatttcttccacagaataaccccaatacacataaaaaaccaattttcgcaaaacaaaagatagaagatgaacaacatctggcgatgtagaacccggaaggtccatgatcttattcaaagcatctggattctttggattcggggaaggtccacgttcagtatacccacataacactcctaacagggactggggcagggataagtggcatgtatgactactaacagaacagacaatacaaatggccttacctcacctctgctgccaaatgagttttggtgtccccattcctccagacaaaaaaaaaaaaaaaaatacccacaacttcttcttttacagcagtttctgtatgctggtattggggataaaaaggggccctgaattacatttatgaatgatagagggaaaccctggcccctttccctaggtcaccttgctagtttaagagccagtcagaatgtaaatctgatctaattaaaacgctcttgttctttattcctggctgtggcactggtgagagaaatcaaggtggaagttgaggaaaaaaaatcaggacaacctttatagctaatgagatcaatgccaagattatacataacagtacacatcatgagttaggatgctgggtggtgcaaagaacccattaatgggagctatcaaaaatcactgaaaacaatgaggctcaaatcagaagtatcaagaatcagctttcatgacccctacaccatgatgtttttctttatgacggcagaactattttgaaacattaaatatatcggcaggcactgtgattcaaaaagtatttgagaacctactaggtgctagacaccaaccgaggcaatgagtatgggtgacaacatgtgccctgccctcacagcaccaatagtccactggacaaataccatctggaacatcaggtaaacacctaagcctgtctggaggaaatctaatttgggcggaatcccacaagcacagactaggtaaggagaaggcagttaaggtgggaagtagccagatttaagagtttgggcaatggccaaaggtgcagaagtttgaactacaagaagttcagtgtagttggttcgtgtgtttccgtggagagaggacaaggtctggtggcactgacaagaattagaccgaaaaggtaaaaaagcaagccaggtttgtctgggccagtaggccaggtcacagttgggactccactgagaccacggaagccacaggtttgctcctcatccccgggccaactcggcggcctccaaccctataccctaccccctgctgcctgtccgtgcctcgctggtgcagaccttcgtcgcctctcctcgccgaaggtacccgcagacagggcctagtcgctctcccctcgcttatccacggcatccagccgatgggcttggaggtttgggggctggccagtcctccacgcctcagggaggaaatggcaccgttagaaagacaagatggccacacaagctctaagtgtttgtcgggcctaaacctgtatcctccctccaagcaccaaacctcccgacctcgaccgcactcgacgccccgaggcccagcaccgacgacagtgcagaggaattcccgcagggtcaacaaggggtcaccggaatccccactcccgcgcccgggcctgcccgtgtcggagccactgtcgccggcactaggaccgcccgggacgggggagcccacgataagtgccgaagagcctgggctcggccgcccctcccccacaccgccccgccggcaccccagagccagccgaccaccgcccgagagtatgggacgagcggcgcgtcccccgcagctcctcgggagggccggcccacaacttgtgcggggtacaccggcgagacactcacccgccaaacagcccgagaataggcgccgaccgaccgcgccgcggacccgcccagcgctcgcggtccgctcacagcccgccccagcccgccccgccccgcccagcgcgcaggcggattgcgtcaccgcgtcaccccgcccctttgccaactgcttcctggctcagtgcgacctggccttcttcccctcccccatgcggccggcttccgagtgcgcaagcccagagtcgtccgcgttgtccgcctctgcgcaagcgccgtgctcctcccacggcagttggccatatagaggctgggggtggggggggaggtcaagcgtagcctcttctccttttaccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtcaagagattctttgccttcggtggtaaccgaatgggggaaagccctttgttaaaaggaaccaagtcccccttaaaaagaaaaagccgtcccggaagggcaattgttgcgggattccggaccattcccggggagggagcccttggcttctcttcctgtcttccaagaagatggcgccagccccgagctggggcgccgagtacgactgggcgggggacggcgagcgcccgcgcgaaactcgtctagcccaccaccgccgccgtctcgatgatcggggggcctctctgggattggctgcgcgcacgtcacgtggggccgacgggccctgcgcagaccatcgagtcgggcgtccctccccggggacgtggccttcctgtgcccgggctggggcccgccgccccgcgggggagggcggagctggcgcggcccctagctttctccttctggtgtggggcccgaggtgagacctggggagtgctccgcgagcccacgagcagcgacgtggctcggggacgggagggtgccgtgcctggctgcggcctgagcgggatgggcgcgggcggctccggcccgcgggttgtgccccggcccggggtgtcctttcctccctcccgcgtggcctggaggcactgcaactgttcgagactcacgtcaaggcttggcgcaaatacccctcgttcaggaagccttcctaggtttcccccgcttagaggaaacacttcctgagttcctaatggctgacccgcatggtgttgggaacctgagcctttctgacaccgtggcatgttgctagggtatttttgtgcgtagctcctttgaaaagtggttaggtgctcaaggctagctgctacatatcctctccattcgacttaaaaaatgagagggtcagacttgacatggtgtttggacgccatgtaaaatcgaaggaagtcgacttgggctttgcttattaaacagtgcctattatggtgaaattaaacgkctgaaggaatgtggatgagtcgtaatcttaaggaacatgacgatttgcccctcagttttgcgttttatgtcctcagattcatagctacctataccctaagccctcaatcaatgacttcacatttatttggtgtctgcttaaggatagtcactttcttagcagctaacttccttaaaaccctattaagataggttaagtcacaattagggttttgtctaaggctcctggtagcggcacattgcataataagcttaatgttcatttagggaagcaaatctgggatgctgaaacactggatgaaacgtagtgcttaggtttatattttgattttttgacatgtaaaagtatccctaggctaaattcattaagtacacatgatattaggatgcttggcaacagtatttaaaaatagttgaaaaggtgtttgggtaagaattatttccatcatttggattaccgaatctctgagtctgaaacatcaacctatcaagttttagacttggggaaaatggagctggagcctactgcctcaagtctcagggacagcgtttgaaaccccattaaataattcatcatgaggattaaactttcctgttactgctattagttttgcttggtgccaagcactgttgaagggacttagctcatcttatcaggagtcaaattaacgtcattcgggtaaaagtgcattgagtgtaaggagagcacctcaaagatatagttgacctatatcacgtccctcagcgccactaggcttacttgaatccctgttacagtgtcctctccagtgggcaaagctaacttctcagtggcctggtgggagaatttcttcttgagtaaatacgtatttttccaggttttgttgttttggccttccagttgtctgacttcagcctcatgacctcacttcttcatttcaattcaaaaaaatatttgctggaaattgctgtgtagggttaagggttctgcagatacaaaggttgagaggatatagtcttttcgaccaggtgcagtggctcacgcttgtaatcccagcactttgggaggtcgaggcgggtggacacttgaggtcaggagttcgagaccagcctgaccaacatggtgaaaccctgtctctactaaaaatacaaaaattagcctggcatggtggygcgcgcctgtaatcccagctgctcaagaggctgaggcatgagaatcgcttgaacccaggaggcggaggttgcagtgagccgagattgtagcactgcactctagcctgggcgacagagtgagactgtgtctcaaaaagccaacaaaaaaagaggatatagacttttcttttcctcaggcagcttgtggtctagtgtgagagacttatttgtagaagagtaattacattatggtgtgataagtgcaatgatagaaatatgtgtaaggtgtggacataggaaataggcwgtggttacctgttggaaagtcttcctacagaatgtggtccttgaactgcggtttaaaagacgagtaagagtttttccaggtggtgctgagtggacaggaagactaggaaagaggaggctgacatttatagttggtggcatacgtgagcaacaggtttagaatttggtatactcttgccatggcaaatggtagagggcttggctcagactgtgtactgaaggacttgatgcccttcagtgagttttatctaagatactctgacctgaacagaatttgagatgattgtgccgggtccactgggatatcttacgatccttcgtgggtcatatggattctccattagtgcgtcccagctgaaacttacagaaagggcttaagcagagaacatgctttttggagtacaaagtgatatttttatttggtatggcccgttcattgtgcatccatcccataggcaaatggtgatacgaaagcttttccctcttttggtaagaagtaaccaagttctgaaagaagcatatcatgcggctttcccaattgccaagttatgatgacacaaagtccaaaatgcgtgtaaaggtttttgaccaagtagaaaagcagagaaccccaaccagtataatgtgtcagaatgctttttctcttcaattgtaaaagcaccacaacgttcaacatctggaaaccaagaaaataatgaaaagaaccttttttcatgtgtataatattttaaaacttggttacatgttattttttggtatttctaaagtcagagacattttagaagtgaaatccctagtaggctattgttttaccaagcacactgaagttcctcgaataccgttgaagatgagctagacatttgttctgagacgtgtctggacatcatgtggttgtgttagtcatcttgttgatacttgttgttaatttggtaagaatacattgactacatactctcccttactactttttattagcattcatattaatcttatttcaaatcaaggttacagcttcatgtmatttgtagagtcagataatcctagaaaggcttgtaagaaagaagtgccaacatccttcccctaatcatgtttcctcccctgcagagtatctacttcagccttagtagatttccttgatctttgcctccaactctaaagagcatatttgcttgacgtctgtatttgtgtcycctacccctgtttcatgtgatgtctcttcgcttgacactgagaataggtaggaagttcctagctttctttcaccctctgccttctcagtgcaaacggatccatggctgcccaaagtgatatatccttaatttggttagttcagtattgattgtttatattatgactacatattgccatttacagctggacgaagtggtataataggattgttttcacttttctggataactttttgttttcctgggttattacaagtcttatttgtttttgtttgcttgctgcttgctcagttttctatattttgtcactacaattcaaccccaaattctgaagcaattatctaaatctttcaagaaattgtccgttttcttttgaagaaaattagtattcctatcattttatcttgaataaatctctcccagcgcctccaatctgctgcaggcttgtctgtgcctgaaatcttcctgtaactctcctcactccctcttgtgttggagcctcacttttctggaacctatgtcattctcttgatttgactgtctcacttcgatggagcacatccttcactagttgcctgagaagtgcatggcagatgaagttttcagaatttgtatgtacgaaagtgcctcgttctgctcttatcctgagtaggaatttggacatcattttgctccgcggtctctaagtttccagtgttgttgaagtcttaagccgttctgattctcttttattgatacgtaacatttttagagcctttgtgtgtgactatgttttcctccatgaaacctgaaggtttttgtttcttttttttcttctttctttcttttgtttttttttgagacacagcgtcttgctctgttgctcaggctgtagtgcggtggcgctgtcatagctcactgcagctgcaatctcctgggcttgagtgatgctcctgcctcggcctcccaagtacctgggactacaggcatgcaccgccacacctggataattttaaaaactttttgtagacatgagctctctatgttgcccaggctgatcttgaactcctggcctcaagtgattctcctgcctcagactcccgaagtgctgggagtgaaggctttgcatctggcctcagaggcttttctttctgtgaaattcagaactcccagaacagtgatgtcccttggagactgttttcatccatcgtcttgcctactctttggtcctgtttatttgcaactcatgttcttcaacgctgggcatttttttgatttattgctttgatttcttcytatttgctttctctctctctctctagaattctactcttggactttctggattggcactcataattttcttaaggtttctttttcccccctctaaaatttttgtttttgtttttatcttttaaattgtaaattgacaaattatacttgtacatatttagggggtacaaagtgatgttacgatttatggatacaataaataataaaatcaagttaacataattcatcacttcaaatactttaagttttttgtggtgaaagcatatgarattacygtcagcacttttgaaatcgacattattatttactatattcaccgtgctgtacaatatatctcataaaagaaaaccacattcctcctgtctaattgatgttttgtaccctttggtttttcattttctttctggaagttattctcaagtttgtcttccagcccttctaccaaggtttttctcatttctaagagctttttcttgttccctctattcctattttataacctattttttgtttcatgaatgtggtatctcctgttaactgttggaagatattgatgaggttttatttttccctgttttctttttccttaagtcactattgaggctgctctggtttgttgtgggtttttggcttttgtcagccttttctgggctatgcagtgatgttcttgtgcctgctcgtgagtcagagggcctctgagcctgtgtctgtggctgactgtggctttcactgcagaggcacctggctgggccatttccttacagcacccttgtcagcttctttgggtttcttcagattccccagagaaatatcttgtagccctttgcctggctgagtggccaagtgaggagagaggcctgggagcacagcagtaaccataaaagagcttacttccctcttttcagaattgtttccctcctctgtaactggtgtccccagtccaaagattctacttccctttgcagacagaaaagygatacctttttgccaggataggagagggactgtgcaggttggctctgtgtggctgtgcagagttgtggggtgcatcttagggatcttcgtgccttttaaacctatcagccaactctgtttttaattcaggtctcctggcttccagtcatattgccagttggccttccccattgccgatacaggattcagcccttttaggtctgtttccagtttctagcctccagtattttaatgttcttatctctattcttattctttgctttcgtgatttgtatcttaaaaaaagaaaaaatcgtttactatcattttagtggtgcttcacgaagtagtgtaaatgtattgatctgacaacggctcgtgctggagacactgttccaggaagtgggacacagtaaggaaaatgcaagtgtgttctcctgcactttcacggaggtcacgttttggtaagcggtgtcaggcagtcagcagaccagcagatatgcagtatgtccaatgtggacaagaagaaaggaggaaaataaagtatcgaggggagtggagtgggggacacagtggcagtttggcatagtggggaggccttgctgattgagcgacagttgattcaaacttgagatgagcaaacaagccatgggcagcgatctggggaagagcgttataagaggaatggacaggaggtgaaaagcacgggggcaggactgtgttgtgcacgttagaggaatgtggaacaccagttattagaccagtgtggagcaggaccagagggtgtaggagacgggcaggtcagggaagaagccggggctcctagcagtcggatcttgatgcctttggagagctggagcagagtgacccagtactggtggtggatcgtggtgaagtgaccatgggccacaccattcacgacatttcttacttttcctgtcacctgtaggaggcaagtattgttgttatcacaggtcgaggtagaccctgaggcaaaggctagagttagtggtttggctccagtttgtgccttcagctacttcactgcttccctaacctggccttgtcagtcagcctcagtctaccatctacccaggtctgcataccccgcaaaacagtatacactttgacgcttttctgcaagcacarttaccttttgggggagcccttctcttaaagcagagtaggttaatgtttgtgaatgaaacggaactttggcaggctgaggtgtctcaggtcatcagcttacgttgtctactgtgtgactaattgaggcaaaagatgtcctttttaatagtattttctcatcacttttgcctgggtgccctttaggaatgttatttttggcatacaacttgagtttcacttaaatttataattctttctgttcattcctactgctctgttgcccagatgtggattttgctttgtctcacaagcgttgctgaaacactggtagaaaggtggacgacggattggttgtgattagtttgatcttcacagtacagaaattcaaaaggtcaataagctcaacaagattgctgtctcactgatgatcagagttgccattaaaatcgtatttcccgcacatcaggctggaaaaaagaataaacatgatcattttagttgtcctcaaaggagaagaggacaggtattctgtaatcaggtgttgtgagtgtaactagttaaactctttgggaggtgggcagttttaccttggcaatatctatcaatgcattgcctgtcatcatataattccatttccaattcaatttatcctgtgggggtagaggcccaagtgagcagaggatgttctttccagcattgtttataatcgcaaaaaaaaaaaaaaattagttcaagggtcctatcagtaggggatttattaaggtatgtttactccactcaacatgtagttgttaacaaatgaggtaaatttgtatttggtactcggaaagatggccatggtgtcttttcaaatgaaaataagtgtagcagatggtgaaagaatgcatgtaagatcctatttttatttaaatcatgtattaaaattataattaaagtataattaaaattacagttttgaagatacagtttagaatatattttttggtaaagcctcatgggggggttgccagtttttacattgttttgttgagttatcttttagaatatttttaaagctaaaaaatcaagttccttggtagaccatcactacagcaagcccactgcagtattaatctattaatactgtcaatgttaattaaaccattattcgtgtagcccctacccatcccattccagtctctcaggaggcttagctgtatcccagagaccccagtgctatgaccgcaggtctctcctggggcaggaagaggtaagaagtggctgatgtcaaagtcaacagtcagcaagtggcgtgagcagtctcgatgaattctttcaaataagcgtttttcagatccactctagggcttgccttttccctctgttgtagtctcagaagttcttgaggtagaccttgtgagacctgcagcagtacttgctgtcttaggtacagaaggcaggatattgattatttctccctgactcaacaaagagttgagatgtttatccaggttaggatgacactgcccccctgtcccccccgccccccaaaaaagaaacaaaaatgaaaggatggtgtctttgactgtactgggagtcaggagacctcacttcaattttgggcttttcctcgttttttttttttttttgaataggttcagagctactccctggacctgttcttatcagccttatgacttggggacttgggatacttttttttttttttttaatttattgagacagagtctctccctgtcacccaggctggagtatgacagcatgatctccgctcactgcaacttccgcctcccgggttcaagcaattctcctgcctcagcctacctgagtagctgggactacaggcatgcacaatagtagagatagggttttgccgtgttggccaggctggtctcgaattcctgacctcaaatgatctgccagcctcggcctcccaatgaagtgctgtgataataggcatgagccactgctcccagcctgacttggggtactttttgacctgtaggatttcagctcctttcttttaaaaataagaaagctgaggccaggcgcagtggctcacgcctgtagtcccagcactttgggaggctgaggcgggcagatcacctgaggtcaggagttcgagactggcctgaccaacatggagaagccccgtctctactaaaaatacaaaactagccgggcgtggtggctcatgcctgtaatcccagctgtgggaggctgaggcaggagaattgcctgaacctgggaggcagaggttgcagtgagccgagatcacgccattgcactccagccagggcaacaagaacaagactccatctcaaaaaaaaaaagctgaatctctgagtgggtttttcatttttcatttttttttttaaacagatgcctcagaacctgggtaactcagtttatcagaaattcagttttcaagtttggaaggataacacttggagctggtagtcactcataaaacatctgattttgtgatcacgtttaagaatccatgaatgatataaaaatcctcacctattaaaactttttggccgggcgcggtgactcacacctgtcatcccagcactttgggaggctgaggtgggtggatcacgaggtcaggagatcgagaccatcctggctaacacggtgagaccccgtctctactaaaaatacaaaaaattagttgagcatggtggcggatgcctgtagtcccagctactcgggaggctgaggcaggagaatggcgtgaacccgggaggcggaactttgcagtgagccgagatcacgccactgcactccagcctgggcgacagagcgagactccatctcaaaaaaaaaaamaaaaacaaataaacaactttgtattcattgcttcctatatactagtcatcacgctatttatttctagcagtggttatcaccagggtgatttttgttacccagggcacatctggcagtgtccagagacctttgtggttgtcgtgacctacaatcatctggtggttgtggccagagatgcttacatcctgtggtacacagggcagcccccgcaacagaagtattcgactcaaaatgtcagcagcgctgaggttgaggagccctgctgtaaagggtcagtccttgaaagggctctagggtatagccatcacaggccccgtttttttggttggaaagagtagagcctggccaggtccggtggttcacgcctgtaatcccagcactttgggaggctgaggcgggtggatcacctgaggtcaggagttcgagaccagcctgtccaacatggtgaaaccccatctctactaaaaatacagaattagccgggtgtagtgacacatgcctgtagtcgcagctactcagcaggctgagacaggaagataactttaacccaggagttggaggctgcagtgagccaagatcgcgccactgcactctagcctgggagagacagagcgagactccgtctcaaaaatgaaaaagtagagcctggtagagtgaagccacttgcaggagtcgtttagttagggctgtgttgccttacagtgctggtgtcctcacagatgataatagtaataaaaaacaccacaccggtttattgtgtgccagctcgggttaagtgctgtctatgtatatgctcatggtaacacaaaaggcattaatatcaactttttataggagargagacaggcccaggaaatcaagatctgtaattatttcttctttttgttatcttggcccttaacttttagaagttcacacatttaaacattccatcttgacagatttacccagcgtttgagtgtctgtggggcttctctaaagctcagggtcaaaggggatatcctgcccacacagcactttctagttcaggagtgggaccaaccaggcctttgcagcaagataggtattcggtgctgaaatacacgctgtaaagttgtcctgtgtttcttgggattttgaatatctttcattgattcaattggcatttatttttcaccaagtacatattcagtaaatgtgttttggaaaaacagtgaacaaatcaaagtcccagccctaaagccatttaggcactcacggcctatctctgcagtaacctgctgcttgttagcactgggaccaagtccatctgtggctgccttcgggggattggcttctagtctagactcttgctgggttagtgtttccatcattctgtcaaggatccagctctaaggctgatagccacttccctgaattcatgtgatggatgcacaagcctcttggactaactcccctcttcattttactgcttccaccccaagcctgggttacacgtgaagccattggtgtgctattaatgtattggtgatgcttttacttggtttggatccctatggcttagcagagtaacttgatcatggcaggtgccatatacgtattttgagggatgaacagatagcatagtgttgattgctaaaaaggtaatgatctggccgggcatggtggcttatgcctgtaatacatacacatgcactttgtaatcccagcattctgggaagctgaggcagggggatcactggagcctaggagtttgagaccagcctrggcaacaaagtgagacccccatctctacaaaatatagaaaaaagttagctggacctggtggtgtgcctttgtggtcccagctactcaggagactgaggtgggaggcacgtttgagcccaggaggtcgaggctgcagtgagctgtagtcacaccactgcactccattctgggtcacagagtgagactccgtctccaaaaaaagaagtaatattctgaacttgtcctttcttgactttttggtgaattataacgggctgccagaatctagatcagctttttaggctctgagagatatgcttcatgtagaaataatccagtctgaaggccaggtctcaaggtgtcacttttgtattcttggatgactgttgaatgtgtggtctcgacgaatggctttgtggagcagctttctccagagacttgcatgtgcttggattaacaaacttgcgatccagggatgctaagcaggtgccttctgtgaccaagctcagtattgagggcgctgctgtccttgaggcagccaagtgttcttgtatacagctgtgttgtgtagcaggttaagtgctgcctctctcctgttgcttgttttctgtaatatgtcacctttcttggcatgattcctttgtccagtcttccagcgtcctgttgtatrgtgtgggtgggctggggactgcataaatgagttggagcagtgatgttcttggccttgctctgtcctgtgagagaggaccctgcaccatctggggctcctggagtggcaccctgcaccagcaggacgcagctcttcctggcccttctgtcggcctctaaacacagtgcaggctgactttcttatcacagctcgtttggctggctggaccaaatgctrcttgtttctttctggagtggggaaataacttcaaccaggtgcagtcagtgtgtattcttatctcagctgcaaaagctgttctaaatgcccttctagggaacttttgcggtgtgaatttagtggttgtgctgcgtgttagtcctgcccaacactaggcccaggcagctagagttaagtcgttgggcattggtagggcactgtgagcaaagactctcttacctcgggccaggcagagaaggacacagtggctgagctcacctgctccttggtcatccttcaaacctctgagtgtgtgtggttccttggggagagaaagcagttttctcgtgggtgccaagacagcagctacctgcatagcaactgctcctggcctagtaggagatttacatgtggagactctggagagagctgcacttctaaaggggttgccacaacagacagccttaggggaaatggggaaactggagaaaagggctcttatcccaaaaggaccagatccattggaacagatagaggtaaggaggcaaagagaaagcaacagtacaagtgtaaaattgggagaaatagtttttaaagggggtcatttatttggcacttttaccaatttgttttgaaacagagtctcagtctgtcgcccaggctggagtgcagtgctgtgatcacaactcattgcagcttctaactcctgagctcaagtaatcctcctgcttctgccgagtagctaggactatagggtgcctggctaatttttattttttttgtcaaaatggaggtttgctatgttgcccaggctggtcttgtactcctggactcaagtccttctgcttcagcctcccaaagtgcaaagtgctgggattacaggtgtgaaccacctaacctggcctctagtttgtttgtttgacacagggtcttgctcagtcactagttggagtacagtgacactatcatagctcactgcagtctcgaactcctgggctcaaatgatccttttgcctccgcctcctgagtagctgggaagcatactacaggcactgtacctggctaattaaattttttttttttttttgtagagatgggagttgtggggggtctcactctgttttgctatattgcccaagctgatcttgaacttccgacctcaagcagtcctcccacctcggcctcccaaagtgttgggattacaggtgtgagccactgtgcctggccctcggcctcttttaccatttttgaaattgaggttttgaaacaagtgacttgctcagaaacagttttaccccttagggcttccttttcaatattataagatgtatggtttctgatttatttattagaataggaaactttttgccttaaatctttttcttgaaaaattaaaaaaaaaaacaaaacgaaaggaaaggatggccctttgggatcttttctgcctgtctgctgtaaccattcgacagttgagaaccatgttgcttggtgtcttgtagcttgtaaatagaagactgaagtgtgtgtgagtagaaccttaaaattcacttttcctttgctttgtcttctttatgttggagtttgcttactcctgagtgtatattattagatgattacaggtgtgtagtattcaccccagtatttgctggctagtgtgaacaaaatgaaatacactgcatcatccgaatgtgttttattttgtagcaatgtgtatattactcttaattttcactcttcttacgtgatatgctttctaattttattaatacctagctcatttgactgtttcaaatgatattactgatttaattatatttactttttaaacatttgctgataagtagacgattaggtggtcttatagcattggtttaaatcagtatgtgtgyggccgggtgcagtggctcatgcctgtaatcccagcactttgggaggcctaggtgggcagatcacgaggtcaggagatcgagaccatcctggctaacacgatgaagccccgtctctactaaaaataccaaaaaaaaaaaaaaaattagccgggcctggtggcgggcgcctgtagtcccagctgctggggaggctgaggcaggagaatggcatgaacccaggaggcggagcttgcagtgagcagagatggcaccactgcactccagcctgggtgacagagtgagactcgtctcaaaataataataataataataataataataataataataatagtatgtgtgcatgaaatcagttcactttgaagaatacaatttttttcttttgaaacaaggcttctattttgatctaattgctcatgcttggagctgcctggccagcccctgagacccaagttctgtgttccctttgtcgtctgcacaacgagctcagcagactgctggctgcgtgttacagggctctggggtgtccccgggttcagccctactgtctcagagagaggaggacctggcctgtgaaggactgaggtggtgatgtgaaggtcttttctccatcaaatcttgcgccagttaccttgtatagtatttagattgttgttatcagttggtcatatggctttattgaaggctggtttagcatatttagaacttatttggcatgcattaggattcttcttcttagagtattttaattccagtatgtacttatgcttgtcttctctacctgcccccagtcttgaagtggtggaaatgtgtgtgtgtgcatgtgtgtgtactttccttaagcccttgctgattgatgcagtcacttgctttcaccctgcttaaatattcctaattctcgctgggcagtgttcctgttacatgtcgtgggttactccgatttgcctagtgtctgagttttgcctcttgttcgtcttttagggcagtgtacgactggggctcagcagtgctagtggctggcccagatggagcaccggggggcgcccgccttctactaggaagaactgggcggggtggggggagttccccatgtggacctcgaagttgtttgggatgtgctgctgtgcatatctaggttgtgctgtggctttcttgatgctttctggtggtttaaaaatctactttctcatgaaagaacgtgaaccagaaaaaaaaaatcttttatgaagtttgagaaaatgattgggtgacagactttagaatcgtgacaatatgctttgctacataaagtttgggtgcaatgtgcattcattttgtagttgaactcgtgattaaacagatatagtcaaaatttgttttttgtttgtttgtttgagacggaatctcgctctgtcccccaggctggagtgcagtggtgggatctcggctcactgcaagctctgcctcctgggttcacgctgttctcctgcctcagcctccccagtagctggaactatgggtgcccgccatcatgtgcggctaattttttgtgtttttagtagagatagggtttcaccgtgttagccaggatgatctcgatctcctgacctcgtgatccacctgcctaggcctcccagagtgctgggattacaggcgtgagccaccgcgccccgcccaaaatttgggttttgactttgaactggaatggtcagtgttatctgccatccctctcctatattgatgtttatttccaaattagggtgtttagttttcctttcyttttttttttttttttttttttttgagacggagccaggctggagtwcagtggtgccatcttggctcactgcaacctctgcctcctgggttcaagtagtgattctcctgcctcagcctcccgagtagctggtactacagatgcacgccaccatgcctggctaatttttgtatttttagtagagacggtttcaccatattggtcaggctggtcttgaactcctgaccttgtgatccacctgcctcggcctcccaaagtgctgggattacaggcgtgagccaccgcgcccggccttagggtgtttagtttttctaatcacagtagtagtacatatcctccattaatttttttaaaaaacgatcctgaatttacagaggaggtacgggtaccgtacagctctttatctgaaccacctgagagtaagttgggactacgaacctcaccctgggatattttggtatgtttacttatagacaagacaccttcctccttaaccgcaatacagccatcaaagtcaggaaatcaacatgaatgcgttgccgccttctgatcaggcagcgcattctcattccactgaaaggatctagttcagaaccacagttcattgtcagatctctttagtctctttcaaactggaatggttcctctgcctgagcttgacacttttaatgattaccagcagttattttgtggggtcccttattgtgggtttgtttggtgtttccttttgattagatctaggttttgcgcctctggctggaacagtacaaggaggaggctgggttcttctctgcatcctaataggtggtgcagaattcagttagtccccttagtggtgatgtgcactttacttgcttgattcaggtgctgccttccagcttctccactgtgaaatctttgtaattgttaagtatatagtagggagatacttttgaaataaaatcaaactttcagttatctcaactatctcaactttaatcagagttcaatttgcttatttatgtcaatattggctcatggtttccccagttaattcggttgattgttacccttttgccatgactttatttgatgttcatcatctcaggtttgcccctgagagcccctcaagctcctgtgtcctttatttatttatctatttatttttttcattattattattttttcagactgagtctcactctgtcgcccaggcaggagtgcaatggcgccatctcggctgactgcaaactccacctcccgggttcaagcgattctcctgcctcagtctcctgagtagctgagattacaggcacgcgccaccacgcccagctaattttctgtatttttagtagagacagggtttcaccacgtggcccaggctggtctcaaactcctgagctcaggcagcctcctgcttctgcctcccaaagtgctaggattacaggcatgagccaccatgcctggcccttttttttttttttttttttttttttttttttttgaaacagggtctcactctgtccaggcctggagtgcagtagcgagctctcggctcactgcaacctctgcctcctgggttcaagtgattctcccgcctcagcctccccggtagctgggactgcagatgtgtgccaccacgcccggctaatttttttatttttagtagagagaaggtttcaccatgttggccggtcttgaactcctgacctcaggtgatccacccgccttggcctcccaaagtgctgggattactgtctgtgtccttctgatatgtcctcattattctctgtctctttctcttctcttctctttctttcttgtaccacaggatattctgggctcttcatgtaccttccctgccccagacctggattctgccttttcttcaagaaggcctgcttcccttttatggcagttggctctcagagaaacagggtctaggcaccagctaggttgctggagtgttactatacccaggccctctcagtcaacagagtatgtgtatacatacatatacaaaacatacctacagctacatgcgtgtgtatttttaacacagtctcattttttaatatctccatgtattgaaaagcatgagtttattccagtacccccatttccaatgtagtagcacagggtttattctagtttctcgctttccaagtggataactccgtttcccaacagtgacaatcttagatcccagtgtctctaatatgtttacttccttgattattcaccctgtatggaacgaggctcctcttgttgaccttcctgctcggatgcccgctgcctcctcatctcactcagctgctgtcatcctgcacctccacccaccatgagcatcttcctcactccacttgggctctgataccctagctatgtagatattctcttatgtggaagcccgtatccccagtttaaaaacaaaaaaagtccaagtcctacacgctctctttttgcagcttgatcattttcatttaatgtacagtagtctgtgctttttccagactgatacgtgagccgttggattcttgttggtaacagcgccttactgtgtggtgtccttgtcccacttagtatgactgccttcgtgctgacgcacactcgtgttcttccagttctttgcctgtggcatgctgttgtgagcctcacctgtcacacctatgcttctgtattcttttgcaggcacttctggagagtagcatttttgaagtgtgattgctgacttagattgtatatttctattttttgttatgtgtttctaaattgccttctaattttatacttcctcaatggttgagtagtcttttttccccctcaccattataaacactgaatgatcacttttgttcatctttgcggatctcataaaggctgcatgaagatgaacatctattcgtgtgtttgtgggcaattttatgttaattttctgtgatttgtgtgttcatatgtcctaacctattcagatgttttccagacattgaaaaactccatttgtatcttgacttctatattagtgttctataaaattcttatgctctgatagggtcaaataaatcaatatcttcctcagtggtttttacagtatatgttgttggagactttttgcagccccaaatcacaggttttcctccttaatcttcagggcttcagggtttgattgtttacatccagatctccaatccagctgaaatttattttagagtatgttgtgaggtagggatcaaactttatatgttttcaaaatggataacaaattggcccaattccttgctgatttgaaatggcacttgtatcaaataataaattcacaggtacacgtgagtctgtttcatgcatcaagtgcctctttcttagccagtaacaccaagtgctaattaccattgctttgtagtatgctttgctaattttagttgaatcccagcttttttttttttttttttgcaaaattttctagcctggttttatgtttaggtgaatttttaggagaatccttgttagagttaaaaaaatatcctactgggatgttgtgttactttcccagggctgccgtaacaaattaccacacatttggtggcttacaacaggaatgtattctctcgcagttttggagactggaaatctgaaatctggcagggccacactccctctgggggataggagagagattgttctttgcttcttcgtcttccagctcctgccccacagtccttggcttgcagctgcatggttcccacccctgcctccctcttcacgtggctttctcgtctgtcacgggtggcatttagaacccacccagataatccaggatcatctcctcatcttagtatctttcacttaatgtcatctgaaaagaccccttttccaagaaaagtaaaacaaatttcagggattgggattccctatctttgggtggccatttttcagcctatcacagatgttatttggagtgtgattgggggtgtagatgaacttggaatagaacagacatcttttgtgatgaatctcctggctaagtcttggcatcatctccatgattcaggcttctcgtgtatatgtgtgtgtgtaaaatttttgttttgccaacttgccaagcttgccttcactgttactagagcttcrttataatagagaggttttctaaacaggtcatctgcagacagtggtatttgtctccttgcttcattctgtctctttagatggcctattggacagtctttgacaatagtaacatcttggtcattctgttgcttattttaatactatactattagctttttagtaaatatgttactttggggaaatattgttcatatagccatttgctgatgttaaactccatagaaagtaaataatacatgctgaatttcatcagttttttgggcatttttgaaatggtcgtcggtcagccacgtatatgtttatttgtcctttttttctttgagacagagttttgctctgtcgcccaggctggagtgcagtggtgcaatctcggctcactgcagcctccgcctcccgggttcaagagattctcctgcctcagcctcccgagtagctgggatcacaggcacccaccaccatgcctggctaatttttagtgtttttagtagagatggggtttcaccatgttgaccaggctggtcttgaactcctgacctcaggtgacccacctgtctcggcctcccaaagtgctgggattacaggtgtgagccactgggtctggcctatttgtcctccttttagccataagtatatattttctaattttaaaactgtatccctagaacagaccattcttagtcatgatgtcttgttctctaaatttagtgatcaattaattaggctcgtgttttgtttaaaattttacatgttttctagcttgggcaatatagcaggacctgtctcttggagaaaaaattagttgggcatggtgtacgcacctgtagtcgcagcgccttaggagtctgaggtggaaaggatggcttgagcccaggagttcaaggctacagtgagctatcttgcatcactgtactgcagcctgggcagcagagcgagactctgtctcaaataaataaataataaaataaaatagaaatttacgtgtctgtagaatagtctataatgattaatctctgcaacatctactcattgttttgggaagacaaaacaatgccgattttcctttggggaacaactctttctaccatgtgtaaaccatgtgttttagatagaatggctcagctgcatgggtggacctggttggctgtggctactagacataacacatgcccttggccccctgattatagttattggtccctaacgagatcagaacccaattaatgccaatgagttacaaaaataattcgtggcacccgtgagacaaagaagctcttatttccttgggagctaccagaagatacaattactgccatttataacacttcttatttcaaaaccaggcaaagataatattgtatcattgtaatctcgggtgtgtgttcttttcttttgtcaggctagagagagttaattgctcttcaattgcttttttcaaagaaactgattttgcttttgattgaccaagtagctatgtttctgtttttgtttttttttttttttgaggcagggtctcgcaccctcacccaggctggattgcagtggtgcaatcacggctcactgcaggctcaacctcctgggctcaggcgatcttcctgccgcagcctcccaagtagctggggactacaggcacgtgccaccatgccaggctaattttttgtatttttggtagagatgaggtttcgctatgttgcccaggctggtcttaaactcctggactcaagcgatctgcctgcctcagcctctcaaagtgctgggattacaggtgtgagtcactgcacttggcctgttttgttttgttttaattttttttgaggcagagtctcgctctgtcacccaggctggagttcagtggtgcaatcatggctcactgcaggctcaacctcctgggctcaggcgatcttcctgccccagccttccaagtagctgggactacaggcacgtgccacccaggctgggagtgcagtagcgtgattataactcactcactgtaaccttgaactcctgggctcaagggatcctcctgcctcagcctctcagtagctgggactacaggtgtgtgccatcatgcatggcttttcttattttattktattgtattttttatttttttgtggagatggggtcttgctttgttgtccaagctggtctcaaactcctgggcttaagtgatcctaaagtgctgagattacaggtttgagacactgcacctggtcttatatttcatcaattcttttgttccttctactttggttttcactttacatcttgacttgaatgcttagttcattcatcttcattaataaagtttacaagtttgattcaccctgtgagtgtagctttagcagtgctctgtagacgttgataagtggtcctctttgctctttcttcttttctgagacggggtctcgctttgttgcccaggccgagtgcagtggcacagctcactgcagccccagcctccccgcactcaagtgatcctcctgcctcagcctccctagtagctagggccacaggtgtacaccgccacacctggctgattttttgttttctatttttatttttgtacaggcagtctcactatattgcccaggtttcttttccttttttaaaccttgttgggaaaacttcaaaatataccacaaaataaaagagaatagaagagaatcatatgcctgtcacccagctttcacagttgtcagcattttactatagccctgcccactcccaatattttatatttttcatttgagtattttaaagcaaatctcagacttttagtcacctctaaatactttagcatgtattttttaggaaacggctttaaaaaacataaccacaataccttcatcatagctaacaccaccaaccacgctcattaatattatctaatatttattctgtgtttggttttctccagatgtcataaaaagcctttttacactttgtttgcttgaattgaaatccaaagaaggtctccacattgcatttggtttaagcctcttagctctttgaaaatctatagcttgcagcttcttttcccttttttagtttttgtttttaatgccatttatttatgaaggcaatagggttgtttgtgctgtggaacgtcccaggtttgggatttggttgactgtgttgtggcactatctaatgtgtttttctaatcctcatacttcctgtagctaggtcaggatgcttaattggtttcaggctgtttgttgttgggggggtggggggcagtggtttcaaggatattccacagactgtgctctgtgttgcacgttgagcagccaggttacatgatgtcgggtgcggtgtcagtaggttgaattatagagttctttatcaaccagttctctactgggtttaacggccatttgcttgttgcttgtacccgttatttagttggtgtattactttcctattgctgctgtaccaaattacaacactgtggctgaaatcagtctcactggtctagagtctgggtatctgggtgccatcaggcagctctggagagtatctgcttcctggccttttccagctcgtggcagccattttttggctatggccccttcctccatcattagagcacatgatctaaaggacacttgtgattgtggttacgtcccacccatataatccaaaatgatctcccatctcaagattcttaattcatctgtaacatatccaaatccagaaattaggacttgaatatctttggaggccattgttcagcctacagctgacaattataaagtgaagatttttctaattctattcttatttaaagaagatttcctgtatcaattttggaggttctgaaatgtggttcctgctggggagaaagaagaaatgaatgatttctttcctttatcagtgtttaggatgcactggaactaatagcttccaaagttgaagttcatttctgtagcatttccccctagtactataaacctggggatgtgattgtgcttcaacccgtggaagccgtattttggtgcttctgttgttctacccaagttggcttgtgtcatctttgggtgtgactccttggtttgtgactgctccctgcctgcctgtcacaggagggtgttgtacctcgtccgtgttctgcttagacctagagtcagtcatgtttctaaggaaccccagtctcttgccgtgagatggtgtttatatatcagtcagttcaatgtgtatcattttcttaggctaaaatcttggttcttaatgatattaactcgcttacctattctaaattttgtgactctgcttttcactgatttgtagtagccgacgatgcttaagcatcttttattccctttctagatggaggcatctttgaaaagtaaagcgcctcgtgtgatacagagcttcccctcctgcagataastctcacaaacacttagcatgtgtctgtccagagtttcctgttaaaacacactttcagaggcgtgtagtgtatgaataagtgccattttcatggcacatatttttcatacaatatattcttacagtaacgatactgacattattaggatatatcccatttggaatatattgtcaaattattgtgttttaaagttaaataattctctgatgcttaggccgccgctctgacattgttagatacatttgtttccattttctaagtagactttttattgaggtataataaacatgcactttttaatgtatatagctcagtgaattttcactaactgaactcactcatataaccagcattgagataaagaagtggaacgttttatttttagagtttagagtctgatttttttttttttcctttgagacagagttttgttcttgttgcccaggctggagtgcaatggcgcgatctcggctcaccacaacctccgcctcttgggttcaagcatttctcctgcctcagcctcccgagtagctgggattacaggcatgtgccgccacgcccggctaattttgtatttttagtagagacggggttcctccatgttggtcaggctggtctcgaactcccgacctcaggtaatccacccaccttggcctttcaaggtgctgggattacaggcgtaaaccactgtacccggcctcttctgatgtttatggttctaaaacagagctgttactcttgttctgctcagatgagcttgatttccatccctgtcccctgtcccttctttccttaccccaacattttcttcttgtttctttctgaaaatataaacagacatacacatttctatttctgactctttcttacagaaaggtagcataccctgcacctgctggcctccgttgctcttttcattaactgtgtaccccgaagactatgcatagtagtgtatggaggctttccttctaccttttatgctatgtgttgcttcactgcatggacacaamgtggtttcttcagcccatctgcatattgaagttgtgttactttccagattttttttttttagctttttatgtctcgctatctctgctgttgcccttctgaagtccattcatcccacacgtgcagtagctggagtttcctttttatctaatacttgagtttcccactgccatactcaccccacgttgatgcctaatgtcttcttgaggtttcctttagagggcactccttacctttggtgccagccattctgctattctgatcctacttcccctcattactgatcttccttctctgccatcctgaccccttcctgtccttggatgcctttggagttgcagagaagctgtctttatcttcctggtgtgatacttgttttctaatagtaggaaatagtgttttcttgttctgcccagttttctctctttatagatgagacatctaagttcctgctccctggatgtatgtcagtttttctcttacatggtaatgttctgatctgagtccggtatctccattgtctaactttgcatagaggaacatacctgtgctttggtggggacgttgtgcttgtattcgtgcagtttaatgttgaattarctctttgtggagacagttatataagtaagcgtttctagggagtctttatatccaaaagtgaggcttaatctctgaagagtagactgataggaagagagtacytggagagatgatgcagtcccaccttctcatgagacaaaggaggaagcaggccaagtgaagagggtgatgtgccaagcagtgtcagcagcagatcgcacattggagtgccacatgctctccacccttgagaggagaaaacctgaagacttgggttttcctgatgtgtgttttcttgtttgtagaaaagtattgtttctatttggataggactgagcccaagattaatctttcagattcttaagtattttccacccatggcgttagctagctttgtatccataacagagttctttataaacatgagctaagctaattctagctcatagaactttcctatgtaaattgtaggaaggaaaaaatcatcaagtgtaaattgttgccctgggtcaaacttcaaattattttgtttcttgtagtttaatgagatttatagtgaggagatggaagggatttttaaattgcaggactaaaggggaatggcccttcctacagccattctgttcccatccccttcccaggaacaccattacagttggggtgggggcctgcgtgggcttcaagccctggtgaggagtatgtgtgtgtgcaggagctgccatgaaacacctttcagcggctcagggtggcagactagtgttaccatggcagttagagacatcagtaaacccatgggtcatacggatgcatttccacctagaagcagtggtttgtttcttcagtgagtcaaagaaacttaagatggaggagaccctaaggagtcatgtaagttaaatgatcacccagtggagagtacacttcacagtgggaataagctctgcccattttttttcctaggtgctaattcaggaaagcatgctcactcttagtgatccttttcttcatgttgagatgaaatgtgtcttcagaattgttcttagttgttcttggttgtgcaggcaactggacagaactcagtccccctttaaatgctctccacatggtaaagacagctcttatgtatcttgttctcagtttccaaggcttgaataggttcatgtaaagtcatcaccacttcctcaaaaggaaattaacaaaaaaaaattttaattcagacgtcttgcagataacgtggcaattgtratgagaatagcacagcagagaaaataaattttgtgactctgtttttcactgatttgtagtacctggtgatacttaagtgtcctcttttccctctccaggtggaggtatttttgttgaaaagtaaagagcctcatataatacagagctttccccttctgctgataactctcacaaacacttagcatatgtccatccatagtttcctattaaaacacactttgggggtatgtggtgtaggaatatgtgccatttttcatggtcttccctcccgtcttcacattctacagcttcacagcagaattgtcttttcaagtccatcttttacccagctgttcatgttgatgcttgttgaggactgggctctggacttcctgtccttttgctattctcaatgacttgagtttccttctagagaggtcttatgcatgtacaaacatgtatatcttttaacacgactggttacatatcaacgtaacacatagctgcaggccaggcgcagtggctcacacctgtaatcccagcactttgggaggccaaggcaggcagatcactgaggccaggagttcaacrccaacctggccaatgtggtaaaatcctgtctctacaaaaaaatatacaaaaattagccaggcatagtggcgcacacctgtagtccagctacttgggaggctgaggtgggagaatcgcttgaacctgggaggcagaggttgcagtgagctgcgattgtgctgctgcactccagcctgggcaacagagtaagaccctgtctcagaaaaaaaaaaaaaaaagaaagaaagaaataggccgggcgcggtggcttatgcctgtaattccagcactttgggagacaggcgggtggatcacggtgtcagragtttgagaccagcctggccaacaatgtgaaaccctgtgtctactaagaatacaaaaatcagccaggtgtggtggcgcacgcctgtagtcccagctactcgggaggctgaggcaagagaatcgcttgaacccaggaggcggaggtttcggtgagccaagatcacgccactgcactccagcctgggcagtagagtgagactctgtctcaaaacaacaacaacaaactgcctcttcttgttcactgacactgggtgtatggttaaagcccccttaactgacctgttttgaggcacagaggtttatttaatcaccagtcatttgatacagggtgaagacctatttgaaatgggactggctggattctacatgttttctttttttttttttttggaaacagggtcttgctgtgttgtccaggctggagtgcagtggtgccatcatggctcactgctcaacccctggggctcaggtgatcctcccacctcagcttccacactgagtaactggcactacaggtgcatactaccatgcctggctaatttttatttttatttttattttttattttttggtagagacagggtttcaccattgtaaacccaggaaatctgacaagtctcagttaatttagaaagcttactttgccaagggtgaggacgcgcacccgtgacccagcctcaggaggtcctgatgacgtgtgcccaaggtgggcagagcacagtctggctttatacattgtagggagacatgagacatcagtcagcatatacaggacgaacattggttcggtctggagaggcaggatggctcgaagcaaaggcaggaagactccaagtggggaggggacttccaagtcacaggcaggtaagagacaaatggttgcattctttggagtttctgatgagcctctccaaaggaggcagtcagatacgcatttatctcagtgaacagaggggagactttgaagagaatgggaagcacgttggccctaagcagttcccagctagacttttccttttaacttagtgatttgggggccccaagatttattttcctttcagactatgttgcctgtgttggttttgaactcctgggctcaagcgatctacccacctcaacctcccaaagtgctgggattacaggcatgagccaccatgcctggccacatactctcttcttatgtaaatgaaattgataatatgtcgtctaggattttcagcattcatttaagtggaacaaaaatttaagaaactcataatcagtgtagattctctgagattttaaaggttttcctccatttgactttttcttttaaacaaacaggtcttgctctttttcccaggctggagtgctgtggcacgattgtaactcactgcagcttcaaattgggttcaaatgatccttctgcctcagtctcctgagtaactaggattacaggcacaggctaattgtttttattttttatttttttaagaaatgagktctcactttgttgcccaggctggtctcaaacttttggcctcaagtgatccttctgccttggcctcccaaagtgctaggattataggcatgagtcaccatgtccagccataatttttttaaggcaacttgtttttcttgaaatttcagtgtggtaaatttaatatccatagataaatttctcttcactctttcattattttgaattatttctaaatgtagttacattaactagtgaaactggcataaacaggtttgagagcaagtaaaactgagtcttactaagcacacatcatcactggtggggatcggtgttcagggcacactagaaggcactctgctcatgacatcaattaatattttactgtgggggtggagacttggtcattcatcaggtcgtttatggaggtcagtgatagtgctttgtgttctgccaccctttgtttacccagtcccggactgaaccaatgcaaatgtttaatcttctgactctacaaaaatgctacagtgcacatcgggcacactgcagagacactgcaggtttgtgataccaccacaagaaagcctgacatcccaataaagcacatcacatgagttttacgtttcccagtgcatataaaagctgtaacatgtttagaaaaacaatggtatatactttaatttaaaataatggttaaggctgggcgcagtggctcaggcctgtaatccagcacattgggaggccaaggtgggtggatcacctgaggtcaggagttcgagaccagcctggccaacatggtgaaaccccgcctctactaaaagtacgaaaattagctgggtgtggcggagcacacctgtaatcccagctacttgggaggctgaggcgggagagtcacttgaacccgggaggtggaggttgcagtaagccaagatcaagactgtgccactgcactccagtctgggcaactgagtgagactccatctcaaaaaataataataaaatattggttaaaaaatgctcatgatcattgagccttcagcaagtcttaatctttttgctgctggaaggtctcgctttgatgttgatggctgctgactgatcagagcagaggttgctacatgttggggtgactggcaattttgtaaaatcagacaacaatgaagtttactgcattgattgactcttccacaaaagatttctctgtagcacgtgatgttgtttgattgcattttcccacaatagaactactttcagaattggactcaatcctctcaaacactgccattgctttatcagctaagtttatgtaatattctaaatcctctgttgtcatttcaacaatgttcacaacatcttcattcagcatctacttcctgagtagattctatcttaggaaaccactttctctgctcatccataagaagcaactcctcatctgttcacgttttatcatgagattgcagcaattcagtcccatcttcaggctccacttttaattctagttctcttgctgtttctaccacacttgcagttgctttctccactgaagtcttgaacccctcaaagtcatggcatccggaatggtgaatcctttacaggaggttttcaatggactttgcccaaatccatgagaggaataactatctatggcagctgtagccttaaaaataatttcttaagtattaagtcttgaaagtcgaaattacttcttgatccatgggctgcagaatggctgttagcaggcatgaaaacaacattcatctccttgtacatctccatcagagctcttgggtgaccagatgctttgccaatcagcagtaatgttttgaaaggaatcttttttttttttctgggcagtagatcttaacggtgagcttaaaatactcagtaaatcgttttaaacagatgtgctgtcatccaggctttgtttcattcatacagcacaggcagagtatatttagtgtaattcttcagacccctaggattttcagaatggtaaatgagcattggctttaacataaagtcactggctgcactagcccctaacaagagagtcagccttttgaagctttgaaggcttctcttagaagcgatctagctattggctgggcgcagtagctcacgcctgtaatcccagcacttcgggaggctgaggtgggcggatcacgaggtcaggagatcgagaccatcctggctaacacggtgaaaccccatctctactaaaaatacaaaaaattagccgggcgtggtggtgggcgcctgtagtcccagctactcgggaggctgaggcaggagaatggtgtgaacctgggaggcagaggttacactgagcagagatcatgccactgcactccagcctgggccatagagcgagactctgtctcaagaaaaaaaaaaaaaaagaagccatctagctatcaaagtccttagatggcatcttcttgcactatgaggctgtctcatttacactgaaaatctgtttagtgcagctactttcatcagtgaccttagctaaatcttcataactcactgcagcttctacatcagcacttgctgcttcaccgtgcactttcatgttagagagatcttaaacttcaagaaccaacctctgctagcttgagacattttttcctgcagcttcctcacctctctcagccttcatggaattaaagagagttagggccttgctctggattaggctttggtttaagggaattttgagactggtttaatcttctagccagaccactcaaactttctccttatcagcgataaggctgtttcgctctcttaccatttrtgtgttcactggagtagcacttttccttcagccttttttctttgcattcacagcttggctatttggtgcaagaggcctagcttttggcgtgtcttagcttttaacaactcttcttcacgtgccttcttaatcatttctagcttttgatttaatatgagagacgtgcagctcttcctttcacttgaacacttagaagcaattgttgggttattaattggtttcccctcaatattgtgtctagggatcgggcggcatgaggagagggagagagatgggagtggccagttggagcagtcagaacacacacagcattgattgattaagttctctgccttgtatgagcgtggtttgtggcactccaaaacaattacagtagtaacatcaaggattacagatcaccataacagatacaatgacaatgaaaacgtttgaaatattgctagaattaccaaaatgtgctgttggaaaagaggcatggaaagacctgcagagttgccaaaaccttcagcctataataaacacaatgtctaaaaaacccaagtaagagaagcactgtaagctgaagtgtgcctctatctttgggcacatgtgtgagaaattcttagaagtaggaagtgttagatcaaagaatattgatgttttaaatctcagtccacaatcaaatatgtacgctctccaaagagaccacaccaattattcctccagccacacctgttttcccacacttttttttgagtcttcagattttatttttgccaaactgaggtgaaatgtagaatcttattctacttttcacttgcattttaaaatacaaattgaataaatgtttcctgcatttccatgaaaggcctgcttgtatcttttgcccattttttaaaaatgggttattaaagagtcctttaggaaatactgtaaacgtaacgtgctcctcttttccccagaaatgtttgagcctgccacgtgtgccatgtttgtgtttgtggtagaggagatgctttcatgattgagaagaagacgcattttatactctttycccctaatgtaaatttattcattaaacacaaaagatttgtaataaaatattttttccttaagattgttatataaagtttactaatgagaaaaactcccttgtcagtttatagtttagctttggtttgaaaatacagacactgtagcactgctgtccaatatgagccacatatatttaaaattttccaacatctgccttaaaaatataaaaataaacaagtgaagttaattttaataatattgtttcacccaatgtaagatactaccattttacatgtaatccatcctaaaactaataataaaatgttttagatagtatttcttgtactaaatcttcaaaatctgatgtatattttagacttacagcacatatcattttaaactagccacgtgtgaaggctgtagtgacatgtggccagtagatgttggccagcacagctcaaaagagtagtctatttctatgaaaatccatcaatttattcttttggacctaacatttgtcctatcctcttttttatttttttgagacagggtctcacttggtcagccaggctggagtgcagtgtcacgatctcaactcattgcaacccccacctcctaggcccaagcaattctcccacctcagcctcccgagtagctgggattacaggcacgtgccaccatgcctggcttatttatttatttatttttaagacggagtttcactcctgttgcacaggctggagtgcaatggcgcgatctcggctcactgcaacctctgcctcccgggttcaagcgattctcccacctcagcctcccgagtagctgggattacaggcatgcacccccaagcccgagtaattttgtgttttagtagagatggggtttctccctgttggtcaggctgatctcgatctctcgacctcaagtgatccgcccacctcggcctcccaaagtgctgggattacaggcgtgagccaccgcgcccagccccccatcttattaagaaaataaattgtatttatctgacacatgttctttaattaggctctaagtaaatattattctttactcagctgtagaaatatgtgctgattgtttctgtatttgtaaaattaatgtagtggcatactccactaaatgtattaatttagtggaaagtagtgagtttagtggtttagtggaattaaatgttagcattcccaaacagtgagatacctattaaagggcaggttcttttagataccattttccttgatctttttaacaacttgcagaaaaggccccaaaacttagaaatgtgaattattaaagttgagagcttaaacaactagccaaggtgacccaaattatatctgagcaagattctgaaagcaggtatcctggcaacaagtttggtgttctttatacaatttgttctcattataggtgcctataatgactcggataaaacacaagttacgtattttcaccttacctagaaatacgtgaatcaaagaaataagccagagaacagtgtcactggagaatatactaagttaccttttctgttacttcctgaaaagtagtgaaactgacagaattagttagtggagaaagaacaaggcaaatttacaggaaaccctggactgcaaggtctttgtttctgtctcatctgaactttcgtgagactttattttagggctgggagtttaatgtaataatatatactgtaatatatattagcagtaaatacatgtgagccaaagaaaagttgttccttattagaatatgctacaagtcaaattaaactgagtataaataagcttaattataaaattagtttgtgctaataaaaatgtaatatgagccacatataattttaaattttcagctttcaaatgggatggaaacatttctttgacctgactttgaccaccacactcagtatgggagtgcaaattgtgctaaacttagctcccatcccatggtgccaataacttcctataagactgcactgctgccaaggaagtggtgggcgcctgtcctccacatctctgctcccacagccttggagatgacccctggtccgctgctcctcctaaccccttcagcatggctccactgcagcgggttcctgtcaggtgataagttaaagcaaagagaggagtaggctgcataaattgtatacctctgtttatccatgttatccactgacaattaggttcttaaaaatttgttgactattactagcagtgcagtgagatgagcattcttgtacatatttccttttgcccaggaaagctttttcctgaagtacgtctccagaagtgggatcgttcgctcgtggagtatttgcttcttaagccttaataggccttgcaaatggtgtcaaataaggacctagtttttccctcctactgtagataaccagttttcccagagccattgattgcatcatccatctccctgctgatccacacgaccacatctgaggcaggcaatgtcagtgtctgtggtgtctgcgttgggcccactctgctgctcccttgttctctgtgtctgtccccggcactagcaccacagcctgaattactgacactggagagagcaagccctcctccacgttgttttcttcagagttatattagctgttcttggtccttgatcttttgtataaattttgttgtgtaaatatgattgtatttgtaactattctaaaaatggtgtatataaatawttttttttacaattcagtgtttgcaatgcaacattataaaaattacatatagaaaacttgtataaataaaaattgtataaaatctggttgtaaaattccatacacacacataccttttgggatttaagttacatttgcattgaatttctagtctaattaggggagaattactatccatgattaagtctttctttagatgaccatggcctgtctccatttattaaggtcatttctgtattttgacaaaggtttttataagttctataaatcacattttttttcttaattagattttaaaaaatttttttagaggggtggagaggggacagagtctcacgctgttgctcacgcggcagtgcagtggcgtgatcttggttcactgcagcatccgcctcctgggttcaagcgattctcgtgtctcagccccccaagtagctgggactacaggcatgcatcaccacacccggcttagatttatttttaatagtttgttgctggtgttttggaaacataattgattgtgtgtattggttttatttccagaaaacttactgaactttttaattagttctaatagtgtgtccatacatcctcctggattttcttccagcacagttatattgtctgtgaatactggcagttttggttcattttcaattctggtaactttcttttcttgccatactgccctggcttatattcctagttgctattaggaatgggttaattagttgagattcttcatttgaatttttttttttttggagatggagtcttgctctgttgcccaggctggagtgcagtggcaccatcttgtttcactgcaacctccacctcccgggttcaagcaatcctcctgcctcagcctcccaagtagctgggagtacaggcatgtgccaccatgcccggctaatgtttgtatgtttagtagagacggagtttcgccatattggccaggctggtctcgaactcttgacctcaggtatctgcctgcctcagcctcccaaagtgctgggattacaggcacgagccaccgtgcccrgcctatttgaatcttttgaaatgatcaaattatctttgcccctcatgctgttaatgtggcgagtaactttactctgtttttctaatattgtacccccccacattactggattaaacttcatcgtgataatatttgtttttctatttctgggtcagtttgcaagattgtttcaggctttggcttttaaatacctaggtgagattcacctactcctttgtctgtgatgagtccaagccccctagctttgtgtgggagataatctctgaaagcttccttacaaaagcatttggagacccgcctttttgttgtattattttgttgttgttgttttttggttttttttgagatggagtttcacttttgtttcccagactggagtgcaatggcgtggtctcggcccacggcaacctccacctcccaggtacaagcgattctcctgcctcggcctcctgagtagctgggattacaggcatgcaccaccacgcccaactaattttgcatttttagtagagatagggtttcatcatgttggtcaggctggtctcgaactcccaacctcaggtgatccgcccgcctcggcctcccaaagtgctgggattataggcgtgagccacctcgcccggccttgttgtaagttttatatttgtttctttgaagattggggaaggttggttattgaaactatatttctaactcagtttgggtaacttatttttctagaatttgcccatttcatctgttttcgagtttttgacactactcttctcaatagaattcttacatgatttttcaaagtctccattttagctgtagtttttgacccccttttaattcttaatattgcctacttatactgtccttttttcaggaatcatttttgccagagattgaacttgtcttttaaaaaatttggatgtaggttttgtttatcctttgtggtatatgtcttttagttcattaatatcttatctttatttccttctacctttcttttgtttattctggtgttttttgttctagtttcagtagtggatgattagcttattttatttttttcctcttcactaataggatggcttaaagttacaaggctttaagcaacaatcttgtttcattccacaaggtgggatatataattgcttaatggcttagttttaaatgttttcagatttcttccttgttccatgagttacttagaagcaagttttaaaacttatatagtctttaaatttttaagttgagttctaattgagtggtggtctgagaatgttactatgatttaattctttactatttgtttaattttttttttttttttagctcctggccaggttttatggttttttaaaaaggtgtcacttttaatcatgtgttcaataaagtagatttattaattgtgtttgcatcctctatacattttccaatcccataacctgtgttaccaagagagttgggtcagtctcaccctttaaccttggatatatcaatttctcctagtaaccttcagtttttactttatatgttttgcagctatgttattagatacatgtaatcagagttactgaatttttaagttcttgaccttctctgttcttaataatgatttttatcctacagtctgtgttatctgaaaataatataaccaactttcatatggttagtatttgctcggagtacttcttccatctctttatttcagcctatatgtctgtatggtttaggactgttgaatggcctatagctgctgttagagttggtcagtttagtctgttaacacgtatttagattactgatgggtttgaattcattcctctcatcagttttgtgttttatttaccttgctttttcattgcttcttttacttttcttgcctcctattcttttttcttgttttctctcttttctttaacaattattaatacagtataatgtaaccagtaataatgtacatcgtaatgaataccgctgaacctaccacctaatccaagatctagaacattgccaataacttccatttgagtaagagtttagtttgaatgttaaaaactctttgtttttcctagattgtctttaaatttttaacattcattctcaacaagggctaaaattagtatctctagcctctccccaaataataagaatcttgaaaccttgcaacttcatatcccccttccaccttatatattattgctgcctaagcattttaattctgtcttttattttattttgtacttgcatattctgcttacgtacctatctataatttaattcccttcaaattttattgttgatattagtatagggtcaccacttgtttcactttatctaggttgctggtttatcagtattccttctttctggtctctctggctttcattttcttgctgaaatatgtcctttagtaggtctgtcagcagggatctattggtagtagttgctttatctttgaatatgtctattctcattcttaaatgaaaaagaattcttaaatccaaattgacagttatttctttcgccataatttatatatagccattatcctctggtatgtattgttttaagtggtctgcctttggtctcatagtattctttatgagtaacctgtcttttctctctagttgcttttaaggtcctgctcttgtctttggtgctctgaggttactctgtagtgtgttttgatttggattagtttaaattatcctgctagacaccttctctgtcttttttgggatgagggaagaatgttgtatcattaaatcttagaattttctcagctattttaaaaaatgtttcttctctgttctttggattttttcttttctctttttgttttggaactccagttatagacatatgttagagtttctcattccatggttcttagctctttcattcgttccatctctcgattttttttctaaaatgtcacctttatgtctcttatgcttttttattgtctcaatcttagttytgtctcccgaagttcttgagtctaatcctacttctaatccatccttccttctttttgagctttgggcttttagcctctctaccatttgtgctgatctgtgggtatcctttttagcctggtatgaggtttattctttcctgaggcggggtgggggggaattgctttctgttttgttaatatctcagtttgggctaggggttcctggacaaatgggcttggttgtagagtactagtccattgtccctacagctcaagagatgcttctgtctgccagctcaggatagtcagagaaggcatcctgtagtcccctctacactagtgggcttttcttcttctttttttgatctacctatcttctggtaagtgtagcccttttggggatcatgactttatggaataggagggtatctcttctcacctcctaccttgagcagacccaaacttctcccccgtccctttgagggctgaaaactcaaatgtcacagacagacgttcacacttcatttggtctgaatattgctagccatggaatttctaaaatttgcttctacgaactatttattagtttcagtgtgctaagcctgctgggaggaaatgctggttgtgagcatcagcacagaagcattctggacggttattagcacaaagttagcatatgattttgtaatctcttctgctaacagtgttttttaaactaactctttacggtgtcctgtgtactaggtactgtgcctgtgctgacttcctagctttattggaagttccttgacagcggaccgaatccctacccgttactctttctccatctccctctgcagtgctgagccctcaaaaacaaaacagcaacaaaaaacacacttgcactagttgctgattggttaatccccacggaaaggttaccaacaaaccacagcagtgacacagaagggaatgcctatttccacatctagggaggcccacctgcccagttccgtgctgctgacttagagcacggctttgctgatgatatccttggctccttctctgcgtcaagccgcaggtgttctctgccttctgtgattctgctcccctccctaggtggtgtcatgaagtgcatggtatttctgctggctcctaggcttttcccctgaccttgcacatacagttgcctgctccacttccccacctgcccagtcagggcatcacacccccttatccatccagtcttccttgaattttacccacctcagtgagggcagctcttcccagtcactcaggccaagaacctgtgtctttcttaacttcttttacacccctcttctggtcaataaggaacttcttggtgcttctttctgaatatataccaaatctggccatttatttcctccattatgcccaccataatgcaagccattgtcatctttagactgaactatagtaggcctcccctgccctcccctcccctgccacttagtgtcagtgttccacgaaaaaaaaaaaaacacgtctgatcctgccttctgctgcttgcagcccccacccagctcccaccatcctcaacagcacccgtggccyggctgcaggctgtgcggacctgaccccattccctgggtaaggctgggtgtgcccctacctcttcccctgtgtgggacggtcttgtccccagatacctgtagttgatcctgtgccctatgcaggattctgttgacctgcgactttgccagaggttcagactgacatctctacagattgctcgactccctttatacccttaaaagaaacagtggcagttatcacttagtaaacacaatggatgcagaagtgacaagtccttcccggagggtggagacccygagagtagggattccgttccgcccagtcctgcgtatccaccgtgggctcagaggccacacaccggttcttttgcgtgtatacatctatgtagagatggagccataagtaatacacgctttaaaggaaggggattttacattttgggggggagattaagttgattgccaaggaatcgggtggggatagtttataaaagtgagggacataaggaataggcacgcaggaatgagggaatgaaagccctggagccgcctgggagcctcactgcgctgtaggacctcgtgccagtgtggccatccgtttacgatgtggtgggcatcctttgaggtttttcttctgattttggggaggtgggcggtactggtgacatctgcttccagagcagccgtccttcctgctccctttctggtcttcggttgtttccactcgggttcttgcggggcgcgctccctctgctttctggaggtgattaatttcccaactcctcggcaccgccttccccacccgaaaaaaggatgcagaaccacgcctgcagttgggtgggcctcccgggtgctgggcggcccggggcggcggggaccccagcggcggggcgggcgggcgctgacgtgtccaggcgggattgggccgccgccctatatagcagccggggcccgggcgccgcgcctcggagcgtcccggcttctcccgcgcggggggcgagtaagccagcggcaggaccagcgggcgggggcccacragtgagcgcgcaacacggggctgggaggcctgggcgggcgggcggacggggcgggcgggctgccgggcgggggggtggggggtggctgctgacgtggaggccgcggagggggaggggcccgggtgccgcggcccccacccgggccccaggctgcggcccccgcccgcgggtgtcctgcttaccgcgcgtggcggttccgggccagacctggggccggctccgagtctcttctgcgcgtggccgtggcgcggaggggcgcgcacaaactttctcaagtccggtggcgccgctgggccgctcttggctgcaagctgggctcccccgcctcctcccggggcttcggtggggcacccctggtgccgtggccgcacggcgcggaggggcggccgacctgagcccaggtcgctgacgttggcggggccggccctcccctcccccgctccggcgggggcgccgtgtgcggccagggtgggggtccctgggaggccagcggggtccttccccccaggtggcggcggggcgggggtctgggcgcagaccgggcggcggggcccccgcagcacctccacctgccgcgcggggcccgcgtcagtctacgtgttcgggggtggggaaagctgctcttcttgggcctggagtgcaacttggacgtgccccagggtcgtggatgaaaaatacattacggaaaagtaccgaatttggatgaaaggcggggaggccgaggggttgctgtccctttaagcctgtccccgcccgcgggccctcgtggcctgtgggagggccgtgctgaggtggcatctgcgaaagttcctccatgcaggatgggtgccgacttccagaacttggtgagaagtgcggagcggagcctgccttctgctcgccagtcgcctgtggtctctcctagatttcgatcttgtgatctctgagtggatcaggattttattttcccattctgaactttggtttgtggtcttgagtaattttagttttggaagaggagaagtctgggtttcagccggaggcttttttggtgccctccatacccggtcctgtctggtgctttaaagcacttgcgggtctcattaactgaggctgaaatgaaattcttcctggagtattactgataattctcttcgaagactgttgccccttgaatatgtagttggcaaaacttatcacaagggaatcaacttaattacttcctcgtttaaaagcaaaaaagtagaacccctcatgtgaagccttttttgttgctgtcagaaacctgttagacttgtgctaaacttgtaagcaccaggtttcccacgcaacacacagctctgtcaggactccacgttttgctctacacgtattagggcggaaaggggtcttggttcctgccctccttcctttagttctagttctgtttgctgaaagttaaattctgagatgtgaccttttttgctttggatgtttgcactctgggaaacaaaattaaaagtccaggttcagtatagtttgaggtttacattaggtggacctggacactgattgatccgagcttcctatgggaaaagtagttgggagagccagaatcacgaagggactggggccatatgggagggactgaaggagacaggagatagggctcacctaccagaaggagccttggaggagagcggacttgttctccatggccagaaaggggaaagaagttgtagattttgtcataacttgaggtggagcgtttacagccatgcaggggtggacccgggccctgagaaggccaygaatttcctgtccctggtggtattaagaaatgggattagattaatatctgaggttcctttcaatcctgatttggacagtactgttagatccagtgagaatctgagatacccgatgttagcctctgttcttgggtatctaggcctgcccaaggtatcctgggaacttcagatagcaagtggagttgcctggcgctgtcctggggttgctgaaagatccacatggaacaggattaaaccctcgtgggtgttgtctgtgaaggcagagccaggagcagggcgtagcagtgcggggtggacatggggctgtagggtcagcttcttaggtgctgctttgttgaaccagaggcaggtggacccctgggctgtgcctcactggattgggagcacagaaggagaatgagactgacttttaagaaaatctcacccagaatttcaggtggggacagggtctgcatttacatgtgggtcatcaaatgcttgcttaaaacgcagtcttcgaaaacaggtttttgagttgtttagaagaaaaacaaaatgttgtttgatgataccagaaccctagatgttaaatgtgtctctagttgtgaaccattcgttacacgctctgacaaactgccacttggaatctggaggctagggacccagtatagcctgtcaaaccagtctggagttttctggaggtctgccttctgccttacctggctgcctgagggtctgtgcacgcctgaggaacatgagaggctctgctccagggtctccctcagacacaggagtaggttcccttatgttgagactcctttcagtatagggtccggctggacttggcttctgaagggtgtgtgagtggtctcagaagagactgacactgggtgcacagtggggattggctcatcacagctccgtgctggagagtcggtgcgggctgacatggacggaactgcattttgcagacttctagtgtggctgtcactgggcactagagacttgcccagaacctagcttgataagggggtgggtgtctgggtttaagaagtgacattggagcccgggacaaccttgagtgagagaccatgccaggtgagagtcagcaagcaagcgtgggagggcggagggtggatgcgggagaccagaggcaagtgtcactggacacctgttggggcaccttagcctggagtgccctgccctgttttgctcccagactggacagacacttggaatctcaaggagctcttgccgagttgtgaatgtgctaatctgacactttggagaaattttcttactttaatctttaaaacttgcaaactagaattttggtgatgcttttaaatggaatactcttgatcagtttgtcccagctttccccttcagtcttggggtacatctgtgtgtctggtgcatctggggccccatagtgtctctggtttgtggcaggttccctgtgtgactcaagccctgtatttagagtttttaaaaaactcatgaccaagattagaatccagaaataccaccagtccacatcctctgctggaaaggcgagaccctttaatccagtctactggatgctcccccattgccatgaaccgccttctcagctccggacccatgtgtcgtaaggrcaagattattgtcacggtacgagtagtcttctccagttgagtggggtgttcctgttactgtcattgcttttcccattttagacacatgcctcactcctgtcagcagttccaccttttcatggttgaggagcacatgtggtcgccagcctcccatctccagagtcccctaaggcaaggtgactcaccctcctacttcacagagttcttggtcctccccagacagcctttgaaggttcctttcaatcctgcgatttcatgacctggtttctagatccccagtggattagaaaggactgaaggacttttacaggctaacagcaagaagaacaaagtaactgcaaaatagacggagaattcttgaagacggtagctcttggtcaccataagcgctgcagagaccccgaggtccacattctgttgtaggtcagagcccagcacaacaacccttcttctggttcagccgcccagcggttatgtggggtacgggaaagatgatccagccatgcaggagagcaccagtggttctgtgaggattttacttcaaaatagttaagtttagaagtttggcacttaaaagatcactccctcaggtccctggaatagttgtcctctgcaagttggagctggttcatgttttgttttaatatgttttgtttcaagctaacgttttttttttcttccaagaaacttgcctgagtattggtgttagtaaccaaagcataaatatcttgaccttttctgattttgaggtaaaaagatctgagttgtaaaatgtagataagtaacttttctctggtttcctctctctcctctcccacttcccatcccataccagcaaaagctggcaggctgacagaggcggcctcaggacggaccttctggctactgaccgttttgctggtaagtttgaccctgtctgaagacttcctgtccctgggctgtgtgtggacctgggggcgcagggatgcgtattttcttagtcctgtgtgtaccttctttctttatatcacaccttcaagtttctcgtggttcgtcagagatgtctccatagcttcacctcccagcaggaaccatctatagacgtgtgtcccttagatgtgtcatctggcttccgtctgtttttaatcttttatttcttaaatgtgaattatgtttattcagtattatctgaattggggtcttgcttctctttaggattgcaggccttaacttttcttcaacttggggagaggtcttaattatgttataaaaattatgcaaaattcactccttattacttggccttgttgtgcgagtaattgatgcgtaattgtgtaaagaaaatgggttcttcctcactgtagtagtttggagctcacctggaactggggagagggaaggagagggaaggagaggaagctaacattcctacctcagaatgctgaatgtaccccatttttcacataagggagctgtggctttcggagcccatatcccgctgagcactgtggctgtgctaatgagaaactcagcgcccttgggccaggtttcccctgctgtgcgagttctgtcccacacctggagggatgggagaataaccagtcagtgtggatcaagggcatttagcgcaatttgtgggtctgttactgttgctacaaagcactgaggctgctttttcctgtcacgcagctaccacttataaccacctggttaagtcgagatttggaggtggtttagtttggggcctggatgcaccttgcagagagagaccgctggctttttgtagcaactgtcatgatgcattttgtaagcattaagaggtgtgtggtgagcaaattgacagaataaccaaggtcrctgttaggagaacgatcctggtgttgatctatgcctggagcctgggtcaggcaggtggcaggttccatggtccccccacccctgcggttaggggtggtgttgactgtgtctctgtggcccctggggtggagaaatggatgcagactgccccaagtggaggatgagctcctccattacaggcaacttttgaggggacagttaaccagctgttctaggacaaacttgtctaacccgaggcccaggacagctttgaacatggcccaacacaaatttcttaaactttcttaaaacatgaggtttttttttgtttgttttgttttgtttttgtttgtttattagctatcattagtttattttatgtgtgtcccaagatcattcttcttgcattgtggcccagggaagacaaaagattggccacccctgttctaggacctcctttacttgcattttcccccctttttatcacttggtgagagtttgggtatcagcttacatcagaggttgtgaggaaaataaaaaggtatagtttgctggtaaaaaagagagtaaaactttgctaaaactcttaggttaacaatctcatagataattgagggttgtactttgacttctgatttattcttctttgctttagtggttttcccggattgtgtgtaggtgtgagatcaaccatgagttccgttgcagttttgacccaagagagttttgctgaacaccgaagtgggctggttccgcaacaaatcaaaggtgacagcccttttatgtgctcttcctggtaatgtctaaggcattgctccctctaaagcctttaccaaatcccatgccctttctagaagtaccttttggccctgtggttgtggggcagggagggtccaacatcttgtgcactgttttcgcattgctgtgcgtgcaggggcgactggccaggcatgaggaaatgaatcaagtacagtgagatttaacatgtgggcagctttctggaaagccagcgaatttgaccattggtaattaatgcagtccttttcaaaactgctttttcctaattgtggtaaactaaaatctgggctctgaagcatcccagagcattgcttaagcctgccttgaggatgaaggctggaccctggcttcggagttctcgaacgccactggctgggattaagagcagtgctgtacagtagaatagactacaagccacgtgtacaatttttaggattctctggtacttattaaaagggaacaggtgaaattaattttgatattttaccccaatatgtctaatacactgtcatttcaacatctctaatgtaaaaaaaagggggggaaccattgatatttgagattatttctcttcgaagtctgatgtgtatttacaacggtgggacatttccttccatttgaatgccagattttcatccaaaatccttgatctgtgtttagatgttataaaatcttcatttgaaagagcagattgttctactccaggttgttcgaaacacacttaaaagttttccaataactaaattgagtattagttcttaaaattaattaaaatataaaattaacttttccttagtcacactagccacatttcagaagctcatttctggtggctgctgtgtcaggtgttggaacccgagaagctgctttgttctgggggcctgggatcctcctcctggagccagcttccctgtgaagtctgtgtttccctttctagagagggaagacggcactgaaagaatgcttccacctgtcctgtcagcgctgtcgggtagatgggcatgcagctgggaagcgatgggcctggacttgggcatgagcctgtctgattccagagatcatccccctgttctctgtcacatccattcatggtgtttttcactgggccttgctattgccaagacrccatgctcagtcctggggatttgggttatccaaaacagtcacacccttgatttcatggagattgtggctaatggcacaaacacatgaacaaatagggcactatggaagatggaagtgatgataatcagggaacctgatttccacaagccttgctgtcctctgccttgggcagggcagggggagatcagcggtgacaattgccactgcagtctttttttttgagacggagttttgctcttgttgcccaggctggagtgcaatggcgcagtcttggctcactgcaacctctgcctcccgggttcaagcgattgttctgcctcagcctcccgagtagctgggattacaggcatgcaccacccacacctggctaatttgtattattagtagagacagggtttctccatgttggtcaggctggtctcgaactcccgacctcaggtgatctgcctgcctcggcctcccaaagtgctgggattacaggtgtgagccaccacgcccggcctccacggcaatcatttttaaccttgtatgttacagtggaaaatcagagtttgcttcaaaggcaattctcacaggtggtgctgggtaggaccattgttttgcaaatgcaggggtctgctctgtgcctggcattgccatagttgtgatttttttaagtgtgttattagactctagaggacttaaaaattgacgtagcaaggcttgctttcaagggactcaccccgttaggggagtggggctcacaatgtctgagctgatgtttaccarggaggccatgtggatgggggtaggttcgctgtcagagactgggagtctctggcctcctctagctctcacactcagggtgctgggcctggtgacctcctggggccttttccyatcactatgaattagaagagaggggtggggggagttgtccttggagcatttgatggttcttgtttgtctgtttttaagcactaaaacccttaaaagtgtttttcatgtaatgctaaaagtagtgcttccttttaatctgtgttggctggtccagttgccactctaaattcagaagaggagagcgaccctccaacctacaaggatgccttccctccacttcctgagaaagctgcttgcctggaaagtgcccaggaacccgctggagcctgggggaacaagatccgacccatcaaggcttctgtcatcactcaggtagaaacaccattctttcttttaaaaattttatcatgtaacatgtctatgtaaatttttaaattttttttcttttttttttttttgagacagagtcccgctctgtcgcccaggctggagtgcagtggtgcgatctcggctcactgcacgctccgcctccygggttcacgccattctcctgcctcagcctcccgagtagctgggactacaggtgcccgccaccacgcccggctaatttttgtatttttagtagagacggggtttcaccatcttaacaaggatggtctccatctcctgacctcgtgatccgccttcctcggcctcccaaagtgctgggattataggcatgagccaccgcgcccggccagttttttaaatttttaaaaattaattgctgttctttcttaacctatccttccaagcgtagaatctgatggaagagtttctgaatgtgcaagattgagaatgctttgagtagctaaagggagaaggccttcaatttaaatcatcccccaccccagagatgtttctgtcgaccacttctctcatgtccaccctgtatgctagcactcagtaggacaggcacgtggtcgttttgcaggcagtgtttgtcagatgaatgggtcctgttttctgttctctrttcattatcctgctttctcgaagaggttaaccagtttcctggttttctttggcttcagtagcccttctctctgctacctgaatttgagatgttagtgagtttcaaaacttttatataaattcatatcatctggtcatggtggaaaattactatctcgctgccagtgtcttccctgaattttaggctcataaacagttgcatcccaatccttccattttcacctgtctgctatcttgttaatggttttgttaaatgtaccactgtctacttggtgactgtggtctcacaccagggtagttgatccctcttgcttccaccttgtccctcctcagttcttctccataaagcaacgggagggaccctgcaccatcaagcagaatgcctcctgctgaaaagcctgtgttgacttttactacrgggtgggatgggtgatcctcttcactgtccccctctggtgtgtgcaccaggctccgcccccatccacctcctccgctttcctgcctgtacacccttagttccctcacctcttaacatggatagctgcctcgtgcttcaggacggtgtttcctggccgtccccagggtccacctcccactttctctcaaactctcttgcccctgttgatttcatcacagcacttgctagctgcctcattcatttgtgcagctgatgtggttctctccttaggatgtcagcctcttgaccttggccctttctccttgtctttcggctgctttatcccagggcttcgagcagtgcctgtgggcagggtggggctgctttgtgagtggatggtgatgaacacatgttctttactccctatctgttggccttcttttaatctcttaacctttccttttttgatcttttttgagcaggtgttccatgtacccctggaggagagaaaatacaaggatatgaaccagtttggagaaggtgaacaagcaaaaatctgccttgagatcatgcagagaactggtgctcacttggagctgtctttggccaaagaccaaggcctctccatcatggtgtcaggaaagctggatgctgtcatgaaagctcggaaggacattgttgctagactgcagactcaggtgggtagcctgaggcctacttctccccagtgactgtgtacccgttccattacccggctcctgatgcaggctagaacgtcactggacccttcctaccagtgggacagttccgtcttttggaggtaggacagcaacattcagagtcctctggcatttttagtggaaaaactcactaaactaataatagaactgggacacttaccatttttgctctttgagtgaatgaacttgaaagtaataataattttttttttaagagacagagtctcaccttgttgtctaggctcttgtgcagtggctattcacaagtgtggttatagtacactgtggcctcaaactcctgggctcaggcaatccacctagcctcccagttagctgggattacaggcacaccaccacatctggccaaactgaaaattagaagcttgtcccagagtttgagacacttaaaagaagctgggcttgctgaatggtaaagatgggtggttcccattgctttgctagtatgttcactaactacacatttccaggccccaaattgaggagattacaagttcaaattctgttttaagccagtttcctcgtctttggcagtctgatgccagtacttggactttatttaagaacatttgtaataagcaaatctctgatgcatttctccctaagtggtagcacttaaagaccaagaaaaatgtaaagaatcttactaaagtgttgcgtgactgctgttgtactagataggcttatttaggaatgggggttcttcccatctgctactgagtctccttgatcttgtgggagctggatctggagcaccctggagcatggtgattggacgatggggatttgatgggagagggcctgaggggtaggagtgcagggtgtagccaggaggcgaggcagaggagtgccacctaatgcaggtccagctgtgccacttaaccacatgggggcatcgggacagtccccaaccccagctggcttcatggagttaaaccattaagtgttaggaaggtgaaagtgttgcttataattgtccagcatggtggccagtgcataataggctctgaaagttttccaggtgtctgctagtcagtggatatttgagcttctgttttgtaatcaacactgtaggggaaagggccacttcactgaatatatggatcagaatgaagacattgacccctgacactctcctactcctcarttatcttcagacaaatcccagatacattattgtgccttagttcagatcttcccgttttcatgtatacatatatatagtcattgtgctcctaactcatgtaatcatattgatagtggtttcttaatattatacctttttaacccagtctctgtttggactttcctcatcatctccaagatgtttctttcagttggtcttttcaagtcagtgtccaaacaaggtcacaatgttgcatttgattatagagtcctgtctctcattctttaacagtgcttactccctcctacccccttttttttttttttttttgagacaggatctcactttgttgcccaggctggagtgcagtggtgcagacacagctcatggcagccttgacctcctgggctcaagtgatcctcctgactcagcccttcaagtagttgagactgcaggcatgcaccatcaggcccggctttttttttgtttgttttttggcagatgcgggttttcaccatgttgcccactctggtctcaaacccctaggctcaaatgatccactcatttcagcctaccaaagtgttggaattacaggygtgagccaccacgcccagccaatcctccccttttttaatgccattgattagtggggaccgtaggtttttggttctgctattgactgattatttttggtgaactggtgttagatctctaggggcttggttacttccacagtcagcttgttgggcaagaagaccctgtaggtggtgctgagtctgtgctgtgatagctggttgttctgctttgaactgattttgagattgatcattaggctcaggtctgggtcttcccttgtaaagttccctatcagtgctttgtgtaatcattttactatcaattggtgattgcccaaattcgttaagggttgcaaattatgcttttctaattctctccctgctcatacattagttgataattcttgtaaagaagaatttttcttcatcagcagttgggtgggaagtaccagataaataatcgattctttggcgctccggcgacttcagtgttgatcagtgactctctttagtgtcattatgaactcaggcattgtccatcattcttcatgctggagctgcttcatctttggccagtgggtcccctcctttcagttttgttccctgcagctttctgtcatgacctattaatatcaataccttctggccaggtgcagtggctcacgcctataatcctagcactttgggaggctgaggcgggcagatcacctcaggtcaggagtttgagaccagcctggccagtatggygaaaccccatctctactaaaaatacaaaaaaattagccaggygtggcggtgggtgcttgcaatctcagctacttgggaggctgagrcaggagaatcacttgaacccgggaggcagaggttgcagtgagccaagatcatgccattgcactccagcctgtgcaacaggagcaaaactctgtctcaaaataataaataaataaataaataacttcttaatttctaacacagaaagatgcctcaggctaatcttacatatttccttccacagaccttgagtcagctgtttctctctgaactctgaaccttttgagtaggaaattgcagttggagactccagtctccataggtgcacgtcgcaactaggttgtcagagcttctaggctttttcagaagacagagctaggataattgtacttttaagaaaggaaaagcaggcggtgactctcacgcctgtaatcctagcactttgggaggccgaggtgagcagattgcatgagcacaggaatttgagaccagcctgggcaacatggtcagaccccatctctacaaaaaatagtggtggcgtgctcacctgtaatcccagctacttagaagtctgaggagaaaggattgtttgagcctgggatgtggaggcttctgtgagcagtgtttgcaccaccacagcccagcctgggtgacagagtcccagaaaaggaaaatcatgagttcaaaatcacttgaagtaattccttttttctgagtttttctgtcatcttgatatagttaggtacatttgtttccatttactgtcaatttttaaagtatttcaacatttacatgcttgcaaagtcaacgttatataataaagtactttcagagaaatctcccctgcctgttaccttcaccctgctccctcctcacctttgcaggcggccattcctggtcctggtttatcctttgttgtttgttgtttgagagcagaagcaaaatacagcttgccatacaccctgttctatgccttgctttttttcttttattattttttggaggtgtctgcatatcagtaagtagtgatttttctcatttctttgttcagcagtgtaatattctgtgggcgtactgtaatttacccaggctttcctactgatgggcatttgggtagtttccagactttagctgttacaaattatgttacagtagcaatcgtgtgcatatgctatttcctgttttacccagtgtatcttgggatagattcctagaagtgagatggctgggtcagagggtggctgcatgtggaatcgggccatcggatgctaaatttccttccttaggaattagtgttttgccgtctcatcagcagtatgcaagagccaggctcttcacattcttgggttttagccgatgtgagaggcaaccaaatatactttaaatttgcatttttctgatgagcaagattgagcaccttttcaatatataagggccacttgcattttttattatcttgagtcattgttaggaaagttttttcactatcaggtcataagaaagtttatcttttcttctgctgcttgtaaatgtgttcttacatttcagtttctgatctatttggaatttattgcaaatagggttgaggcactgattgagtttcacttttttccatacggctttcgagttgtcagcactatttttttgtttgttgtaacacagggtctcagcctgccacataagctgaagtgccatggcatgatcacggctcaccggagcctcaacctcctaggctcaggcagttctcctgcctcagccaccccagtagctgggaccacaggcacacgtcaccatggccagctaatttttttttttttttttttttttttttgagacggagtcttgctctgtcgcccaggctggagtgcagtggcgcgatctcggctcactgcaagctccgcctcccgggttcacgccattcgcctgcctcagcctcccgagtagctgggattacaggcgcctgccaccatgctaatttttgtatttttggtgacctcgtgatccacccacctcggcctcccaaagtgctgggattacaggcgtgagccactgcgcctggccttggccagccttatttttaaaatttttgtagaagtcaggtctcaccatgttgcccaggctgatcttggactcctgggctcaaacaatcctctcatctcggcttcccggagtgctgggattacaggcgtgccatcactgtcttgaaaagacgttttgctctagtgaacttgagtggctgcttttatcatgtcctaaatgtttatattaacttagctctgtttctgggttttcagttcagaccagcaggtctttccgtatactggtatttcctgtgttaatgataatggtttcatgtttaatgtctaggaccactgttaacacctccaccctgcactattctttttcagggttttcttgttyatttttgttkgttctgtgttacaacctttataatcaactgtttgaaattgtattaatattttaaagttaattgggatratcgccatctacttaaaccttctgttagctattttaaggagtgttttctaatttygaatgcacatactccaccttgtgttgggcttatgtcttgctattttcttgtccttttttcttttttccttttttctattagaaacacatcttttggccaggcgcagtggctcacacctgcaatcccagcactttgggaggctgaggtgggcggatcacaaggtcaggaattcgagaccatcggggccaacatggtgaaaccctgcctctactaaaaatataaaaattagctgggcatggtggcgcacgcctgtagtcccagctaatcgagaggctgaggcaggagaatcccttgaacccaggaggcagaggttacagtgagccaagatggcaccactgcactccagcctgacgtcagagcgagactccgtctcaaaaaaaaagaaacgcatctctttcattacatcttctaagtagttgttgtttgtggaagttaatgttgttaacttcttgatttcagtcttttctctttgctataaatagaatttcacccagtagttttttcagggtttctggatatgcagtcatgcttcttcctgtccagcttttgtggatgttaactcttgtctccctttgtgggtgtatattccagtggatgttaagtagtggtgcagatacactcgaacttaccctaacctgggagtcagggcaaccttccccaagcatgtgatgtttaagctcatgctgttttaatggatgagttggtgytgctgggcrrgaataagcaaagatggtgtttctgccagaatgtcttggaaaaatatgctccttcagaacctacaaatattcttgttttcttttattctcttcttgctataggcctcagcaactgttgccattcccaaagaacaccatcgctttgttattggcaaaaatggagagaaactgcaagacttggagctaaaaactgcaaccaaaatccagatcccacgcccagatgaccccagcaatcagatcaagatcactggcaccaaagagggcatcgagaaagctcgccatgaagtcttactcatctctgccgagcaggtgaggcctgtgtgagtgcctcgtgcccctgcctacctgcttgtgcagacctcactccctcatgggttgccgtgtccagtgtggacttcaaggcataatgtggtgggggtggaggkcttgactccaactctaaaaagccctgtctgtccccagtttgttttcaaaggcctgttctcatcagatcatcccttcctttccaggacaaacgtgctgtggagaggctagaagtagaaaaggcattccaccccttcatcgctgggccgtataatagactggttggcgagatcatgcaggagacaggcacgcgcatcaacatccccccacccagcgtgaaccggacagagattgtcttcactggagagaaggaacagttggctcaggctgtggctcgcatcaagaagatttatgaggagaaggtacacgatttagaggaggcaaatccccatgggcaggaatagaaatgaggatttgggtctggagattcagttaaggcctggttctgccccttatctttttgtccttgatgaagatgcttattgtctctacacttgagtgacccgggtgagatcggtgcccgcccccccttgctgttgagcatctgcctggcagttgtccttgccgtcctgggcctctgactgtgctgacaggctgccagctgggctgccccgggtcagatgcacatcccggacttgttcacgtcttagattaagctgttagctcagcttagtgaactttgaggtctgaaacgtgttccttaattgagggaaaggattgggtgttttgcagtgttcaaggacgaagttatcagccggcgggtgactagactgaggggaaaaatccagtccttgaacagtgaagtttctggggattggctagtcctgatcacttgttgttcacttcttgggatcagcatctatagtctgggccgctttggcttgctttctgcagcagtggccatgcccacctgcccgcttcccacacctttccctttgactgccccttatggtgctcttatttagaaaaagaagactacaaccattgcagtggaagtgaagaaatcccaacacaagtatgtcattgggcccaagggcaattcattgcaggagatccttgagagaactggagtttccgttgagatcccaccctcagacagcatctctgagactgtaatacttcgaggcgaacctgaaaagttaggtcaggcgttgactgaagtctatgccaaggtaactgcctccgagcatgaagtgtgtctcctttgagtggagtccgcggggccttcatggatgagctctcgatttgtaaatcctggggcctggacacagtgcaggtgcccaggtttggggagagcgtgcctctgagccccaggtgagcagcctggctttcactgtgacacgaccttgagctctgcaaacccatggctgttctcccrttttcttaggccaatagcttcaccgtctcctctgtcgccgccccttcctggcttcaccgtttcatcattggcaagaaagggcagaacctggccaaaatcactcagcagatgccaaaggtaaggacacgtttttcacctgttgtattgaatttgtcttgttttctgtctttctgtttctgatattgctttgttgacctttgtactgtggatgcccttgaaaactggtgtatttttctgaattaactggcckgtttgacatggtcaacttccgtgttagcttaaagaacagcagaataaatgtctgtagatgtctgtaccatccttctggcctttaaccagagaggattgtatgttcttaggtttcataagtatcttaagaaacatgtcatttagtaattatggtgaaataacttcatgatactttggcgggccrggtgcggtggctcatgaggtcaggagatcgagaccatcctggctaacatggtgaaaccccgactctactaaaaatacaaaaaattagccgggcttggtggcgggcacctgtggtcccagctgcttgggaggctgaggcaggagaatggcgtgaacccgggaggtggagcttgcagtgagccgagatggcaccactgcattccagccttggcgacagagcgagactctgtctcaaaaaaaaaaaaaaaatactttgaagagcagaacttgtatacaaattgtattaagtgtgaatttaaagcgttctcagtttaccaaaggagattgtagcccccaggaaacatgaacaaaaaagaaataccagagaatccaaccatcatatttaattcctgttttatttaaactttgtttccaattaatgttacagtcctttttaaaaattaawttttttttattttattccttttttttagtgacaaagcctcactctgtcacccaggctggggtgcagtagcgcagtcatagctcactgcagccttgaactcatgggtcaagtgatccgctcgtctcagcttcccaagtagctggcactacaggcgccccaggctagttttcgtggaggcagagtcttactagttgcccaggttgatctcgaactcgtgggatcaagtagtcctcctacctcagcctcccaaaatattgaggttatgggtgtgagtcactgtgcccagccccttttactttgtatagcttcatataaggaccagtctgccttccttaactccttacctggaggataataaaccaggaactctggcagccttgtctatgtcaagcaarttactttaccaccttggtacagctatacgagttttaaaattccatccgtgctctgtctcattctttatgcaactcaagaggaccaggccttgtaaaagttcagatggtggaggagcatgtcgcatgtcgcatgctttatgttagtggcttctgtggggcaaacggtgtccttagtgagaggcaggattattcggccacagtatttagtttcctgactatggctccctaaccctccctttcaactttgtttgatggctgtggatatgtccctccctccctcacatctatgtgaagcagtttgggatcagaagccgctccgaagagagctcccactgggagctcaggggctgcagctgtgccattctgttttagctatctctttggttttggtgtggtaggttcacatcgagttcacagagggcgaagacaagatcaccctggagggccctacagaggatgtcartgtggcccaggaacagatagaaggcatggtcaaagatttggtaaggtaccccttggaatgttgtgtgtgctggtgacaagggaggctctgagttgggcatgggcggtcatctctcgatgacatcccacatgtccgggcacagacacccagggcatcctagctgggtgagtaataggttctgaaacaaccagargctggtcgaagtcctggaataatcgtgggtggaggaaacttcatcttgaagaaggcatctttcaggggagatgcaggggcagtctccaacaattcctgacagctgagtggtcagaaaaggcaaccgtggagactgctgggttttggttcagctcattggccaagtaaccaggcgcatccatggacctctgtgctcctcctgcagattaaccggatggactatgtggagatcaacatcgaccacaagttccacaggcacctcattgggaagagcggtgccaacagtgagtgaggctgtctgttgcggtggggccagtgtgccctgagacccttgtggggggtgtcagctgtgagaactgtgacgtccgtgcagacagtccaggcccattgctgcctgtaatgggagttacagactttacatcctcctgcctgctggaagaggccacttttccttttccctttggtgcagtggttggattagagctgcttggccagtgggtgaattgtcacttttgraaatccatctaagccctccccaaataacccacagaggccatgttgaaggcatgcccaagggcagcattctctatatttccgtcagacctgctaggttagccaatcagtgttggtagtactcatgccttctgaacgtggaaactgctgatctggaactcaytgaagagtaaaaacattctagatttgtgcccaagtaaaacaacatggggagggatacttttttgagacagggtctcactctgtcacccaggctggagtgcagtggcgtgatctcagctcactacaacctctgcctaccgggctcaagcaattctccagcttcagcctcctgagtagctgggactacaggtgcatgccaccacagccaattaatttttgtatttttagaagagacggggtttcaccatgttggccaggcttgtctcaaattcctgggctcaggtgatctgcycaccttggcctcccaaggtgctgggattaaaagtgtgagccaccacacccagcagggggattctgttgaagaggcagtgatatgtcagccaaggtcgctatatgcctcacctgtgccaggttgtaggtgtagcacagttacaggacactgttggaagtatgtcatgtgggccaaggtcgctgtgtgcctcacctgtgccaggttgcaggtgtagcacagttacaggatgctgttagaagtgtgtcgtgggcattctgctgcaggtccaaggatgttttstgttgtttgtttgttttttgggacggagtctcgctctgtcaccaggctggagtgcagtggcgtgatctcagttcactgcaacgtccacctcccaggttcaagcgattctcctgcctcagcctcccaagtagctgggattacaggcgtgcaccaccacacccagctaatttttttgtatttttagtagagatggaatttcaccatgttgtctaggctggtgtcaaactgctgaccttagttgatctgcccacctcggcctcccaaagtgctgggattacaggcatgagccactgtgcccaaccaagaatgtttttttacacctctttgtttaactgtatggctatackcacacactcgcgtgttctgaaaacaagtgcacacgtcgcgtgtgttacctttgggtggaaggtgagaaggcaagcacgtcctccattcctggatagttcagtggatgaaggagcctttcccaggtagtgggacaccgacctgcataacatgactgacgtccgtgtatccgtttttgttatgagtaaacatagccttggcagctgtgctgtggcctgtgcaatggtgagctctctggtgtcagtcttatgttttgtgggcattttacgtgacagcgacgagagtctgtaggcacaaagtgacctttttgcgcactacttgaaccacacatacaccataaacttgcttttacggttttgttttggttttggttaactgtagcgtttgtttaggcctgacacggtggctcttgcctgtaatcccagcattttgggagaccaaggcaggaggatcacttgagcccaggagttcgagatgagcctgggcaacatagtgagacccctgtctctacaaaaaagaaaaatttagccaggcctgtggtccccgctgctctggaggctgaggcaggaatatcacttgagcccaggaagtcaaggctgcagtgagctgtgattgtatcgtgccactgcattttagcctgggtgacagagcaagaccctrtctcaaaacacatatatatggaagtacagtagtgtaaatctaacattaatttctggtttctgcccccgagaaattgcagaatgtagcttagtcagtcatgtctgttctgttttcttctcatgcagttcctaactcttgtcttctttcgtaatctaaaaaaacctgctgcccagctcccatgtcctctgcttctcttgtcttgtgttgctycacctggcacagctgcatgtccatgttcccccctcagtgcatcgcctcgttgctgcctctgcgtgtgcatgtgtttgggatggacscacaaaaagccctcctcrtggtccttccagcaagctgggcttccctttactgcacagtgggcaagattcctgccttgtttcctgatgatacggcttctccagagtttggggggcctggaactcttaacttgggggtactgggttctatccagagaggttgacagcaggagggtttgcaacagcacttgtcttgcagacacagtgaartgctcagtgtgaatctgagccaacagtagatggggtctctgggcagcagcatgggccccacaaggctcttaggcgtcagtgagtgcttttgtgtggagttaatgtgtgtggtttttttaacttgagaatagtagttcccaaacttactgcacattagaaacacctggaatccttcaactattctgaagccctggccaataccccagacgagctaaatcccagactgagtggccccaaccgtcagttatttgaaggtctcggggcatttccagcttctggtccaggctgagagcctgtcctccagaacccttgtgatccaggtgaagatcataactggcccccattctagacaatggagatttttgtttgggaagctaagcatcgtttttggtgatgggaatcacagataaggttatttagcgctttagcgctgtcctgcccagttatgtcattggcagaatgttgttggtctgtgtcctaaatgtgtttccttttgtgttcctaagtaaacagaatcaaagaycagtacaaggtgtccgtgcgcatccctcctgacagtgagaagagcaatttgatccgcatcgagggggacccacagggcgtgcagcaggccaagcgagagctgctggagcttgcatctcgcatggtaagtgccatggctgggccctctrgaaaggcactggccttgcgtctcttggccccctctaaggagtagcgtgttgtggtgtgcggccttagagaatggaagtcgacaaatcccacgttgcactggaaccggattggactccctggggccacatttcctttatcctccccaggtcacctgcacgtcttgttctccatggctgtgtgctgtgctagaagggcacagagactgtgtggcagcgtcttggccttggccacaccctgggtgcccagatgcctgggtaccatctccagagattgtgacagacatttctggattctcaaaggcatcccaggtggttctcatgtaaggccagactcgaggatcactgcaaacctgaagtgggggctgttgctctctaccacctggcagaagcactgcactgctctgggctccccgacgtttcatacatgcttatgccaagctgtgagcacccttgcttctgtgagtcagatacccacacttgaaagtctctgggtgcctttaagtatccagagaagtcaaatactgcgtgagtgcctgcagcagcactttggcctgactgtgtgaggaacaagccccagggttccctgtcattcgcttaggggattctttgttcacctcaccccagtacccacacgaggaatctcaaattggcagacctcttttatagccctgagctgcattccagggcgtgatgcagcctcccactgcttgtggccttcccggagctcattccccagtctcatattccaggttctcctcttagcctggcctccagcccaggtcccttgtcctggctgctttatgcccttcctgattgctgagcccttacttctctgtcagccaatagccgtttgatccagaatctctcagaattcttggaaatgtttggttggctgttggtgttcttccctgaattccagctctgcttattctgtatttcttctgacattttaatggggcctgtggaggagttgagagccatgtgggttcagtgccctgtgttgaacgttcttagccatgcggggaaagtggtccgagccaccctctgttcagaagggatcactcactgctatgcagaatgccaggcctccaagtagaagagctgggcctcccctgtagtacctgttaaaacagaagtgctcactgaattgctttggtgattactgctatcatgatagcacttttggttgaagggtcctacagcgagttccttaattggactttgttcaggaaagtgacgtgcagcccatgttgcggagtgtagcgatgcttggtgagagcactcattatgcgctgtgcacactcttaacagctggttgctcccggggtgctacgaggtgccacctggagaccacctcacctgctccatgaaggactgtgcccagggctccctggtgtccccttgtgtcagtggggagttgctcgccgtgcttgtgataaatgacatctactttaattgtatttttaggaaaatgagcgtaccaaggatctaatcattgagcaaagatttcatcgcacaatcattgggcagaagggtgaacggatccgtgaaattcgtgacaaattcccagaggtaaagtttcccagagacattctgtaactctayaggagtgatccaagtcacacttcaggaatatttgatatttgggatatatgtccttcctcatacttgaacttagtctccccatgatttgttctaggtcatcattaactttccagacccagcacaaaaaagtgacattgtccagctcagaggacctaagaatgaggtggaaaaatgcacaaaatacatgcagaagatggtggcagatctggtaggggtgtttcacatcctttcttgtatgacagcacctggggtgggtggggcatgcgtcctgtcagaagtcctgacccccacaggacccctgctctggggaaagcacataggccctgggctggccttccatctcagggacttgggacaaagtggtgacggcttctcacttaatacctggatgtttagattggcagtcattgttaagactgcagtgtttgtggaattcaggtggggagatttgccttttctcatgcccagttaccttgtttccttgaggagtcttcagatacttagagaaattgtcccatccagtaagataagaggtataacaggtgacatgaggagtcatatactgatttattatttttctcaaaaactgacgtgggaacaggtttagaaagtgtagtgagtagtggatgagaaggccacaggcagccatgtatttccgtgggcttcaccttagctgatggctgccctgggagaggcgatggtgaaggactccagcactgtgagctgctgtcacatcactgccgtgagtgcagaattgcccagagcgtaggggtccgtgctgtctccatrtgtgttctgagccccttccttaaccagctctgatcctggcatgggacatgaactctctcttagccaaaaagtagacttgcatcgattgmctgtaatttgcaacgtaagttagttgttggacaaatgatctatctcacttaccctcatgacaaacctctgaaggtttgtttgcaaataccagtgctctgtcgtgttcatgctacccttaggggtagaagggatactgtattttactctctagcacaggtggtgaatcgggctgtgttttttgtctttaaggtggaaaatagctattcaatttctgttccgatcttcaaacagtttcacaagaatatcattgggaaaggaggcgcaaacattaaaaaggtgataacttgtccgctgcatcttgcttcttcttgccttgtcctctgtagccctgcaccattttggttttagactaggarggactcttccttacttctagccctgtgctcaactgtgtctcaactctgggagagctctagtcagcttctcatggtgatctctctccctgtagattcgtgaagaaagcaacaccaaaatcgaccttccagcagagaatagcaattcagagaccattatcatcacaggcaagcgagccaactgcgaagctgcccggagcaggattctgtctattcagaaagacctggtaatgggagatgttttctaatggagatcctccagtaaaatctctaacagcctctaagattgagcctggggttgagtcacgcagggtcattgggccagcgcaggctgatgtggaagattgcacctttcaatccaggctactgatgagttggtcagcagttttctgcctttgtctctcacgatacttacttacctggaccctgcagcagtaacatttgacgtgggcacttgtcttattagacattttcttcttgttacctgaaaatcttatctgaaggtatttacggtattttctttcctttaaaaaaaattgacatgcagtaaattgtacatatttacagtgtacaatgtaatagttttgacgtgtgtatacatccatggaatcattcccaccatcaccccaaaaatgtcccatgccattttgtattacagtctccctccatcccacttggcagctcctgaaaaccacactccccccacccccacttctatccccaggcaacccccagtctgctttcggccacagtagatgcttttggattgtctacgcttttgtgtgaatggaatcataacatctactctttattgggcccatctgctttcactttgcaggatattttgacatttgtgtgtgttgtcacctgtattgttggtttgttcttttttatttcaggataatattgcactgtagggatagatcatctgtttctttgtgtgtacttggtaattagtgtctttcaaggggttttctattttctccaaggtgtcaaatgtattaacatgaagttttttagaatagtcctgcattatccttttgctgtcaatactgacgtcacctctctttcacagtatatgtaatctgtgccattataaaatgatgccttttccctggtagtatgcttggctccaaagtctatgttatttttttcccccttatatttaaaatttttttggagatgaggtcttgctgtcgtccaggctggagtgcagtggtgcagtcatggctcactacagccttggctttccagactcaagcagtcctcccaccttagccttccaagtagctgggaccacaggygcatgctaccgcaccaggctaatttttttcttcttttagttagtagagatgaggtcttgttatgttgtccaggctggtctcaaactcctcaagtgatcctctcgccttggccttccaaactgctgggattacaggtgtgagccactgcacccagcctcctttatatgatactaaagtgagtttctttttggcagcttgctttttaaattaaatctatctactaatcccagcactttgggaggctcaggtgggcggatcacttgagctcacaagttcaagaccagcctgggcaaaaccccgtcactactaaaactacaaaaagaattagccagtaatggtgctgcatgcttgtagtctcagccactcaggaggttgaggtgagaggatggcttgagcctgggaggtggaggttgcagtgagctgagattgcgctgctgcactccagcctgggccatagagccagaccttgtctcaaaaaaaaaaaaaagaaaaaagattatgatgtttgcatttaattacagttgtgattrtatatgttatatatcacatatttatatttattacatatgtttaacaaacgcggttaaataacttactgtaatttttttcctcaattgtggtaaaatatacatagcagaatgtatcattttaatcgttttttaatggttaattcaactgagtacattcacaaggttgtgcaaccatcaccctgtccattttcagagcatttccatcatcttacacagaaactacacccattaaacagcaactaccaccatccccacgtgctcagccaccatgatgtcatgattttatatgattggctttcagtccaccatttacattattaacctttaaaaaaaattccattattttttaaagagatttaaataatatgaaaaaatgtatgtatttatccacacagttgccatttctagagctcttcatttcttggcgtgatccttgtcttcattttccttctgtctgaaggaaaccactcaacatctctcgtagtgtgtatccggtaatgacttctttcacattctgtatgtctgcaagtatttttttccttcaytttcgaaaagctgtttctgctgcataaaggtttctaggttggcagtttttttcctttccagacttggcttcattgccgtctcctgttgtttctgatgagaaagctgatggtgcccctggctttgttcctctgtccatgacaaaccttctccctctggctgctgttagggttttaccaccgtctctgagcaagttaggatgtgtctctgtgtagttttcttcatgtctcttagcttggtgtttattgagcttcttgaatatatgtgttcagaatttcatcaaatgtggacaatttttggtcactatgagcattttgttgtgttagccccttgctgtctccccgtcagggactctggtgaccagggtatttagttgtcttctacttgtgctctgtttatttgagttgaggggaggagcgatattggttttctccatgagtttctttaaattcattaattctttgcagtgttctaatctgcctcatttcatctaatatcattttcattttagatgttgttttcttccctagaagttcactctgaattagtatcttctgtattttcagttcttaacatgttcagtctttctgcttttggccatagacaatacagttaaatacctgtttttctgtccttggctggctgattctaacactgtcatttctgggtggttttctrttttcttttcctcgttatgggttttccccctattctttgcatttctggtgtttcttaatgagggtgtttttgtattcctctgaatattattttgtgtttgtgaagtcactctgaaacattttgctccttttaggacttgcttttaacgtttattagggaggatcagagcagtatttagttcaggcccaaatatttccactgctgagataagatccttctgagtactccacgtcccagaaagttgaaactgctgaggacggttctggaccaggctccgactgagctgcaggcactgtttcctggtgtctgagctgtaggtactataccaggccccgactgagctgcaggcactgtttcctggtgactgagctgcaggtactgtaccaggccccgactgagctgcaggcactgtttcctggtgtctgagctgcaggtactgtaccaggctccaactgagctaaaagcactgtttcctggtgtctgagctgtaggccactatacccggccctgactgacctaaaggcactgtatgaggcccagctgagctgcaggcactgtttcctgtgatccttctggggattctttcccaggcccagggtgatttcttcacgcgtatcagtatatgagtggctggtctccggatctcagaggttctcgatgccagtctctttgggctctgatctccggatggttctgtttcctcaccttcccgtactgtggcagcaacttggggcagctgtagggctcaccttgtttcctgtctccagggtcttgaaagtcaccattaggcggtaagttcagtccagtccctggtactgcatcttggctgaaagcagaatctttggttttaataggaaaagtttatgtatccataggcatatggagccacctctggcagagccggagcgttgactgaagaaatagagcattatgtgtggtctgaaattaccacgctcccacctcccaatccagcatagattcacgaggactctgggtcctgttgagttaaacacctcccagcgcgcctgctctgctgggcgcaccccactctccccaggacgtgcactctcctcccccgtgcaggtcaaaaatggcttggagaagtttggtcagtgcttgtaagtggcatctccagggctctaggcctgcgtgttcatcaccaccaaagatgatagtttatcttttcctctgccctttttgccacaaaaatgtgacttcctcctcctgccctgtgtttggtttcaggccaacatagccgaggtagaggtctccatccctgccaagctgcacaactccctcattggcaccaagggccgtctgatccgctccatcatggaggagtgcggcggggtccacattcactttcccgtggaaggttcaggaagcgacaccgttgttatcaggggcccttcctcggatgtggagaaggccaagaagcagctcctgcatctggcggaggagaaggtgagcatggggagggagcgtgactcttggcaggaagcctggtcctcagtacagtgttctcgcttctcactgtggaaacccctgaatgcccttcctttgtggcgggtcagaaaacagctctataatgtactgtttatgcgtctttgtttttgctgttactggagggcctttccaggtccaaacgctcacatatgcaatatataaaagttggtctttggcttattagttttggggtgcttttgttttttaaatatgatttacagtaaaattggccattcttcaggtatagttgagttttaagtaacatgcagtcatgtgaccacaatcatcaaaattcattttccatcacccctaaagattgcccatggaattgctgttgtccttgtgtcaaaacccatctgtgggtatgtttccgggctcttctggtgacaccaggtttatgggaagtctggaaatcagtagtgtgagccctcttaactttggctgttctacaccccttgctgatcagcctgtcaatttgtaggaaaaaagcactttcacgttttgattgggattgtgtgaaatttgaagatgagactggcgaggattgacagctcagcagttttgacttttgcaggcatttctccattttttttaggtctgtgattctttattggtgttttataatttttagcacatttttatgttcgacttaacagatctaactactgttactcttttagtgctattgtaaatggcactttttttccatttccagttgttagcacatggaagtgcctgtggtttttgtatgttgaccttcacgaggctgctaaataaagctcatgtatattagcgccagtcactgttttgtggattttttttttttttttttttttttttttttttttgagacggagtcttgctctgtcgcccaggctggagtgtagtggcgcaatctcgcctcactgcaagctccgcctcctgggttcacgccattctcctgcctcagcctcccgagtagctgggaccacaggcgcccgacacctcacccagctaattttttgtatttttagtagagatggggtttcacagtgttagctaggatggtctcgatctcctgacctcgtgatccgcccgcctcggcctcccaaagtgctgggattacaggcgtgagccactgcgcccggcccactgttttgtggatccttattttatatgtcacaatcacgtggtctgtggacagttacatttctctctaatctggagccttgtatttcttgtcttttttgttgttgttattagattgatgtttttgtctttgtgtttaaccagccttgcgtttctggggtaatccctgcttggtttggtaggttgtctttggccatattgctagattgcatttgcctaattgattgcctaatgtttgactaatgctgctatttgtggatgtctttgaaaagtagcagagtctctaggtggtatttggtgaaacctgcacttaaaaggtagcaaagttgttatttaatatttttgtgctagcatgtttttctttggtatttttgcttgcgggccagatcttgggtccggagaaaggcaagagctccccgtgtggacctgagtcccgtggagcagcgcccttctcggggcccctgcgtgggtctgccagaagcactggtgtccacaagcagtgtccggggcctttccaggaccctcgttttcttactgccacacaagggcgtcgcactacacgaggcctctgaggaccggtctctaactgtagccttggttggcttgtgtccctctgagcttgagcttgagcctggggagtggctggttttgtggaggctgatctgtagcactcgtgggaagaaagggagcctggcccagatttgtgtgtgcttggtctggaagcaggtagaagagtgggagcatggtgcacacctcttgggcagcttgcttcctgctctgctgggcacaccccacgctccccaggacgtgcactccgccaacatatcgtccggcgcgttgctcccacctccccctgtgcagatcaaaaatggcttggagaagtttggtcagtgcttgtaagtggcaggaccagggttctaagcctgtgtgttcatcccaccagcatctggttgttgtggaagagaagtaggtgtgcagtctgggtattcatctgtttattcagtgaggtgtgctagccccattttgggggtattggtgcaacatcaggacactggtgacaatgtaaggggagcccgagcttgctgtcctacagaccctcttgtcttcctcactgtggtccaggcacgtggtgtcaggctaacacagtgggattggtttctgcagcaaaccaagagtttcactgttgacatccgcgccaagccagaataccacaaattcctcatcggcaaggggggcggcaaaattcgcaaggtgcgcgacagcactggagcacgtgtcatcttccctgcggctgaggacaaggaccaggacctgatcaccatcattggaaaggaggacgccgtccgagaggcacagaaggagctggaggccttgatccaaaacctggtagggagcgggcctcggcggccgactctgctggggccgtgatggggtggcttatcttccatctcttcttaacactgcaggataatgtggtggaagactccatgctggtggaccccaagcaccaccgccacttcgtcatccgcagaggccaggtcttgcgggagattgctgaagagtatggyggggtgatggtcagcttcccacgctctggcacacagagcgacaaagtcaccctcaagggcgccaaggactgtgtggaggcrgccaagaaacgcattcaggagatcattgaggacctggtaggcacttgggtgctcggggaggggttctcaccccccagtggccactcaccgaagccgtgtatgagtgttcgctccaccctgtagggaggtgactccctcatacagccctggaaggcttcagaaggggctttctggtgctcgctcttctttcctcagcctgtctggcctccttcctgatagttggtgagaattctgcctgcgagaagcacttaaaaaaaaaaagagagagagaaggagaagaggagaggggagagagagagaggaaagaaagcaagagaaagaaagaaaatgcattctgtataagggatcaggaaaaatgaaaatgcagtctaaggggtcagctctcttctcccctctgtgaaggaaagaaaatcgatttgagggcatccacgtgaatccatgggaagtcatgagaagacgtggtctttagaagcagtctttagagagtgtcccctccaggccactcccctgccagggccttggattccctttccctaataatcaagtctgatgcctcctcatggagtcagaggctaccccaggaggtcccactcctttggctgaattggccaccctccagggatggcacctggccttctgggacacatttcagaggaggcccacccccttagacctgtcctgctacctccctcctccctgcgcctggagccctggactcgggagaaggggagcatctgtgccaagtggctgtagaggacagggaggaaggtggtgtgaagagtgctgtaaaacttgccctaaggaatttaatctttgctcttttcttttttctttgtgtacctccctccaggaagctcaggtgacattagaatgtgctataccccagaaattccatcgatctgtcatgggccccaaaggttccagaatccagcagattactcgggatttcagtgttcaaattaaattcccagacagagaggagaacgcaggtgggtcccccattagccctgctctgcttgttaatagtggcgcctcccatgtgagaggcggggctgtcgcacatactggtgaggctctttcctgtctctgctggaaaaccatctatgtattctgggggcttccagaggttcagggtcactccctggcctttaaaagatggaccacgtcagttactgacagagtgaccaggtgaccttcataggtcctagagacacacaaggtagccagtcccaaggcgatgaggagcgtgcagcctcatcctcgggtgtcccgagttcagtcccagtgattctcatgacatcgtttggatcgcatgagccccgtcgtagagcttcctcctccacatctcccatcactgtggggtgtcccctgtgaggsaggcagctgcagcctctggctggccagagggcaccatccaagtggccggcagttctaggagggcattcagttccccgtaccatgcttgcccccagctctgctcatgcacckggtggtggggaggcgacctgtgggatgcgggtcggttgcctctctctcacttgctctgcatttgtgaaacaaaaggtatgccctccactctgtgttatcagatgcccgccctccactctgtgttatcagtcttggttgagctgtttgggcggcaggtggccctgcagcctgctgagtgcacatagtgtcatctctctgggcatccaggaagcatgtcacacacagccattcaagcccctttgttttcctgagaatacagggtgttttgagtaggaaactaataaactcatactgcactcygtctatgttttacacttcagtggttatttaaaactttgattttgatagaatttcacagaatagtataaagacacatcctgtggcaccagtttcttttctcaacttctccccttttacacacgttttttttctgaatgtcatttttagacatgtccctttattcatggtgggtattttcttagaacaaggacattctcttacataattctagcacatttatyggaatcggatttaacattatataacagtagtatctaatatgttgtcggtattcaaatttgccagtttttctccttcagaaacacctacttccccatcctaggatcacccttgatttcaggcaggcgtctgtctggtctcctgctcatttatttacatcacacacctcctgggttctgtcttagtgataattattgttgtgtctgttttgtgacacttattgttgtgstgtctattttggtacacacgcggtgtcccagtgtggcctgtaggagcccctccagctgtcttctgtgtcctgttcacacgcctcttcacttctggggctctcgctttctgrcataaggagctggcacaggtttaccttggccttgccctttctgtctcccctagacctctcaccccccttcccactgcctctcctgggtggggctgcgtgctggccgccttccctgatgagccctgcctcacagtcaagcctcacttgtgcagtgggtctgccctgtgttcctcccatgaactaactcatctgatctcactgaagcctctgctgtagttagttgctgttagcttcatcttcaaggtgaagaagggagacacagagctcacggcctcccggcaaagccttcattgccgccccccccccccccaaggtctgggagccctctttgaggctgctgtggggacgtcctatctgctctccctgaccagaccaagacctcctgaaggacaggagtggttttccctcccttttaccacccagcacccagcaggtgcctcacagacatatgcattctgaacaaggtgtggggtctcttccagcagctgtcagctgtcccttttcccctttctctstagttcacagtacagagccagttgtccaggagaatggggacgaagctggggaggggagagaggctaaagattgtgaccccggctctccaasgaggtgtgacatcatcatcatctctggccggaaagaaaagtgtgaggctgccaaggaagctctggaggtatgtgtccrtgtgcccccctccaccccccgccaaggcccagtcagcaggcacctggggagacgcgtggcctggatkggatggacggttgcccaagcggcagtggcagtggaggtagccctcttgctcctaccgtgtgcgcacgggctgtgcttctcggctggacacagagtttggggaggccacttcccttcaccaaggctcggggttctatagcccctttctgggacagctgcatgggatccggcctctcaggcccacggtgggtgcgggggctgtggaagggtctcagctgcagggggatgaatgtgacctccagttgcaacgtctccccccgcgtgagtggggttatcaggcctagctcaccttgtgtgcagtcagtgtcgagtgccacctgcgtactggatgctgctctcagtgctgcggtgccacagcacacaaaaatagttctcacgttgccgtggagagacaagcagtcaacgcagatatatcctgtggcaagtgatggtaaatgctgtggcaagaaagcaggttctggaggtgaagggcggtgggggagacagggcagggaaggtgagcagcggtctgagagtcccttgtggcacctcgtgggcattagccaaagccgtcctgatcccaagggacagggcagggaaggtgagtagtggtccgagagtcccttgtggcacctcatgggcatcggtcaaagccgtcatgaccccraggatgtgccaggagtcagggcctctcctcctacgtgggcctgaaggggctgctgtaattcaggagggtaggcttgggatgaagggtctggaatttctgtctgccagcattagcctaatgcaaatcttttcctattcttttctattgagttaaaggtcctggtggcattgtcgggtggggcacattgctgttgtcatagggctgtttgccttgtgtttcgtggagccccattgctgagcttacaacgtcactctgctctcagctcccacggcctaaccatgaccatcctccctgcaggcattggttcctgtcaccattgaagtagaggtgccctttgaccttcaccgttacrttattgggcagaaaggaagtgggatccgcaagatgatggatgagtttgaggtagacccctttcccgggaggccatgtcacaggagtggcctgtyrcatcctctcccgagtgccagtgtcctttctcaacttcctgttgactctgcctcctcctgctcggactgggcactgacttcccttcacggcgggtggccttccctctcaccacttctgggtcccagggccaatggactctttcctgttctctggggtcctgaacgtcaagtcagccccctcttcacgtaggtgaacatacatgtcccggcacctgagctgcagtctgacatcatcgccatcacgggcctcgctgcaaatttggaccgggccaaggctggactgctggagcgtgtgaaggagctacaggccgagcaggaggaccgggtgagcaggaggtggccggggcactgcccagagccatggtgctcagctttgggcacatgtcagaatctagggaagttcttcaggatcccagcatcccagcgacatctggctggaggtgagatgcaggcagtgccaggacgcagtcagcatccaggggtcttgmtgtggaactagccaagagcatggcacctttctctttttcataaaaaagtgacaaagttggacttccgtgtaaatttgcagtttctctcaaaaccaaatcagagtggtacctcagacctacaagaaaggtcaaggttgcgagaggcccccaagcatgtgctatgcagtgaggacgagcatcggggacccccactaacctctagcacagggtggtcaaagggcgaatgacttcctggtaagcagggatgaaacccccccaacctctggcaaggctgacgtttgaaggattgtatgagcggagcgctgcagacgcccagcctctggcagggctgacatttggaggattgtgtgagcagagtgctgcagacaggagcaggggttctggaacttggagcagactgtgctggggtgctggtttgctaagggggttggctttccactcctcccgtgagcacgtygagtctggtgaatggggtggagctcgtgaacctyacatggtgtcagtgtacccctgcgtggactctgggttgtctcctgcagccaggtcatacctgtagcctttggccatgggtgttcaggggctgtggctgccccctcttcttggtctgcatctgccccagtcctaaaaagatccagagcatttctgtgcgtatccatcagatccctgtttgacaaatgaggagagcggggccccaagctcgtgactcactgcctagctctgtcagttcctgagcacgatcctcgcaagtggtcccaagccctcttttgaaggatttatagacctccttgtggagcagccaagttccctggttctcattattagcagataatggaaggtggcagaggtcggaccagagagatggcggaccattccggaccacgggttacagaacactgcagcatctccagtgtcctatgaccagggtggaaggggaatggagtcacagggtggatcagctcaatctttgcctcattcttgctcctttcatttgtaggctttaaggagttttaagctgagtgtcactgtagaccccaaataccatcccaagattatcgggagaaagggggcagtaattacccaaatccggttggagcatgacgtgaacatccagtttcctgataaggaygatgggaaccaggtgagagcctcggttggagcgtgtcgggggcagaggtgcttgttgacctttcctgtgacttgggagcagtaaccagatgtgcctagatgggggttcgagggccaagttgagagtggcaagtctctcaggacctaattctggcttgaggtttgggctgtgtctcggtacttgccagatgggtgaggtctctggcactatgtatcatctggggcctggagcattttctcctgcgtctccttccagaaaatgagcaggagctccagctgggtccttgatcagtggcgcctccaggtgtagctcattcacctgtcacccgggcctctctgaggctcccaagggctctcattcacctgtcacctgggcctcttggggtcaggtggacatttctctgcagccccagctgcaaacaccgttgtgcttgccagatggtccttagtaaactcttgttgttacttcctccaaattgcagtgccacccccctgccactggccctcatggcctcctgcttcactcagaacaaaatgaaaggcagccccatcccctctctgggccctgccacctggcatgcagggcagcctcacccaacaccccctcttgcacacacttcccaggcttggtctttcctggctctggcatcctgctggggtgtctgcttcctaggcgtgtccagcacagctttgcccacagtgggagactagcaagccttggtggccacagttgtgctggtttccagaaacagcaraccccctggcagcagagcccctccacgcccctcgctcccactgtggatgtgccgcccagggttttccgctgcttccccttccccttccccttcttcctccccagcttcttgttcccttttggatctttgagtcacacacacaccagccaggccaggagggccctcctgcaccctgcctcctccagctcccacgtcctcttccctccccacatacattttttaatttttagtcttgatcttgagagtttagttcttttttttgagagagatagtctttgtcttgttgccccaggtggagtgcagtggcgcgatctcggctcactgtaacctctgcctcccgggttgaagtgattctcgtgcctcaacctcccaagtagctgggactacagctgtgagccaccgctcccagcccaagagtttagctcttttaagcccctcacccttattgccttttatttccctctactattctatataattatcaatcttaaaagtcattataggtgagtcaccagtggctcacgcctgtaatcccaacacttttggaggccgaggcgggtggatcccctgaggtcaggagttcaaggccaacctgaccaacatggcgaaagcctgtctctactaaaaatatgaaaattagccaggcgtggtcgcgtgcacctgtaatcccagctactcgggagactgagacgtgagaatcgcttgaacgcaggaggcggaggctgcagtgagctgagatcatgccattgcactccagcctgggcgacagagtgagactctgtctttaaaaaaaaaaaaaaaaagtcattgtttagcaattagactattccatctaatacaccatgagccaagtggggtggagcagtcatttcttcacaggcagctttttcctgtgagctgtgcttccgatcttgaggttctgtacctggcagcacgcgggtggtgcctgaggctgtcagctctgctgggccacggtgggtggggctgctgcctcccactctggcattttgcttcaatctggacagaagcttcttgggctgctgctctgttgtctctaggttaggtctttctgctcatttcctttccaggcatttgtccctgtcctctagtcctgttgcgtgatgatggttccgtgttgtgatttgtccctgtcctctagtcctgttgcgtgatggttgtgatttgtccccgtcctctagtcctgttgcatggtggtttttgtgttgtggacatgttgttttcgccgattgtgggctacaggtgttttgttaccacgtttccttctctatgccctgaactgtctgcttggtctgcttgtctgctatcccaagtctggtatggtgtctcctgtccatttgtgtggcccaaggaaggcctgagcaggtgggatctctgagtgagggaggggctcgctgaggaatgccagccagcctccagcctccagcacaaagatgcctccagactgtggcccacgtgggcaaagaagcaggaagctgaggggcttggggctttgtctttgccccgctgtccttgagtccagaattcttgcctgttagtgtctctcctttgtctttgaggacaaatgtcctttttcgttctgtaattcactgtcttttgggtagagtttgggaagagatggaagctgagtggacataggttttttgtggggtgttttttttttgtttttttttttttgagatggagttttgctctgttgcccaggctggagtgcagtggcgcaatctcggctcacagcaacctccgcctcccgggttcaagcaattctcgtgcctcagccccgggagtagctgggattacaggcgtgcaccaccacgcccggctaatattgtatttttagtagaggcggggtttctccatgttggtcaggctggtcacgaattccggacctcaggtgatccgcctgcctcggcctcccaaagtgctgggattacaggcgtgagccaccgtgcccggccctgagtggacattgttaacctcttgttttaaatcagccgtgacgttgctttccatcttctctcctgagctgttttcctcagcagtgggggccggctcttgcccctgacgggaatcccagtaaggcatccccttttctgactacattctccttttttagccccaggaccaaattaccatcacagggtacgaaaagaacacagaagctgccagggatgctatactgagaattgtgggtgaacttgagcagatggtttctgaggacgtcccgctggaccaccgcgttcacgcccgcatcattggtgcccgcggcaaagccattcgcaaaatcatggacgaattcaaggtgagccggctggaagcacagtgggtgagaatcctctctcaccgggggcacctggctggccagaagaaagagcagggcatggccttcccctcaagatgatgaggccacaaccccagggctggcagtggaactgtcctcatggacaccacgggtcagtgcaggcgacggcctgtgtgaggctgcactgccacggtggccattaggagggcatctccttgacagctgcctggcgagctcgtcctctgtgggtgggaatttcatgcaagagcgcacagtacgtgctgcggccctctgtctgctgggaacaaggtgctcctgagatacacctaacttggtgtggtgatgaggctgactgacttcagaacaactctgaaaccagattttaaaacgtttgctaactcagaaaatgcttcactagaaattgacacataattttaacccttttcctcgcttggagtcccctcatctgacgttgtacaccccttccaggtggacattcgcttcccacagagcggagccccagaccccaactgcgtcactgtgacggggctcccagagaatgtggaggaagccatcgaccacatcctcaatctggaggaggaatacgtgagtctctgtgggccttggagccctgaggcgccctggcacgtccaccggcctgaggcccagccaggagcttcaggggacaaggtggcacttgtgtttccagaggcaggcgaggtgcaggggtgagcaggcgggcgggatgctgggggtgctgggcagactgaccctgtcttcctgtcttctgcctgcagctagctgacgtggtggacagtgaggcgctgcaggtatacatgaaacccccagcacacgaagaggccaaggcaccttccagaggctttgtggtgcgggacgcaccctggaccgccagcagcagtgagaaggtcagatgcgggcttctgccctcctgggtcccagggagggtgggcgggcaggcgggcttggtgtcctgagggtggcaactgcgtcggaagctgcttgcgagttggggagcatcccctcctgaagccgtgtcctctctctgcacaggctcctgacatgagcagctctgaggaatttcccagctttggggctcaggtggctcccaagaccctcccttkgggccccaaacgataatgatcaaaaagaacagaaccctctccagcctgctgrcccraacccaacyacacaatggtttgtctcaatctgacccagyggctggaccctcygtaaattgttgacgctcttcccccttcccgaggtcccgcagggagcctagcgcctggctgtgtgtgcggccgctcctccaggcctggccgtgcccgctcaggacctgctccactgtttaacactaaaccaaggtcatgagcattcgtgctaagataacagactccagctcctggtccacccggcatgtcagtcagcactctggccttcatcacgagagctccgcagccgtggctaggattccacttcctgtgtcatgacctcaggaaataaacgtccttgactttataaaagccaaacgtttgccctcttcctttcccacctccctcctgccagtttcccttggtccagacagtcctgtttgtggagtgcaatcagcctcctccagctgccagagcgcctcagcacaggtgtcagggtgcaaggaagacctggcartggacagcaggaggcaggttcctggagctggggggtgacctgagaggcagagggtgacgggttctcaggcagtcctgattttacctgccgtggggtctgaaagcaccaagggtccctgcccctacctccactgccagaccctcagcctgaggtctggtgagtggagcctggaggcaaggtggtaggcaccatctgggtcccctgtggccgtcacagtgtctgctgtgattgagatgcgcacaggttgggggaggtagggccttacgcttgtcctcagtgggggcagtttgccttagatgacagctgggctcttcttcacaccacctgcagcccctccctgcccctgccctagctgctgtgtgttcagttgccttctttctacctcagccggcgtggagtggtctctgtgcagttagtgccaccccacacacccgtctcttgattgagatgtttctggtggttatgggtttcccgtggagctgggggtgggcgccgtgtacctaagctggaggctggcgctctccctcagcacaggtgggtcagtggccagcaggcccatctggagtgggagtgggcacttccaccccgcccacaggccatccggctgtgcaggccagcccctaggagcaggtcccgggtgactggcagttttcayggtctagggccgagacgatggcatggggcctagagcatgaggtagagcagaatgcagaccacgccgctggatgccgagagaccctgctctccgagggaggcatctgtgtcatgctgtgagggctgaggacggggccctagtctctggttttctggtcttaacatccttatctgtgtccgccacggaggtgactgagctgctagygagttgtcctgtcccaggtacttgagttttggaaaagctgactcacgcccatccatctcacagcccttccctggggacagtcgcttccgccttgacacctcactctcagttgaataactcaagcttggtcatcttcagackcgaattcttgagtagacccagacggcttagcccaagtctagttgcagctgcctcggcaagtccccatttgctcaggcagccctgaatgggcctgtttacaggaatggtaaattgggattggaaggaatatagcttccagcttcataggctrgggtgaccacggcttaggaaacagggaaagaaagcaaggcccttttcctgcctttcccgggatctgtctactccacctccacgggggaggccagtggggaagggctgtcacctcttccccatctgcatgagttctggaactctgtcctgttggctgcttgcttccagctccccscaatctccatcgcagcrggttcctcctgtcttttctacagtgtcataaaacatcctgcccctaccctctcccaaaggtcaattttaattctcaccaagttttgcacatctctgtatgtcgcttgatgtcttagacgcgagccctttcctaaactgttcagcgctctcttttcctttgggtggttgttgcaagggtgatgacatgactgtccccaggcctgtctccctgaagcgtctgtgctgtcaggacagccctgggcagagatgaggcaggggtgaggcgtgcgtgtgcttttcctccttgttggatgtcttccatatcatctgtttccatagctacaatccatcccttggccttaactttggaatttggagattatatgcaaacatgtgtaaaggctcatgaatatggatgacactggaattttataaattctaaaataaaacccgaaaccagatgtagcatgctgggactcattttgtcacgctgccgcctgtgtgttctctttctcgtcaccctggagtggtgactggcatctgtgggtagttcgtctttggtgtgattttctcagcagttctcaacactgtgttcaacrgcccctcgggagccacaytgagggagacccaggtgtggtcatggcaagagggtggctgcctgtccctgtcctctggctgccagacagtcagcagttgccctgcagccctcattgagggtggacaaccgtccttgtggagcagcacctgccactcccttttaggactctgccagcctcagtggcattcctggcaccctggacccggcctgtgagttatgacgagctgagttgggtggtggggggtgcgggcggaggcctcggctggaggaggaggagggaggggcgttgagtgggaggagccaccccagtcacctgagtggcaggagataacgggaagagtcaagagggaataggtgttcctgctgctgactgggctggtccccacctgggaagacgggtatggcagttcctcttaaagccaaacatgttggccgggtacggtggctcacgcctgtaatcccagcactttgggaagccgaggtgggcggatcacgaggtcaggagatcaagaccatcctggctaacacggtgaaaccccgtctctattaaaaatgcaaaaaattagctgggtgtggtggcgggcgcctgtagtcccagctactcgggaggctgaggcaggagaatggcgtgaacccgggaggcagagcttgcagtgagccgagatcgtaccactgcactccagcctgggtgacagagcgagactccatctcaaaaaaaaaaaaatgccgaacatgtttatccctgacccagcagttctgttgggccctaaatatgcaacccacagtaaagcacacaactgcaaaatgaccctaagccaaacacgaagcagcccagcagccaggaggggctgagatggatgctcggcatggatggagctcgcgcaatgtcccacggcagacgccaaatgcaaagtccccagttccatctctgcttggtggctaaggtggtggctactctggatgggaaagggtcacaggcagggtagggcgcatgtgggcatcagggccctggatgggagagggtcacagggtagggcgcacgtgggcatcggggagcttccacgtcgggtgatgtggaacttgccttttacccacgtgctggttacaacagtttgttcacctggaagcctgtatgaactgagcattttcgtacgtttcaataaattcaccttaaaactttggagtttaagacagcaacaataaaaagcaaccagctggaaggaagtacacgtgggtttgtagtaagcattgtgctgagcgaaagcacacgtggaatggctgagctccccatctgtgtaaagtttccaaggttcccgccccgggccgtgtgtgctgtccgccatgctccggccggtggtgtccagccccagggcgctgtgagcctgcatccctgccggaagagcccttccatggaggcagggcacagtgctcctaagaggcaggtgaacaagtagcaaatcctcaagaaatgctacaagcaagcacgccgccctcaggccaggcatcacggtgggtgaaatagaacgcaggcgaggatgttcagaaagaggccttttctgtggagtaagtttggcagtactcatcaaagcacattaaaaccacatattctttttgtgtgtgtgtgttcccgagacggagtcttgctctgtcgcccaggctgtagtgcagtgttgagatctcagctcactacaacctccgcctcccgggttcaaacgattctcctgcctcagcctcccaaatagctgggattacagatgcccgccaccacacccagaataatttttgcatttttagtaaagacagggtttcaccatgttggacaggctagtcccgaactcctgaccttgtaatcctcctgcctcagcctcccaaagtcctgggattacaggtgtgagccaccacgctcagctaaaaaccacatattctttttgacacttaagttccacttgtagaactccaaggacatcaatacagatgagcacagatccattttttagcaagcagacggccacactgggattgctgcggggtagcaagttagccaggggaagcttcatgtggctccccagcacagggcagaactgcacgtcacattatgatccagcgtggaaaacaattatgtatgaacacaaacttctgggggaagagccaccagatgttacaggtatacacgtttcctcctctcatcccaaaacctcccccatttgggtgcttgctgggtactaggccccaaggaacagaggtaaaaacagcaagaggggccctgggccaggggccaggagctgggagagggagggaagttgggcaaggatcaaaaggacacatgtaattgctgcagaatgcaagtaaagcggcactgtcagaggctgcctgtagtggctagggggaaagcagagcctgattcaagaaacagaagaatccagaggacccagataactgggaatggagggaggggttcaacagacctttgctgtggcctgggacacagagctgcagggtccgagagctggggcatgtgggtgatgtccctgcgcaaacagggcaggaaggggcgggtgggtccagaggacacgagggagaacggccctgcgctctgaaacattcgaaggtcaccaggtgtaagaggagagggcgatgtggccaggggcggcgaggaccacaaagcccacctgcctgaggagaactgtcgtgtccaggggcctggggaggccaccgagggacagggtcccttgggtgcaggggccccttgggcttatgtctgggagcaggaaacaaagagggccttgtgagctgacggtccctccctgccggggatggagtgacaggcgctctgaggagagaagccggcgctggggggaagcaggcaatgtgcccagagatgaggcacaacagcagccagcggttcacacagccgctgcctgagggaagaggaaaaggacgctgctcgcagggctcaggaggggccactcccctaaggaccaccagatgtccttccaggcgtcactgctgcagctggctggccttgggaacygtgaagggtgtccagtgggagctgagctggggagagggttgggggcagggacaagtcagactagggccaggagcaggccatggccacgaggcacagtgggcggctgggcagggccctgtgacctcagggagtgcacggggcaggggcctggctgctcccagacttgcctctgagccctcgggctgctcatcctttgttccgttcgttccaaaaagaacctgtccccaaaaaagggcagcaagaggaagagggatgtgactcagtgtccggaggtagagcagccactgacaaggatagggagagggctggggggagggccgagactgggctgtacagttcacctcattctcagccagtgcctgcttagccaggtagtactcccgcttcactttgatctccacagactctgggatgtcaggcaccaggaggtccaggaggcggccaacggagaaaaccacatgctgggagcagaggaaggcactcacgcccacccaaacgcccagagtggccttcacagggccaggcaggccggggctccggcacctgctcccagctgtgggtggagtcagaaagcagctgtgcaggaaaaggaaccccagaaggggcagaggccaccccagctttcgtggccctggggctcctgtggagacacccacaatgtccacaccacaacccagggatgaggccaggcagggaaaacgcaggtgcagagaagagctctgayttgaccaagatgacacagcaggaagtgacggcaccgacccctcaccacgtgctcgaattaggcaaagcacagggtcggggcctcatgccatggatgggagaaccagcaggtgcctcggctacctcaaacacaatgacgaaggccaggcggatggcaagaagattccagtaggtctgggaataatgtccatcgtcatcccggaaagcccgatacctgcagcagacacaggactcagtgcgcgcagccagggctgagtgttggctgggcaggtgcctctggaattagcctatctcccctttttccaccatttcgctctctcatcccatgttcctggcctggctcttcatcgagggtgcctgaaatgggaattcttcccaaacaggatactctgacaatacctttaactggtgggttccaaaggtggatgtgctgggttgtcccccattgggctaaactggaccctccccaccccccaggtggcagatgctttattttctagtagatgtgacagtccagtacgtctgtgcttctacggatgacttcagtctacttacacggtgaaaatccgccgattgctgacctctgtgagatcagcagttcacctgctcagagactgtccctgtccagcagagccctccctccctatcataagctacattcagcttcacttgctatttcagactttgacatcttcctgtgtctctgtcccatggtaaagatgtgacattccattttctaatataaagttacatgttgcactccatgaaaactattaccagggtcaactttgtaggaaaataaaaaaaacaaaaaaccaaatattgcaagttaaaaatatagccattggaaaaaaaatccctcaaatgaatggaataaacttttaagtggccagacacagcagaagagagactggggactgggagacagtgacgacgagaccaccctgcggcaacacagagagcacacttggggggaagcaggccacagcccagtgggagttccagacgacaatggacaagcagagaagcactgctggaaggagtaagatggagacatttccagaactaaacaaagacgtaactctttcagccgggcgcggtggctcatgcctgtaatcccagcactttatttatttatttatttatttatttatttatttatgagacagagtctcgctctgttgcccaggctggagtgcagtggcgtgatcttcgcttactgcaacctccgcctcctgggttcaagcgattctcctgcctcagccttcctgagtagctgggactacaggcccgtgccacaatgcccagctaattttttgtatttttagtcaagacggggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtctcattctgttgcccaggctcccccccagtggcgccatctcggctcactgcaacctccgcctcccgagttgaaatgatcctcctgccccagcctccagagcagctgagattacaggcgtgaactgccacagccaggttttgtttgttgttcttgtttttctgagacggagccttgctctgttgcccaggctggagtgcagtggcacaatctcggctcactgaaagctctgcctcctggattcacgccattctcccgcctcagcctcccgagta

SEQ ID NO: 17754 - DNA, 98716 bp, Homo sapiens
aggaagctggtaggcaggcgctagaccctaaagaaggactgctgagccagttcttaagcctgtggtcctgtcggtgaggaaagtgagagcagtccagagcaggtgaaaagagcagagctcattcctccagtggctcttttgcctaaagcagcattcctcaaacttctcactcgaagcattaagttacggtgagatgctaacacacgctttagacttaagtcaaaatttactgtgaagccacagcaaaccatggcttcacagatgaattagttgctacacaaataagttcgatacataagtacagtaattgcttttaaaccttataataagcagtaaattagaagttaaaccatgtttttcttttacgaactgaaagaagagaatgcttttgatactgagaatcgcacactgtgtccaggaagattgttcttgcataaccagacccacaataaatatctacaacttttcttacatgtttataaaataaatcttagaagaaaaatattgtagcttttttttttttttttttttcaatgaagctctatgaacatttcacagaactttgttcctgggagtagttagggaaatgctgcttcaaaaagccaattttaagtagttgtgaggcatccgagtggaatttggctgcactatccataaaactagagagtataggcggtatttcacctaccaaggtcagtaccctgcctcaggattcttactgttcatttgagcaattccggggccctctctggatgaccaggttcgtaaatagttgagactttgtgttatctcaaattgtcaccatcacctctgggccaatataggttagtgaggtcgagaggcccacaccattgacagaagagaattctcaggccgggcttggtggctcacgcctgtaatcccagcactttgggaggccgaggcgggtggatcacctgaggtcaggagttcaagagcagcctggccaacatgttggaaccccgtctctactagaaatacaaaaattagctgggcgtggtggtgggtacctgtagtcccagctacttgggaggctgagacaggagaattacttgaacccgggaggcagaggttgcagtgaggtgagatcgcgccactgcgctccagcctgggcgacagagcgagactccgtctcaaaaaaaaaagaaaggattctcaccttcctgtcccttcctaggagttttgtggtagtgttcgatcctgtgatgtggccatcttctcctcagggcctgtgagaggcaggcagcatctttagctgaggtagaatgcctgttggggaaagtcaaataggatggtggctggggccggggctctggggactccttctgccccacatactcaattggaaagactgagcaagtcccctcacctccctgggcctcagcttccctgtctgtcaaatggagggctcaactggggtgagctccagtttccttctagtgctaacgcgtgttcaaggatccttgctctcctttccggggagcatcaggggtgtgggctagatagcaggaaagaagtaggggtttgtaaacaagagatccaagcccctggacccttggtcccagcacccagtgcagccctcgccctcccagccccttccttagaaaggacaagaaaatccactccttgttctctccctgtcccatcacccccgcagtcccccacagatctgaggccggaggatgccaacatggtgagcaccctcttgctgtcttattcacgtaggcttttcttggtgcctgcacatggctcttgtaaggccaccaatcttgctggattatgacctcatctaaccttaattacttcctaaaagccatatgtccaagaagagccacattgggggttagggcttcaacatatgaatttggaggacatttacagttcagtccacagcacctggtcatgtggagatcccagtctgcatttgtgggatgaaatctctgcttttttaaagtttacacaccacctagctgggcacgtggctcacacctgtagtctcagcactttgggaggccgaggcggggatcacctgatgtcaggagttcgagaccagcctggccaacatggtgaaaccccgtctctactaaaaatacaaaaattagccgggtgtggtggcgggcacctgtagtcccagctactcgggaggctgaggcaggagaatcgcttgaacccaggaggcagaggttgcagtaagctgagattgtgccactgcactccagtctggatgaaagagcaagactccatctcaaaaacaaaaataaaaaaagtctacacaccaaaagagctgaaggcaggagagtttgtggtggttcagagtcctgattctggaggaaacaggcctgtttggagtcccagctctgctccttactagctatgtggcctctcagaggcagcatccttatctgagaaatcgggttgaccttgtaggtggctgagaggctcagatgagggctcgcatgtgaggccttggcactgagcagggcactcctactgagtgttcaaaggtcgtgagtaccactgctctgcagccctgggctctggtctcagcaatgccgtcactctttctggcttcctaagagtcagaaggcaagtgggagaatagaaccatttcctgtgtctgaaggctgtgcctcagtgcttttgactcactctgaagacagcaggcagccctttctgttttttttggagatgaagtcttgctcttgtcgcccaggctggagtgcaatggcgcagtctcggctcactgcaccctccgcctcccaggttcaagcarttctcccaccatagcctcccgaagctgggactacaggcacacgctgccacgcctggctaattttttgtgtttttagtaaagacagggtttcaccatgttgcccaggctggtctcaaactcctgaactcaggcgatccgcctacctcggcttcccaaagtgctgggattacaggtgtcagctaccacgcccgacccacaggcagccctttcacctcacgccgagcacgtctcctccatccatgaacattttgcaacttttttttaaagagacaggttcatactatgttgtctagattggactcaaactcctgggctcaagctttcccaagtagcttgaacctcttaagtaactgtgactacaagtgcacctggccactttttctgagacggagtctcgctctgtcacccaagtggagtgcagtggcatgatctccgcccactgcgagctccgcctcctgggttcacgccattctcctgcctcaccctcctgagtagctgggactacaggcacccgccaccacgcctggctaattttttttgtatttttagtagagaccgggtttcaccgtgttagccaggatggtctcgatctcctgactttgtgatccgcccgcctcggcctcccaaagtgctgggattacaggcgtgagccaccgcgcctggcccacctgcccattttttaaaaactttattcttcctggtatcaaggggagaaagaaaaaaattttttaaaatatttaaaactttattttgaaataatttcaaaatcacagcagtttgaagggtacaacaaagaacattttgccacattttctctttcattcgttccctcctcttctccctcacccctgtttcttcctatcctctctgaaccatgaaccatttgaggattatttgtatacatcatgctcgtttatccgtaagatgttttagtgaacatttcccaagaacagggacagcctctcacatgcccatggtacagttctcaaattcaggaaatgtgtaatattctctgatcagcccaggagttgctaatttgtagttcctgtttcaaatttgccaactgtcccaataatgattttgaaagccgttgtttttctggtccaggatccaatccaggatcaagcgctgcctttagttgtcctctctgcagcctcctttcgtttggagcaggtcctcagcctttctgtctttcatgacattgatgtttgtgaagagtacagtccagtttctgttgtagaacgtccttgaagttggtcccggaatatttgtttaaagtgagttgggaaaccacattcacatgtcttttggttatgtgtgtatttgtcaaacagccagccttgtgctgcgtgctgtgatggggagcattactcaacagagcctggccctgaccttggggatgtagtttgggtttgtggggaaagcagctaccgccaggtgggctttacggacccctgtgtgtctcatgactagaggcactgacgcttggataaatacatactggatggatgcaggatgagtccgcattctagaagtgtgcagaggtacagaagtggccctgctccctgtccagcacccagtcatcagctttccctggcttcccgaggcaccctgacgttcacactccaaacacaaagtcttctctcaggaatctcgagtgagctgcagtctgggttctagccctgccctagcagggatctgctcagtgactgggctgctctcttcctgctttaggccaatgcgggggagaggagaccactgtgactctccccagtgcccttggagcgcagaatgaagtgaggggaggaggagggtcacgagccctggagcgctgggaagacaggctgtaggccgcaggccccgatcctgcctgggacgaggttcaacagaagtaggatggtttcatcatgacctggcaggaaaaccaccagacctggaattttgcttttacaactgtttaacttctgtttcatacaggatggaaaccggtgaattgtaatctcacataaccgagcaagatctagtagtcataagcactttgtcagagcaaagcagacaaggcaaagtgttggaaatgtcatcggatcttcacagaaccttagccaagcagcctttcaatgcgagaaacaaaataacatggatttttatctagtaatgaagtcaacaccattgtccaccctgggttaacacattcacatctcaaagcgaatggggctgcagacactcatgttagagagccttggaatgtcctgcctttttacgtttaattaaaattaaataaaatatacaaaattcagttcatcagttgttctagtggcattttaagggtttagtaccatatgtggctcatgagtaccatcctggacagcgtcgacctagagcagttccatccccgcgcagagttctgtttgacggcgccactctgcacttccagcagcctggggagcaggggtgcaggagagttccttctgtgtcacagacttggtcacacagtacagatctcagatcagcacttaaacacgactgccagctgtcaacggcgtgttctgtggaatgctgggatgcatcacaggtatgctggaagatgtatagaattttacttctgttattctggtaactcagagtcctgttcagtcagtttccacgtcaggwtgctgtcctggttttaaagagaatgaacgcagccgaagttgaatcgaggcagtgatttcactcagtgcgttgggtctttccactcacctggccctccagaaccccagggccttgagtgcatgggctggtacaagagcccagtttttggctggggaggcacttcctatgggagggggacgcctgtctcagtgctgaggcaaccaccaccgaggaccctgggctggaagctgggctgagatgtctggtggtaggttctgaggcaggacaggggaccgactcaaatggatgatacgaacggcaggctggattcacgttgctcctgcacctccagcatctgctgaggacacctagaactgtggccctggccaaacctcagctccctattccatgaaagtgtgggtcaaagtgtgggtggtagagtggggctgacagtggcccctaagctcctagggtccagcccacaactgaggaagccacacggctggttgtgtacgagccggagtgtctctgtttggttgaaagtgccggtctgtgggtccttgctggtgtgtgtgcttctgtccccgcctcctggcctcctggctgaggggaagctgagtgggccacggcccatgtgtygcactcgcctcggctcccacacagccgcctctgctccagcaaggatgtggctcttccacactctgctctgcatagccagtaagtcctctcacccgctgcttcgaggggctsctgtgccctcagctccagccaggtgtctgcagactacagccttgactgtctgtctctgatggggctcagttagagccagaggttagagagtggcagctcctccaggaaaggagtcttgctcggtgggtcagrgccccaggcwtgttgggaagggcggctgaggcttcrtgttgccagttctgtcagccagggcctttggactccagggctctgccattctgttcctcctccagccagcctccccccgccaccgaggccctctccccatggcacccacttggggcaggtccttgactctgtagtttgttctctgagtgtggaggctccgcctggcagagctcccttctgttacagagcaggggttgggctgatgagggtgaggaccctgtgagagagtgttgaccagagactgggggcaagtgtctgtatggtagagggtgtgagtgttggcagggagcctgcttcctgtgttgtcaggcccagggtaaaaactggaatgtggggtggggggaggcacttctgctgcctggggggtcccattttagcctttaactgtcccatggaagcctctgggcaagccaagccatgartcctttcgggggccccctgtgatgagacagcacggtcaggtgagcccctggaggctgctaagattaagccggaggccagggtggtcctgcctagtgatctgagcagacttcccatgggtctcctgcccctgctcaggaggttggccggagaattggatgggcatcaagcttatgtggatgaaaggctcctggtagctgagttctccctgaaagatgggctgaggctgtgctgggaggggacttgggattagcatcccacctggggccagatcacccaggaagcaggccacaatgtgtagggtaccagcaaggaacacgtttttggacagattttaatattttatatttcattttattttattttattttttgagacagagtcttgctctgytgcccaggctggagcccaggctggatcttggctcaccataacttctgcctcccaggttcaagcagttctcctgcctcagcctcccgagtagctgggawtacagrygcctgccaccasgcctggctratttttgtatttttagtagagacagggtctcaccatattggtcaggctggtctcctgccctcaggtgatcgacctgcctcggcctcccaaagtgttgggactacaggcatgagccaccttgcccggcctaatattttatatttcaaaaacatcagaatagtcaccatggaaaggtcaacagtttgttgaacttccttttattttacaatttagacttctctgtttttagttacatgtggggtgtggagagagtctcactctttttatggcttgtggctttgatctcccattaccaagaatatctggagcagatgcttagactagactcttgtctaccctctcccagtacagaggaggtgactggggcacagagcgggcagtgactacccaggcttgcaagcaactgataatagacacgaggctcaagcccaggcctctgtcctgcctcccagctccagaatactcctgtggctcatctgtctcctttagcctctgagaccaccacccatcacctcagtgccttttccagcaggtggcatcgatcaaacctcttttgaggcctaggcccttcccaagctgatgggcagcagagagcgatgatggagcagacttgccatgagaccacttagcccacagctcagctcagccacgggaaggggaccagagcagggcccccgcagctccggtgtgggtggcggaaacgaggctgctgcagttctgctccatgctgtgaggtcctgagactaggatgggccagtccaggagagtttcctggaggaggtgaggtggcgttgagtcttgggggctgaggagagtctgagaaagaaaatgtccaggagatgctgggaggaagaactccctcagactgtggctccaggcccagcaccctgtaccctgtgccgggttgggcctccttaggctggagagaatccaggactggcctggcctggccctgaccttccactctctccaggccagccactctggtgatgcctacttcttatttgtggcagcagacggaataatagcagttgtctaagggagattttagaagcattgggtgcagacagacactgaaaccctggaactgtccacaccctgaccaccagccccatcatgccctcttaccctgtggcctgctgtccccaagtcagtcttcacccctgactcattctgcagtcacatcaactcacttctccatcctgggtctcagaggttgagtttccacccttgcgtgaagaagcctgtcctgtcagcctacaacaccttacaggggtgaagaagaaggaaccagaagtccagggcccgctctgctggtggcacgcactcgggctgaggccaggggctgtgccggggcatcaccccgggcctgtgcgtgatagaaaacctcagtccttggggagtgggagactgtagcatctgaggtgggctctgaaggacggggaggtccttggcaagtacaggctgggggtgagcagaggggccttctgtgcaggggggataggagggaccaagccctggggtgtgaagagtctggtttgtaggaagatggaggcgaagtgtgagtgggagcaggagattgtctcctctggtgttgctttcccttccagccccgccccaaatcgggacatgctgggccctggaggtgcgggcagaggcgaggccacccctatcccagcccctgtgtgaagagaaggcaggttgtgcacacagtagcctccccggccccggcagggtgtcacagcacgggggtagggaaggggcactccaggcagaggggcagcccaagcaaaggtgaaatgcccccggaatgcagtgtgtgggggagagctggctgggggagtgtgggccgtgtgggagccccacatccctgcccttctctgggaggcctgcattcgtgtggcaggtgtggtataagtggaggaatgcgggcatccagtcccgagaggcccacggtggaggtggtgaggaacgtggggacctgagtgccggcctgggggagcttggagttcctgctgagggcagtggggagccacagaaggtcttgaccaggatggcgacagaattgtatgttgtgtgttagttggaatctgggggagaggggaggcagagaggcccgtgaggaggctgctgccttggccccatctgcggctgttgcggaaggcagacgtggggaggaggacacactcatgagaaacgtttagtttcctggccaggcacggtggctcacgcctgaaatcccagcactatgggaggccaaggcgggcagagcacttgtgatcaggagttcaagaccatcctggccaacacggtgaaaccccgtctctactaaaaatacaaaaatgagccaggcatggtggtgcgcacctgtaattccagctacttgggaggctgaggcaggagaattgcttgaacccaggaggcrgaggttgcagtgagctgagatcacaccactgcactccagcctggaagacagagagagacaccgtctcaaaaaaaaaaaaaaggccaggcgcagtggctcahgcctgtaatcccagcactttaggaggccaaggtgggcagatcatgaggtcagragatcgagaccatcctggctaacacagtgaaactccgtctctactaaaaacacaaaaaattakctgggcatggtggcgggtgcctgtartcccmgctactcgggaggctgaggcaggagaatggcgtgaacccgggaggcggagcttgcagtgagccgagattgcgccactgcactccagcctgggcgacagagcgagactccgtctcaaaaaaaaaaaaaaaawatawatatatatatatatatatttagtttccagcacacagtagtgctcaaggcctgttggcctttcttgttattagggagatgaagggtgagggagagagatgggctcagctgactgtgaggtttggggtggagttgatgaggctccgtgtagaagatcgaggtggggggactgcggctggctgcagatggctctgaggcacagtgctcccacgaggccccgctgggtgttctgggcggggtgtcgggacccctgcatctagccccacttcttcagctcctggtatcagtgtgggcaaatcatgccccatgggcctcggtttcctaaattgggaatcgtggtacttattgtactgtgagaatgtgagttgaaattgcccggagtgctgggggagacagagggttgaggggagacagtggtggctgacaggatggagggggatctcggtctgactcagcaggcctccgtggctggggacagctcagagaggtggtcctgtgggtagtgtggtgacagacactggtgtagctatgtctgtaagtcagacaacacgggaggggggattgggagggagggccagccctcgcctgtggttataactctctccaacctcagcctccacgtgctgagcctcctgcgtcagacctggggccgcgtatcgccccatttgatctgcacagccccatgtcccagaggggagacggaagcgaggtgccaagcccagggtccttcagtgactccaaggcagtgaggatttgaactcaagaccatctaccaagacaatgctgttttctgagtcctggtgggaaatgcaacaggaggtggtttcctgatggaggcgcagctcaaaggcaaactgttgggcctggggcgagtccagtctgaggaaacaagctgagccaggcctggcagacctgggcaccagctggctctcagggaaagcccagcaaatacagcgaactaccccaccacacacacacacacacacacacacacacacacacacacggatgcacacacacacacacggatgcacacacatggatgcacacacacacggatgcacacacacagggatgcacacacacggatgcatacacagggatgcacaaacacggatgcacacacagatgcacacacggatgcacacgcacacacgcgcacatggatgcacacacggatgcacacacacagatgcacacacggatgcacacacgcacacacagggatgcacacacggatgcacacacacggatgcacacacacggatgcgcatacacagatgcacacacacggatgcacacgcacacggatgcacatggatgcacacacacggatgcacacatgcacacacagggatgcacacggatgcacacaagcacacacggatgcacacacatgcacacacacacgtacacagtctcatgccaccgtgcctctgcggcaggctcttgctgacctagttaccagccctgtaagcagagccctgctccagctcagtgagccgccgcacggcaggagcagtgcccagcttcttgaggccatttgtgaccctggcctctctctgtttaccaacccctcggtgcctccagctattactaaaggctttgaaatcgggcataaacacagaatctgagccccagacacaaatattcaatcttccgacgggccatgcacaaaccacacccctctctgagcctcagcacctagcgtggtgcctggaaggcaacaggtgctctgggggagcggaaccctcagttgaacaagatctctgttgaacaaagtgaacacaggggtggggtggcgtgaggaaagggaatatctggcccactctgacctttttagagcaccttttttgggtgggcctggccctgcgctgagctgggctctgtggctgggggtgttgtgtgtgactcagatcacatcacagttcagggcagacaaactgaatcacagatcaccctgatccagacagaatttggtcacagccagacagaccacaggatgctgagggggctcagggtttggtcagagccagacagaccacagggtgctgagggggctcagggacccgggagttactctgactgagtctggattggctcctggctcctggctggctgagcagggccacaaaagacgggctttgcagacagaggtggagagtgctgagcaggcctgctgggtggagggagccgctgtgtcgaggcctggaggcaggagtgtgcagagggtgcgccgggcagagcgggggggtgccacggacgcccaggagaggagactggactttgctctgcggcctccactcgtgccttttcagttataccgacagtgaaacggggggaagaaggccccccacccacccctcgtaacatgttggcagctcgcactttttaattctcctctaggcagtttgctgacgtcctgttttttccccagagtgactgaccaggaggcacagggctcaacgtgacgtgggccccggggccggagcccagactccctgctgggcatcctttatctcagttctggattcgtgggggagcagcgggaacagtacggccttcttccctgcctaggggtcttgatctggaacctttgagagtctatgtaggctgtaagtggccactctcccagcacctaccgagggtgggccaccatgccaggccctgagataatgtggcgatcgaggcagatgcagtgtgtgcccccttggactcactggtggcagggggcagtcactggcaatagggaaacaaggaaggccaagcacagtggctcactcctgtaatcccagcacttagggaggccaagactggaggatcacttgagcccaggaatttgagtccagcctggacaacatagcaagacccccatctctacaaaaaatttaaaaaaaaattagaggccaggcacggtggctcacgcctgtaattccagcactttaggaggccgaggcgggcggatcacaaggtcaggagttcaagatcagcctgaccaacatggcaaaaccccgtctctactaaaaatacaaaaattagtccggtgtggtggcaggtgcctgtaatcccagctacttgggaggcttaggcaggagaatcgcttgaacccaggaggcggaggttgcaatgagccgagatcgtgccattgcactccagcctgggcgacaatagcaagactccatctcaaaaaaaaaaaaaaaaaaaaaggatgaagaggaagccaggagacaggctgaggacagagcacttcaatcaggcaaggggaggattttgtacacatgtgcactcaggggatcaggaagggctccaatgcttccatcagattctcaaagggggccaggtgcagtggctcacacctgtaatcccagcactttgggaggccaaggtggtggatcacgaggccaggagttcgagaccatcccggctaacacggtgaaaccacatctctactaaaaatacaaaaattagccaggagtgctggcatgtgcctgtagtcccagctactccagagacccagtattttgagtcctggcctacactcggtaggtgctgggagagtggccacttacagcctacatagactctcaaaggttccagatcaagacccctaggcagggaagaaggctgtactgttcctgctgctcccccacgaatccagagctgagataagggatgcccagtagggagtctgggctccggccctagggcccacgtgagacaggagaatcacttgaactgaggaggtgggggttgcggtgagccaagatcacaccattgcagtccagcctgggtgacagagtgagactccaactcaaaatgaagaaaaaaaggccgggcatgatggctcacacctgtaatcccagcactttggaggctgaggcaggtggatcaggacgtcaggagatggagaccagcctggccaatatggcgaaaccccatctctactaaaaatacaaaaaattagctgggcatggtgatgggcacctgttttcccagctactcaggaggctgaggcaggagaatcgcttgaacrcgggaggcggaggttgcagtgagacgaaagttgtgccactgcattccagcctgggcgacagagtgagactctgtctaaaaaaaaaagaaaaaagaaaaagattctcaaagggatccattacccccaaacaagaacgtctggtctggttatgtttcctgtgttttctactttggggcattggcagggaggacacaaatcacaggtctgcaaaagctggggtgcagggtttcttcattgtgttctcacaaaggacccttagggacagttttttctctgatttgaataaccagactggttgtgctttgcctggaagtgttttgttttttgaattttgtggacaccgcatggcattaactgatctttttcatgttgatatcaccttcaagaaagcttcattcattcatgtatgcgttgaatcaacaaatgattttattaagccaaaggattttaggaacacttctgtgagccagcgctgtgttcagagccaacagtggggcacgtgatagaaagtgctggcactgcgtgatctacatgttagctgttggcctccttcctggcttgttgtatccccctctttttttaaaccatcattttccttctgttcttttttgcctgccccattattttaagcgagttttatcttacctgtattatgtatttttatgaatcaccacaaatcattccaggcgaggcagagatgtgaagaaaaaggaataaaatatagatatcaggccgggcgcggtggctcacgcgtgtaatcccagcactttgggaggccaaggcgggcggatcacctgaggagttcaataccagcctgggcaatayggtgaaaccccacctctactaaaaatacaaaaattatccaggtgtggtggtgcgtgcctataatcccagctactcaggaggccgaggcaggagaatcgcttgaacccgggaggcagaggctgcagtgagccgagatcgcgccactgccctccagcctgggcaacagggccagactccatctcaaaaaataaatacataaataaaataaaattaaatatagatatctactttgtgccagactcagggaaatggccttaaatgcagggatgagagatccagagcctggcctcagagccatctccccaggttcctcctcctcctcaagtctggaaggttgatttttggataataaaattttaagcatgtacacaggtaaacgagataactataacaaagccaatatgtccatcaagcggatgacacaatgatcaagatcctgccacacaagctgaatgtattttgtgttccccttttcatttttgttgtcaaggtatttaaagcctggctgctcaaaatgtgacctgaggaccagcagtgagagcatcgtctgggagcttgttggaacagactcccagccccattctgattcattatctgctgagtcagaatctgcattttaacaagatctccgatgactcatttgcacgctaatgtttcagaaacagtattttaaaccccaaacatcgtgtcatttcactcccaaaaaacatggacattttcatttctaaagaacatgaagggccgggcgtggtggctcacacctgtaatcccagcactttgggaggccgaggctggtggatcacctgaggtcaggagtttgaaatcagcctggccaacatggcgaaaccccatctctactaaaagtacaaaaattagccaggcatgttggcacacccctgtaatcccagctactcaggaggctgaggcaggagaatcacttgaatccgggagacagaggttgtagtgagctgagatcgcaccactgcactccagcctgggcaacagagtacgactcagtctcaataataaagaacgtggacattttcttaaatagccacaatgttcttaccacctaactaaattaattctttggtatcatctaataccaaatacttagtccatatacaaatctctctgtctcaaaatgtctttttttttttttttttgagacagagtctcgctctgtcgcccaggctggagtgcagtggcgcgatctctgctcactgcaagctctgcctcctgggttcacgccattctcctgcctcagcctcccaagtagctgggactagaggcgcccaccaccacgcctggctaatttttttgtagttttagtagagaaggggtttcaccgtgttagccaggacggtctcgatctcctgacctcgtgatctgcctgcctcggcctcccaaagtgctgggattacaggcgtgagccaccatgcccggcctccaaatgtctttttaacagttggtttgttcaaagcaagatccaaacaaggtccgcacatgacatgcggttgctgtggctctccgtctggagtgcacccccatccccattttctgctttcatgcctttgatttatggcagagtttggtcacgtgtgttgcagaatatctatgttcaggatttgtgtgtttgcttcctcttggtgtgatttgtctttttattccccaaactgcctgaaaactggaagtttaacgtcaggtttcagttctgtggcgagcacactctaagcagttgtgaggattttgccccacttcctgcagttatttcacctctttttcttttktgtgtgtgtgtgtgtgtgtttgtttgagacggagtcttgctctatcaccaggctggagtgcagtggygcratctcggctcactgcaacctccgcctcccaggttcaagcgaktctcctgcctcagcctcccaagcagctaggactacaggcatgcgccaccacgccyagctamtttttgtatttttagtagagatagggtttcactgtgttggctgggctggtcttgaactcctgacctcaggtgatccacccatgtcggcctcccaaaatgctgggattacaggcctgagccactgtgcctggcccttctttttcttttctttgctgaagtgttttaaagccttggtactcagaatgtggtctgaagacctgcagtgtgggtgtcccttagaatcttgttggaaatgtagtcttgggcccttasatccttcctagagtgtcacaccaagaaggacatgcctgagaggcccactcctagggatgctaagattgactagtgggctcaggtggtgtcagcctaattgtaaagttagtctatcagactctcatttagaagctttacctgttgatgatcctggcctgaattaattattgtatttcattagggctcacaaaatagtttggttctattattcttcctacatttattagtaataatttatccataaaaaagacgtttttcatgccatttttataagggccagatgaacaaatgaaaaataaatttaaggctgggtgaggtggctcacgcctgaaatcccagcatttgagaggccaagtgggggcagattacttgagatcaggagttcaagaccagcctggccaacagagtgaaactccatctctaccaaaaatacaaaattgatctgggtgtggtggcacatgcctgcaatcccagctacaggggaggttgaggcaggagaatcgcttgaacctgggaggckgaggttgcagygagccragattgcaccaytgcaytccagcctgggtgacagagcgagactccatctcaaaaaacaaaaaacaaaaaaaaagaaggaaagagagagagggaagggagggagggagggaggggggaggaaggaaggaaggaaggaaaacttaaaagacaagaagtactttttctcattaaccaggatgatttgatggccctgaaatgcacttcatgtaggaaaggcaagaaaaatgcttaatacttttcctaacagtcagttttcagagtaaagagatggtgccctttttacttccattggtagcaaattttctttttcgtttcttttttttggagacagtcttgctttgtcactcaggctggagtgctgtggtgtgatcaaggctcactgcagcctcaacttcctgggctcaagtgattctcccacctcagcctcccaagtagctaggaccacaggcaggctcccactgtgtgcagctaattttttaatttttttgtagaaacggagtctcactgtattgcccaggttggtcttgagctcccgagtgtaagtgatcctcccacctcagcctcccaaagtgctgggattacaggcgtgagtcaccttgatttcttttgtttttatttttctctctcttgtaaatatcatgaacttatgaaagttttatatattcagtgtgtttcacatacttgtaattcttattctaaaaaatattttaattataattattatttttaaataattattttaataattattatttttaaataattattttaataattattatttttaaataattattttaataattattatttttaaataattattttaataattattatttttaaataattattttaataattattatttttaaataattattttaataattattatttttaaataattattttaataattattatttttaaataattattttaataattatttttaatgtagactttttaaaagtacaacatacagaaaaatggacaaatttagatcagtaaatgttcatattaagtcacacccgtatcaagaaacagaacaggctgggcacagtggctcacacctgtaatctcagcactttgggagcccaaggtgggaggatcacctgaacctaggagttcaagaccagcttgaacaacacagtgaaacctcgcctctaccaaaaaaaaaaaaaaaaaaaaaaaaattagtcaggtctggtggcacaggcctatagtcccagctactcgaaaggctgaggcaggaaaaccacttgagcccaggaagttgaggctgcagtgaactgtgatcacaccactgcactccaggctgggcaaaagagtgacagccagtctcaaaaagcaaaaaagaaagaaaacatactgtgtacaaccttgggggctaaaaaaattttttttgaacttcattaaacttaagaacatctgtttatcaaaaaaaaaaaaaagtaagtgagtgaaaaggcaaaccacagaataagaaaataattgcaacacaaattgataaaagattaacttcagaatatgtaaagaatttctacaaatcaataagaaaaaggcatgtccacaaacagaaaaaggacatttcacaaaagagattatcaaaatagtcaggaatcttgtaaggagacttcagacgtcagagaaaggcaaattaaaaccaggtgtggtggctcacacctgtaatcccagcactttgggaggccaagacgggtggatcacctgaggtcaggagttcgagagcagcctggccaacatggcgaaaagcccatctctactaaaaatacaaaaattacccgggcgtggtggcgggcatctgtaattccaggtactcaggaggctgaggcaggagaatcacttgaactcgagaggtggagattgcagtgagctgagattgtgccatggcactccagcctgggcgacggagcaaaactccctctcaaaaaaaaaaaaaaagagaaaaccatttgtcagtatccactaaagctgaacatatgcttaacaggatccagaagttccacggttagacatatgcccaacaggaatgtgttcatatggtcatgaagacgtctgcaagacactcatagcaggccagacacagtggctcacacctggaaacccagggctttggtatgccagggcgggaggattgcttaaggccggtgtatgaaatcagcctgggcaacatagctagaccccaccgctttaattcttcatcagattaaagaaattcacagccgggcatggtggctcatgcctgtaatcccagcactttgggaggctgaggtgggcggatcacctgaggtcaggagttyaagaccagcctggccaacatggggaaaccctgtctctaataaaaatacaaaacttagscgggtgtggtggcacatgcctgtaatcccagctacttgggaggctgaggcaggagaatcgcttgaaccagggaggcggaggttgtagtgagccgagatcacaccactgcactccagcctgggcgacagagtgagactccatctcaaaaaaaaaaggaaaaaaaaaattccctctgattcctggtttgctaggactttttatcagaaattagtcttggattttatcagatgccattttctgcatctatcataatcatatgatttttaatcctttatttcctgttgtaaggagtaaactgattattttaaatgtcaaaccactcttccatttccgaaatgaactctgcttgttttgatgtatcatgctttttttttttttttttttttgagaggagtctcgctctgtcaccaggctggagtgcagtggcgcaatcttggctgactgcaacctccgcctcccgggttcaagtgatcctcctgcctcagcctcccgagtagctgggaytacaggtgtgcgccaccacgcccagctaatttttgcatttttagtagagatggagtttcaccatgttggccaggatagtctcaatctcttgacctcgtgatccgctggccttggcctcccaaagtgctgggattacaggcatgagccactgcacccggccgtattatgctttttataattccctggatttgatttactggaattttgtgcagcatttttgtatttatgttcgagagaaacggttgtttcaattttcctttcatttattgtgcttgctggattttaatatcaatgttatactggcttcataaaatgactgaaaaatgttttctcattttctattctctaaaacagtttatataaacttggcattatttctctttaaatgtttggaaaaattcgtcagtgaagctatctgggcgtagagatctccctaagatttttagtcatgagtaaaatatcttactcaggtgatacatttctttttttgttagttttggtgcatttctatttcaaggaatttgttcatttcacccagattgtcaagtttactggcataaggttggatataacatcctcttacttttttttttttttttttttgagatggagtcyctctctgtcacccaggctggagtgcagtggcgcgatctcggctcactgcaagctccgcctcccgggttcacgccattctcctgcctcagcctcccgagtagctgggactacaggcgcccgccaccacgccyggctaattttttgtattttcagtagagacggggtttcaccgtgttagccaggacggtctcgatctcctggcctcgtgatccgcccgcctcggcctcccaaagttctgggattacaggagtcagccacctcgcctggcccctctattttttaaatgtcttaggatctattatgatgtcccccctttttattttttattcatgttggtaatttgtgtgttctctttttttttttcttgttcagtattgctagtgatttatcattttaaaaatctttaaaaaaaacttcagcatcattagttttctctactgtaagttggtttgctgtttcattgatacgtgttcatatctttattccttcccgtacttcctttaggtctgatttgctattccactgtaattttatctttcaccctgggttatttagaaatgcattgcttaattttcacgaggttcagatttttctagttttccttccttccttccttccttccttccttccttccttccttccttccttccttccttccttcctccttccttccttccttcctttctttcttctttcccaagtctcactctgtgcctaggctggagtgcaatggcacgatctcggctcactgcaacctccacctccctggttcaagtgattctcctgtctcagcctcccaagtggttgggattacaggtggctgtcagcaygcctgcctgatttttgtgtttttagtagagatggggcttcaccatgttggccagggtggttttgaactcctgacctcaagtgatccgcctgcctcggcctcccaaagtgctggggttgcaggcatgagccaccatgtccggccatcttttcttccctttctttcttttttcttttttttacatggggtcttgttctgtcacccaggctggagtgcagtgatacaatcttggctcactgcaacctccacctcctgggctcaagcagtcctcccacctcagcctcctgagtagctgggaccataggtgcatgccaccattcctggctaattttttgtatttttggtagagatggagtttggtatttttgttagataccagccatgttgcccaggctggtcttgaactcctgagcttaagcaatctgcctgcctcagtcttccacagggctaggatgacaggcacgagccactgtgctggacctctagttttctttttgttattggtttagattctagtatagtcagagaacatattctgagttatttcaattcattgatatttattgaggctttagctttgtgatctagcatatggtcaattttggtaaatgtttcacgtgtacttgaaaataatgtttctgagggtgcggtggctcacgcctgtaatcccagcactttaggaggctgaggtgggtggatcacgaggtcaagagattgagaccatcctggccaacatggtgaaaccccgtctctactaaaaatacaaaaattaggcgggcatggtggcgcgtgcctgtagttccagctactcgggaggctgaggcagaagaatcgcttgaacctgggaagcggaggttgcagtcagccaagattgcaccactgcactccagcctggtgacagagccagactccgtctcaaaaaaaaaagaaaaatgtttctttttccattgttgggtacagagttttgtctgtcaggtcaactttgctaattatgttgttcatatcttctatatccttgctcaatttttggtctgcttttatttttatttttttattttattttttttttttgagatggagtcttgctctgttgcccaggcgggagtgcagtggcgcaatctcggctcactgcaagctccgcctcccgggttcacgccattctcctgcctcaacctcccgagtagctgggactacaggcgcccgccaccacgcccggctaattttttgtatttttagtagagacggggtttcaccgtgttagccaggatggtcttgatctcctgacctcgtgatccgcccgcctcggcctcccaaagtgctgggattacaggcgtgagccgccgcgccccgctggtctgcttttatagttgacgtaaaaggcttaattaaagtgttaaagtctcccactttcattgtagtgttttgtatttttccttttaattcagtcaatttttgcttttatattttgaaatgatgttattggataaatacagatttaaaattgtcacrtcttcytagtgaatcaaaaacaacatatttgtgtgcatatatctccttcccttccttatacagaagctagtgtcgtttatacacttgtccttcatgtagtgattttaatttcttcctgaaatctactgctgagtaaacagccattaattggaaaaaatatttgcatcaatttcattaaaaaaattgtgatgcattccagccaaccaaagatactcaaatgacttttactgttaggaaaatgtattaattgaccaataaaacaagtttagataaataaaaacaatactttgaatataaaaatacagtttccgtataaaatgtattgtcatgaaggtttattggcctcattaaaaggagaagacaagatttgacagtgggggctaggcgcggtggctcacgcctgtaatcccagcactttgggaggctgaggcgggcggatctcttgaggtcaggacgagtatgagaccagcctggccaacatggtgaaacctcgtctctactaataatacaaaacttagctgggcrtggtggcgggygcctgtaatcccagctactccggagactgaggcaggagaattgcttgaacccaagagccagaggttgmggtgagccaagatcgcgccaccgcactccagcttgggcgacagagtgagactccatctcaaaaaaataaaaataaaaaataaagtcatagcaaaagttacagagaaacaccttgagggcaaaataaatactgaacccaaaagcacttccaaacacatggaaataggctgtgcgctcatcgacttcagaatcatagaatcttcagccatctcaatcgacatacatcagcaaaagcaggcatatgggatttatccaaacatgacatgcaacgcagatttgttccatatgatattgttggactagaaactgttacatagtaagtaaatgggtgagtgtgtcttcccgtgagagtgcgatgtcaaatgtcattccttatatcgtgtttactcagtgtatttagagaygaaaaagtcactaaaccaaaaaaaggagtgttgccaagaagttgtatagcttttcaagagtgtttatggcaaaagtcgttaattgaacagtaattgaacaggtaartctgtaaactggamttcaccttgcttttttcccatgyaaatgtagattagagatgggagcagtggctcacacctgtaatcccagcacgttgaacggctgaatcacctgaggtcaggagttygagaccagcctggccaacacggtgaaaacctatctctactaaaaatacaaaaattagctgggggtggtggtgtgtacctgtaatcccggctacttgggaggctgaggcaggagaatcgcttgatcctgggaggcgaaggtgtcagtgagctgagattgcaccattgtactctagctcgggcgacaagagcgaaactccatctcaaaaaaaaaaaagtacacacacacacacacagagatttaagcaatggagtggcatggtcagaccatgctttgttttttttttttttttttttttttgaggccgagtctcactctctcacccgggctggagtgcaatggcgcgatgtcagttcaccgcaacctgtgcctcccaggttcaagcgattctcccttgtcagcctcccgagtagctgggattataggcacccgccaccatgcccggctaatttttgtatttttagtagagacagtgtttcaccacattggtcaggctggtctcaaactcctgacctcaggtgatccaccgcctcagcctcccaaaatgttgggattataggcatgagccaccgcacccggcccagaccatgcttttaaaaaatctttctagcatctgatgtggagaggatgtatccagaagtacaagtcttgaaagaggccaggagactaacgtgtccaagcaaaagacgatgaggtcagtggggcagagctgagtcctgacagaggcccaaatgtgcatgtgaattctgaggatgataaaggtagcatttccaaactatgggttaagaggagctactcaacaaataatgatgagacatttcaactgtgggaaaaaagtaaagttgtatccctatttcactccaaatgtaaaaataaaatccagatggacaaaaggttcgaacataagaaattaaagaagagaccgggccttggctcacgcctgtaatcccagcactttgggaggctgaggcgggcrgatcacctgaggtcaggagttcaagaccatcctggccaacgtggtgaaaccccgtctctactaaaatacaatattagccgggcatgatggcgggtgcctgtaatcccagctatttgggaggcttaagaggctcagatgggagaatcccttgaacccgggagatggtggttgcagtgagccgagatagcgccactgcactccagcctgggcggctcagcgagactttatctcaaaaaaaaaagaaagaaagaaaaaagaaatgaaagaagaaaaaaaatatagaaggaaacatgagtggatgaaaagaaatagcctgagtggaggagcatgacccgaagctgaagtcataaaggaaaaacaatatgacaacatcaaaaaacgtagttgtgggggaaaacagcatatgcaagacaaacagctgcgtgagaagcggcatctataacacattgcctgtttctcttggatagagaaaagctcttacaaataaataagaaagtaatatcgtttcatgaaaatgaataatgtacatgagtaggcagtaaacaaacttacaaaaagagacttgacctcactcataatttaaaaatagttttggggctgagcttgttggctgacgcctataatcccagcacttggggaggctgagatggcaggattacttgagcccaggagttggagaccagcctgggcaacatagtgagacaccatctctacaaaaaattttttaaaaattagccaggcctgctggtgcgcatctgtggtcccagctacttgagaggctgaggcgggaggatggattgagccctggaggtaaagactgtagggaaccatgatcatgccactgcactccagccagggcaacagagtgagatcttgtctcaataaaataaaaagtaaaaaatatttgggaggctgaggcgggcggatcatctgaagtcgggagttcgagaccagcttaaccaaaatggagaaactccgtctctactgaaaatacaaaaattggccgggtgcagtggctcaygcctgtaatcccagcactttgggaggccgaggtgggcggatcagctgaggtcaggagttcgaaactagcctgaccaacatggagaaaccccatctctactaaaaatacaaaattaggccaggcgcggtggctcaygcctgtaatcccagcactttgggaggccgaggtgggcggatcacgaggtcaggagatcgagaccaacctggcttaacacggtgaaaccccctctctactaaaaatacaaaaaattagccgggcaggcgcctgtagtcacagstactcaggaggctgaggcaggagaatggtgtgaacctgggaggcaaagcttgcagtgagctgagatctcgcctctgcgctccagcctgggtgacagagtgtgactccatttccaaaaaaaaaaaaaaaacaaataaacaaacaaacaaaaaaaccaaaaattagccgggcatggtggcacatgcctgtaatcccagctacwcgggaggctgaggcagragaatcgctrgaacctgggaggcagaggttgcggtgagccgagatsgtgccactgcactccagcctgggcaacaagagcgaaactccatcttaaaaaaataataataattttggaacaagatgatgatatactcttaaaacaaggatgaaaatgtcttcacagtcagtccaggcaacactgggggagataaaccttctcccatgctgtcgttggagtatgaattggcaaaacctctttgggaggtaatctatcgatatctatttttccccaaaaaattttaaatgaaaaatttcaaatatatagaaaagttgaaaaattatatggtggacaaccacatcactacacttaaatttgacaattgtcaacacttttgagtgtttcttttatcacgtatatctatctacccatccagcaagccatcttatattttgatgcattttaaagtaaattgcacgctggatgtggtggctcacacctgtaatcccagcrctttsggaggccaaggcaggtggatcacttgaggtcaggagttcgaaaccagctcggtcaacattgtgaaaccctgtctctactaaaaatacaaaaaattagccgggcatggtggcaggcgcctgtaatcccagctatgtgggaggctgagacaggagaatcgcttgaacccgggacacagaagttgtagtgagccaagattgcaccactgcactccagcctgggcgasagagcaagaccccatctcaaaaaaaaaaaagaaattaataaaaataaattgctgacttaagtataattcaactctaaacatttcagcatacatatcaacaaaatgtgtttgtgcttcttctttaaggtaatatttacatacagtgacatgcacaaattctaagtggaccattcattgcgtgtgttctgacacatgcacaccttggtaattcaaacacctatcaagatatagaatattttcatcattccagaaagttccttctagtcccttcccagttagtcccatcctctcaagcatttttttttttttactataggttagttttgctggttctagaacctcatataaatggagttatacaatatgatttttattgccttagcttaacaaatctgctgtgctctgtttgaattccctttccctacatcagggtcataaaattcctccagaaagaaagctgagggtaacgacagggctcgtgttatttgtccatgttttctagagatcactgtcctgctctgcccattgtcaaatgtctgaaaacattttataggttttgtccagtattctagttgtttatggtgaaagaattagtccagtaccaatgatttcttcatggaaaggccaaataagggacactttgagaaccaatatagtgataacagattataaccattgaataaaatagaattcatgagcctattctgctgtaaataaaaaaaatcacacataaatgagaagaaagaaggaagacctaaggcttctgtcactcagcataatgatatttgttgttgttgttttgagacggagtcttgctctgttgctcaggctggagtgcagcggtgcaatctcggctcactgcaacctctgcctcccaggtttaagcaattctcctgcctcagccttctgagtagctgggattacaggaacgtgccaccgcgcccagctaatttttgcgtttttcgtagagacagggtttcatcatgttggccaggcyggtctcgaactcctgacctcaagtgatccagccgcctcggcctcccaaagtgctgggattacaggcatgagccactggcgcgcggccagcataatgatttttgggattcatcacgctgctgtatctgttgttgactcctctttactcctgagtaggattctactgtaggaatataccacagtgggcttttccagtctcctgttgatggacatttgggttgtttgcagtttggggctcttccgaataaagctggtataaaacattcttgtgcaggcagttttggggatacgttttctcgtgggtcgcttgaagggggtacatagaacatacacaggccctcttcctggggctcacagtctactgtaacttcagtacaagacgcagtgacgtgagtacacgctgtgtgtcaggtgcagaaatgacagtaagaggcgtgaggaggtgggaagtgcttctttggggagagctaggggcggcttcttggaggaggggggctcgggtactggtacagcttggtttagtaggaggatcagaggctstgggtcagatacacctgcgtctagtctttctctctcacacacacataaagatccctgggcagtctcacttttctcagctgtaaaacggggttcatgacaccacaggatttgctggaataacgggagtaaaaggcctctttcattaaacgctcctcttttccctacaggcctggccctgctggccgctttcaatgtggatgtggcccggccctggctcacgcccaagggaggtgcccctttcgtgctcagctcccttctgcaccaagaccccagcaccaaccagacctggtgagtagggccggtgggcaagaggccttcagactgaggggcttccaggcaatctgagatgggccccagagacggccatggcagcccaccccaccccaccgtcaggagaggaactcctttctctttcagaagggcatgcaggagaaagagagaaggtgtgagagaggctgtgggcatcgggctggtctgtggggtccacggaaccccagcctcacgcctcactgggcctctccctgctccattgcccagggggagggtggacttaaagacaattttagtggcygggcacggtggctcacgcctgtaatcccagcactttgggaggccgaggcgggcggatcacgaggtcaggagattgagaccatcctggctaacacggtgaaaccctgtctctactaaaaaatagaaaaaattagccaggcgaggaggcgggcgcctgtagtcccagctactcaggaggctgaggcaggagaatggcgtgaacccgggaggcggagcttgcagtgaaccgagatggcrccactgcactccagcctgggcgacagagcgagactccrtctcaaaaaaaaaaaaaaaagacaattttaaaataaagcatattaaggctcttttgttccttatggaagtaacacatgttcaatatagaacatttggaaacaaaaaataacaaagaaaaaactgggcctggcaccgtggctcacgcctgtaatctcaacacttagggaggctgaagctggaggatttcttgaggccaggagttcaagaccaccctgggcaacatagtgagacccccccaactcaaaaaaaaccaaaaactgtctgggcatggtggtgcctgcctgtagtctcagctacttgggaggctgaggcaggaggaccacttgggcccggaggccgaggctgtagggagccgtgattgcaccactgcactccggcctgtctccagaacaaaaaccctgaaactatgaggaacaagcgtgtactggtaagaggcaggctgtggctctggcagccagggttcagtggcagcttcaccgtggatttgccgcatagcctgagcaaggtgctcgggcctgagcttcagtttcccttctctgcagtcagcgtggggawctacctacttcacaggattgtcgcaaagactatttgagataatgcaygtaaagggcttagcacaggttctgccgggcgcggtggctcacgcctgtaatcccagcactttgggaggccgaggcgggcggatcatttgaggtcaggagttggagaccagcctggccaacatggtgaaaccccgtctctactaaaaatacaaaaattatctgggcgtggtggtacacgcgcgtagtcccagctactcgggaggctgaggcaggagaattgcttgaacctgggaggtgsaggttgcrgtgagccaagatcgtgccattgcactacagcctgggcgacagarcaagactccgtctcaaaaaaaaaaaaaaaaaaaaagggcttagcacaatttctggccacattaatgctcaataaacattactttacattttttaaatatcatctatacccacctattagataagcaaaatgtaaaatctgccaacattgctggtaaggttgcggtgaaacagggacgtgtgggagtgtgaattgcgatcaccaccttggagagcaattttgccgtatctggtaaagctgaggatgcacgtggcctctgacacttccactccccgatcccagctctagagaaattctcagacacatataaaaatgtttgtgtgccgggcgcagtggctcacacctgtaatcccagmactttgggaggccgaggccggtggatcacctgaggtcaggaattcgagacctaggctggccaacctggcgaaaccccgtctccactaaagatacaaaaaaaaaaaaaattagctgggtgtggtggcgggcgcctgtaatcccaggttcttgggaggctgaggcaggagaattgcttgaacccaggaggtggaggctgcagtgagccgagatcgtgccattgcactccagcctgggtgacggagcgagactctgtctcagaaaaagaaaagcaagcaaaaaatgtttgtggtagcattgtttggaatcatgaaagactggcaatattcctcttaggaaaatgggaaaaatactgatatgactcatgcaatgcaatactaaaagcagatcccctgaatgaagccagtgcaatggttgtttacctggatccatctggaaacataccgtgagttgaaaaaggcaagttgtagaatttaatatacaaaggttggcaggtgcagtggctcacctgtaatcctagcactttgggaggtcaaggcgggtggatcacatgagcccaggagttcgagaccagcctgggtaacacggtgagaccctgtctacaaaaaatataaaaaaatcagccggatatggtggtttaagcctgtagtccgtcccagctattgggaggctgaagtgagagacctgcctgagcccgggggcgggtgggtcgaggctgcagtgagccgcgattgtgccactgcacttcagcctgggtgacagaacgagaccctgtctcaaaaaaaaaagaagcaagtaagtaaaatatgcattccctcagatggcgatggtggccgcgtgctgatgtaggagtgtgtctgcagttaggagaagctctggtggaaagggtcatgagatccgaggctcatttgaatttcccatgtgtcaccaaaatgacttttatttatttctttacctattatttatttattggagacagagtcttgctctgtcacccaggctggagtgcagtggtgtaatctcagctcactgcaacctccgcctcctgggttcaagtgattctcctgcctcagcctcctgagtagctgggattacaggcgcccgccaccacgcccagctaattttttgtatttttagtagaaacagggtttcgccacgttggccaggatggtcttgaactcctgacctcaaatgatctgcccacttcggcctcccaaagtgctgggattacaggcatkagccaccgcacctggccccaaaatgacttctagtgctgtgttgttttaaagccagatctggtcaaggtttatgtattacgtattgctgttatgtctctgtcattgatttcaatccaaagcagtgatttctcccccatttttttctgggtggtcatagggcttttcttgtgcatactctcccactgagcgggcccagcctaggatggttacctcctcatcccaccccagcccaccagattgctttgctcctggtcagtggtcaagggtttccttcacacccagcacacaggagcaagtgagcccagggttcaaacaggcactggggcagagccaggtgaggagccagggttcctggstgggcagggcgggagctttgcttgaataggatgggtgggcagtggtggctcccgaagcagcctcataggccctgggacttgggccttgaccctgacagccaggcagacttggatcctgtgatactgtgaaatgtatatttgacattccaagactgaatatatattttacaatataacaaataaaaatatatttggtctcaaaataaacatttggtcccattatctggcatacaygcctaaaatctctggaatctccaaagtaataaatgtctttttctttgttaatgagttgacgggggaccggcagcccccagatagcttcaaaatgggggctggtcactggagagaaccaggcacgatcagagggttgggactttcagccccacacccctcttctgggagagaagggctgaaggtttagttgatcaccagcggccartgattcaatsagtcatgcctatgtaatgaggcctccataaaactcaaaaggacagggtttggggagcttctgggtagcagaacatgtggaagtttctggagggtggccccygagagggcatggaagctttgcccctcacccccactttgcccctcacccccactttgccttatgcatctcctcatctgtatcctttgtaatatcttttttttttctttttgaggcagagtcttgctctgccacccaggctggagtgtggtggcatgctctcggctcactgcaaccactgggttcaagcgattctcctgcctcagcctccctagtagctgagattacaggcgccygccaccacgcccatctgagttttgtatttttagtagagacggggtttcaccaatgttggccargctggtctcgaactcctgacctcgtgatccgcccgcctcggcytctcaaagtgctgggattacaggcgtgagccaaggcacctggcctgtaatatcctttataataaaccagtaaatgtcggtaagtgcttctctgagttctctgagccactctagcaaattaagcccaaggaaagggtcccagaaaccctgatatggttgtttggtcgaaagcacaggtgaaataaccggcggctggtgatgggcctcggaagttaggagcagtcttgtgggactgagacctcgacctgtgagggctgatgctacctccaggtggagcatgtcggaattgagttgaacgtgaggaccttcagctggagctggttgccgaaggactgcttgccccgtgtggagggaaaaccccacccacctggggtcactggactgttctgtgttgtgagagctgcaggggagacagagctcgacgtttcctacatcattagagagtcctttctggatcctggtttcatcggtgcagtcaaaagtctggtcactgccaggcgcggtggctcacgcctgtaatcccagcactttgggaggctgaggcgggcagatcatttgaggtcaggagtttgagatcagcctggccaatatgctgaagccttgtccctactaaaaatacaaaaattatctgggcgtggtggcgcgcacctgtagtcccagctgcttgggaggctgaggcaggagaatggcatgaacgcgggaggcggagcttgcagtgagccgagatcgcgccactgcactccagcctgggcgacagtgagactccgtctcaaaaaaaaaaaaaaaagtctgctcaccattagatttaagtggtaaggatggggccaattcattcattcattcattcattcattcagcaagtatggatggagcacttactcagtgccaggcaatatttggggaataagagggagacatggtcactgccttcatggagctcccgggctcatgagggaaacacaagctagacgatgacaagagtgacaatgaccccaccgaataacagctctgttgggggacgtccgaggtacgggggggcgcatcgaggcaggtgtgttcatcagcgtctactaggatttgcagggtgactgggaattagcatgagaaggaacgggaaggggatggcaggcacagagaacagcttgatcagaagcctggaggccggctgagtaaggtcaggaaactgagaaaatcacgtgtggctaaagctgacagtgatgaaaagtaagctgggagagtgtggtggtgcctcgtcacccaggcactgagggtttggaggaactagagggtctgaagccgggaggggtggtgaggttttcagggagttttgtgttgcacgaagatgaattaaaggtcaagattgtgtttggtttgggtaaaattttatcaacatgtgccatacagaagaatgcacacccggctgggcgcgggggctcacgcctgtcatcccagcactttgggaggccaaggcgggcgggtcacctgaggtcaggagttccagaccagcctggccaacatggtgaaaccccgtctccactaaaaatataaaaattagccgggtgtggtggtgggcgcttgtaatcccagctacttaggagaggcaggagaatcgcttgaacccgggaggyggaggttacagtgagccaagaccgcagcattgcactccagcctgggcaacaagaatgaaactctgtctctccaaaaaaaaaaaaaaaaagaagagaaaaatgcacacctcataagcatgcagcgcagtraacatccgcagagtgaagcactgtgtaagcagcatgcagatcaagggcacgtgagctgcggcgcctaggccccctctaagccccgcactcccttccagacacatctgctgccaagagtaacccccagctgactttcatctccgtggattagcctcgcctggttttgcatttagtatcaacgaggcatacggtgtgtgccccgctacgtcgggctcctctctctccacataaggcctgtgaatttcatccatcctgttgccccaggcggtacttcttctggttgccagggttacattgtgtcgacagtactgatgattggcatttgggctgttttcttgggctgtgatgaatagcactgatgtgcacctccttttgatggatgaatgttcttttttttttttaatccctcagagttgatcccaaagaatgtactcatttttggggagggcatatgtgctcaggagtgggattgctgggtcagaagttatgcaattggttctgcattcagttttccatactgtttgtagggtgtgagcaggtttcagtcagcgttttctgtaactgtctcctgcctagttccctcccaccaatacccagcgaccccacgcctcagctccaggtcccaccgacattcacagyccctctctcagaagcctaaaggccagggtgcaggagagagtttggagcccgtgtcgcagagggctctgagtccaccaggggctgggggagggcccagcggggctccctgaacacctgctgaagcagagaggggctcccaggcttgaacacgctggggaggaggatgtggtgggaggcacttctgggttcctgctgcagagagtggggcctgagaccacgggcctgctgcatggggcaggaagtgcgctggctggccaactcgggcctagaaaaaggcaggggctgtgctcctgcttgagaatgacgtgtgcctctcactcacattgtctctcttaaaatgtaagagaccagggctggcagcatcatgggttttggttgccacagaaggtatgggtgggacagacagcagacatggaaatagaccctgagggctgggcatgggggctcacacccgtaatcccagcactttgggaggctgaggccggcagatcacttgaggtcaggagttcgagaccagcctggccaacatggkgaaamcccatctctactaaagataccaaaaaaaaaaaaatttagctgggcatggtggcaggtgcctgtaattccagctactcaggaggctgyggcaggagaatcacttgaacccaggaggcagaggttgcagtgagccaagatcatgccattgcactccagcctgggcgacagagtgagactccatctcaaaaaaaagaaaaaaaaaaaaaagaaagaaagaaakaaaccctgagaacaggacaggttagagctgggtgaaggcaagatgtgagcttcaagtcagtgaccagttaaaaagattgttaaacatttaaatacaaaatactaaataaggtcaggcatggtggctcgtgcctgtagtctcagcactttggaaggccaaggcaggcagatcacctgagctcaggagttcaagagcagcctggccaacatggtgaaaccccatctctaataaaaatacaaaaattaaccgggtgtggtggtggcacatgcctgtaatcccagctactcaggaggcagaggctaaggcaggagaatcacttgaaccagggaggcggaggttgcagtgagccgagatcacgccactgcactccagcctgggagacagagtgagactccatctcaaaaagcaaacaaacaacgaaaaacatactaaagcaataaataaaggcaggagayggacaagggttgctgggctgtacccagctcagggtgtaacagggcccctgtggctgcgagctgatggccagtcctctgtcagagctggtgggtcaatggtttgtcagccacgtggtcaacaaacctgcaaactcccggcagtgggggataaaaggtgtgggaagcagaggcagctcagagggccccaggccatgtcattgcatgatggcggcatgaatggcagtcttgggatctgcagtgcgcaccctgcacagctgttcatgatggcctcctgggaacgcgcagtccaggtgggaagaaagggtgggggtggggtgctatagtcagggctgctgcagggcctggaggggatcaggctgcacttcctttgggaaggcttcctgaggagctggggtttgggatgattgctctgcagcaggagggatctcaggcagaggaaacagtccgggcagaggactgaggaggagagagactggaggcgggtccaggcctgcacctaccccaccaaaacggggtctgcggtggagcccagttttgaccccacccttcctgggggagcagggaaggagatgctgggtctagggctgaggtcggggctggggagagaggcagggttgctaaggaagcaacctaatttgggggctcagctgcagagccggaacagaggagcagctctctgctgcacccagccctccgcccctcagccctgccccagatgagccccctcagctgttgcctgggctgttgttcaatagtcactcaacacttactgagcccttgttctgtgccaggcattgctccagaccctgggaataacacagtgaagaagatagacaagatccttcgggagcctactgtctcgtggggagacagataataggcactatcagatgatggcaggttctgagaaggaaatcaaacagggtgatgtgaagcagagtaactgggttgtgaggcacggctgggtagagaaagcatttatgaggaggtgacaggcgaggctggggaaggagaataagccaaccttggggagagtggaaggtgagggctctgggaataggaaacagcgcggtggagggaacagtgccgtggagggaacagcgccgtggagggcctgaggcaggaaatgctggcgctggtcacccaggaactggggctgccactgacagaagggacattggtgtaaactacatgagtgggccaggtgctgtggctcatgcctgaaactcactgtaactcactaggctcactcccagcagtttgggaggccaaggcaggaagattacctgagcccaggagttcgagactagcctgggcaacatggcaaaaccccatctctacaaaacataagaaaatttgccaggtgtgatggcacgcatctgtggtcccagttacttgggagactgaggtgggaggatcgcttgagcctgggaggtcaaggcygcagtgaaccgtgatcatgccactgtacttcaacttaggtgacagaaggagactctgtcttaaaaaaaaaattacatgagtaaattaaaaaccaaataagtgggccaggcacagtggctcacttctattaatatagaagttttcttgtagttttggaggccagaagtctgaaaaggtgtcagcagggctgggtcccttctagaagctctgggggagaatctgttttcttgccttatttggcttctagaagctgcctgcattccttggctcacggcctcctcctcctcaagcctgcagcatagtaagctttgcatctttctctgacactttggaagaccaaggygggagtgcttgagcccaggatcagcttgggcaacacagtgagacttcatctctatagacaaattaacaaaattagctgggcaaggtaactcgctcctgtaggcccagcaacttgtgaggctgaggtaggaggattgctgagccsgggaggtcaaggctgcagtgagctgtgatcacactactgcactccagcctggacaacagagcaagacactacctaaaaaacaaacaaaccccacaaaataacaggaggctattaccatcaacaaggcmggacgatgatggaaggagcatctggagaagagttgctttctagaaataatttggagagtcrggcacggtggctcatgcttgtaattccagcactttgggaggctgaggtgggtggatcacctgaggtcaggatatcaagaccagcctggccaacatggtgaaaccctgtctctactaaaaatacaaaaattggccgggtgtrgtggctcacacctgtaatcccagcaatttgggaggccgaagtgagtggatcacctgaggtcaggagttcaagaccagcctggccaacatggtgaaaaccccatctgtactaaaaatacgaaaattagctggtcatggtggcgggcgcctgtaatcgcagcactttgggaggccaaggcaggagaatcgcctgaacccaggaggtggaggttacagtgagccgagatcgtgccattgcactccagcctgggcgacaagagtgaaactccatctcaaaaaaagaaaaaaaaaaaaaagaatttggagagagaaccaacagggttggcaggtggattggatgtagggcatgagtgaaaacacgacgaagtgaggatgcctcctgggttttgccttgagaacttagtggttgctggtgccatttgctgtggcggggaagatgagaagaagcaggcttgacaggaaagaccacaggttctgtttgtttcctatcgacgctgtaacaagttaccacaaatgtagtggcttacaacaacacaggtttattattattattattattattattattattattttgcactctttcacccaggctggagtgcagtggtgmgatctcagctcactgcaacttccacctcccaggttcragtgattctcctgcctcagcctcccgagtagctgggattacaggctttcaccactatgcccagctaatgtttgtatttttagtagagacggggtttcaccctgttggccaggctggtcttgaactcctgacctcaggtgatcygcctgcctcggcctcccaaagtgctgggatgacaggtgtgagacactgagcccagctgcaagtttattatcttgtagttttggaggtcagaagtctgaaaagctatcagcagggctgggtcccttctagaagctctgggggagaatctgttttcttgcctttttaggcttctagaagctgcttgcattccttggctgacgggctcctcctcctccttaggcctgcagcatagcaagcttcacawctttctccgactctgattctcctgcctccctcctagaaggacttttgtgattacactggggctttacagcccagccaggacagccctgggggcttctgggatgggagaggcctccttgggaggctcccagcattccctgcagtctcgccacttctcccctctgcctgcctcaacgtccccctgagtccctgcggctcgcccatgccaccgttttcggggcctccctcatagaaggacccttgtgatttcactgagcccacctagataatccaggataacccccccatctcatgatccttaatttattaactcacatctacgaagtcccttttgccataaaaggcaacatattcacaggttctggggattaggacgtggccttctttggggggccattattctgcctacgatagcagatggagaggtrggaatttcagccgttataggtgtattgaagccatgggcttggaagggatcactagggagagtgtgccggcaaggaagacagtgacccagcccccagatcctggtggcagatagaggtcagaccgcgaaggcaccagcgaagccttgaggaatgaggagagagtaggcagaaatctagaaaaaagtgttcgaaggagatggttactcatgtttggggcttctgagaggttgaggaagatgaggacagagagcggtccgttggatgtggcattgtgggggcccctggtgaccttcacaggaactgactcagagggtgggaagtcagcttggggtgggttcagttgtgggtgggcggatggacgcacaggtgcagactttcttattattctgtaagccatgccgatacgtgaatatatttcataatgtattaaaatgtagagtgataggagttgaggaagtggagacggtatctcatttctgccccaccttcctgtgctctttagtctgtcccaacccactgtagccacatcatgacctttttttttttttttttttttttgaracagagtctcgctctgtcacccaggctggagttcagtggcgtgatctcggctcactgcaacmtctgcctcctgggttcacaccattctcctgcctcaggctcccgagtagctgggactacaggcaccygccaccacgccyggctwattttttgtatttttagtagagacgggvtttcaccatgttagccaggatggtctcgatctcctgacctcgtgatctgcctgcctcggcctcccaaagtgctgggattacaggcgtgagccaccgcgcccggcctcatcatgagcttttgaaagcacagctaatcatgtgcttcccctttataaagtcctccatgacttctactgccctctgcagaaagaccttggacttggttcactgttaaccaccaagcccctcgtcccctccccaccatcccctatgacaaccccyggagctcactgtctgtctcaggacagcccagttctcctgggtaacgtggatggtgagaatgttgaggctgtccctggaatctgccgtctccctggactgggcctgggtgggggcaagaagtttgcagtcaggaggcgcagctcttgaggctgccttaatcaggctgaggcagccacccccaaacctccagttcttttatttatttatttatttatgagacgaagtcacactctgtcccccaggctggagtgcagtggcgtgatctccrctcactgcaacctctgcctcccaggttcaagcaattctcctgcctcagcctcctgagtagctgggactacaggcacacgccaccatgcccggctaatttttgtatytttagtagacacggggtttcaccatattgatcaggctggtctcaaagtcctgaccccagatgatccacctgcctcagcctcccaaagtgctgggattacaggcgtgagccgccgcgcccggcctccaaacctccagttctgactgacccacaggataggggcaccagcgtactcttctcaggaactaaggccaggcagggcaggccccctgggtggcccacgaggaagccagcactgcccccaacagaaccaaccccaacgctggtggttttctggcctccccatccctgtccccataagagagcagagtttttattaaccatcagtatcaccccttctttgtcagggtgggcagcaggcagagaggggttgcatttaaccatttcctgcctggtgctgtgtagaagcagaggttgggcaaatgtcttccccataatccagagtctgggctaggaatctgccggccagacagggagcttgtgagtgcaggcaactggaatgggaagggtgctgggcaggcagggagaagacgaggaacatcagccagctcagctttgcaacctcccctcccactcaggctcctggtcaccagccccagaaccaagaggacaccagggcccctccatcgatgttcccttgtccaggatgaaatcctttgccatcctgtaggtaagtcagccccamctccagggaatgctccccaggaccccctttctagcaaaatccccctcatctaaactcaaaccattccaaccccagccctgcctcatccagcccgttcacccctagactccagcataacccacagcaagattccatcccaatgcccagtcccaccccaacccaatcctaatccccagccacctttcctgacacagtcctagcaacagaaatgatacctacagcgtattgcgtgcccaccctgtgcccggcagtcctctgagtcattctgttttcatcctcaaaaccrcgccatttataagagaggaagctacagttcagagaatgtaggtcttttggttgccagtatgacaaagttcacacttttagtgttggtggctgattcgaaactctagcccttcctgatgcaagtcatcacacctcagtgcaattcaccccctacatattcagtctaactgtggccaccctagtaactagcatggggcctgacatatattaggtactcaataaatgccatttgaatgaatgaatgaatgaatgaatgaatgaacctgattcactcattaaactctatccatcctacccagtcaaactcaggtcacagatttactgacaacctcttggctatatatatataaataaatagaatccttgtcttgtctgaggctgggcgccgtggctcacgcctgtaatcttagcacactgggaggccaaggcgggtagatcatttgaggtccagagttcgagaccagcctggccaatatgatgaaaccccatctctaccaaaaatacaaaaatcagccaggcgtggtggtgcatgcctacaatcccagctatttgggaggctgaggcagaagaatcgcttgaacccaggaggtggaggttacagtgagctgacattgcaccactggactccagcctgggcaacagagcaagactgtttaaaaaaaaaaaatcctgccaggcacggtggctcaygcctgtaatcccaacactttgggaggctgaggtgggccgatcatgggtcaggagatcgagaccatcctagctaacacggtgaaatcccgtctctactaaaaatacaaaaagaaattagccaggtgtggtgacgggcacacgtagtcccagctactcaggaggctgaggcaggagaatggcgtgaacctgggaggcggagcttgcagtgagccgagattgcgccactgcactccagcctgggcgacagagcaagactctgtctcaaaaaaaaaaaaaaaaaaaaaaaaaatccttgtctgagaggcactgagttgaacagactcaatctcagtccagcagggttgactgagtgattccatgactgaaaaataagacagtatcctgaggctgacagtggggaggacgaggaaggagctaccatttctgcccctgaggctgggggcagtaagattccccaggatgggtctgtgaggctggsgggttccttggtccacacagccagtcccacggtatcttgcacattccttggcacttacatacccaccaggcagtgcttctccacccacctgcccraccaaacccactgaggaaaagcagcaggcatccgctgttgctggacgcccatcaccacgctcacaaggctgggcacagagcagacgtcaatgggcacgtgttgaaagggtcagcaaatgagccccggggatgggcactcggccctgaacgtgtccagtcctgaccttgaaggcccccgctctagctttctagaggcttctctgagtggccaacagttcctcatgggggcctgaccaaggtggctctgtgccctctgaccttggcttcgggtctctgcctcccagagtcccctcctcctcctcacctgggcttaactttttcagagcatgtccccatccccaaggggaggcaccggggagtgaccgttgtccggagccaccacggtgttttggtgagtgcaggagcgagaggagggagggccttagggaggctggtgctasccctcgtggttgaccctggtgttgagaccagttctgactgccaygctgttcccgaggctgagtctagcgtctccctggtgccaaccccagggctgactgtagctctgaccaccctgataccagggctgacctaggtattccctgtgacccagcacactcctgcaggtgtcggcctcggccttgaygccaacactgactcctacacccggtgaggggtgggccagctcttcctgtgccccctgcctggttgagccactgagttctggaatgggggtgagaatgtggctgtggctcgggaatcgggaggtgacctggtgtttccccaccctctcttccctcccacagatatgcattcaagtgctggtccggcggcctcacagcctcagctcagaactcacaggcacctgtagcctcctgggccctgacctccgtccccaggctcaggccaacttcttcgaccttggtaaggattggacattcactggccttggatagctctaaagagatctccttggtctccaagaaaaggcaccagctcacggcagatgcagtgggacgcaggcccacagtggagcaaggcagggttgaggcatcacgtgaaaggaatcagggcagaaccatgtgtgagcgtgctcaggygaggatggagcctttctgactctgagctcttccatgtgtgtttttaaagaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggtgagaagaggcagatctgggttgctctgagtcyatcagagccaattcctaggctggtggcctccaagggtgaggggtgcctcagtctgagagatggggagcagtggctggactttacagacctgacctgtaccagctccayccactctttcttataagtggggaaactgaggctcagagagtggtagtgatgggaatggctcacacagcacacaaagcctgaccaggttctagctctctttttgaagggggagacaaaagcttctctcttggggccaggtgaggtggctcatgcctgtaatcccagcattttgggaggctgargtgggcggatcacttgaggtcaggagttcaagaccagcctggccaacatggtgaaaccccaactctactagaaaattcaaaaattagccaggcatggtggtgtgcattatagtcccagctacttgggaggctaaggcaggaggattgcttgaacccgggaggcggaggctgcagtaagctgagatcccaccactgccctccagcctgggcaacagagtgaagctctgtctcaaaaaaaaaaaaaaaaaaaaaaaaaaagcttccctcttgggagcttctccaacttcttccctgaactgagctggttgtcagggctgcagtgggggtgcatgccctacacatgctacccttacatctgcctcacatcccatgcccactcctgacctgtttgtcttggccaggcaccgagattgccatcatcctggatggctcaggaagcattgatcccccagactttcagagagccaaagacttcatctccaacatgatgaggaacttctatgaaaagtgttttgaggtgggcttcyctaagagctggttaacacttatctattgctgagaatcaccctacctcagaacaacaatcaccacatttgctcacaattctatgggtcacatacttgggctgggctcagctggatgattcttctgtccrtcttgcctggagttaccctggagctgcaggcgtctggttgcttgactggggctggatggcctaagatgacctcacttacttgtctggaccatgtgtctttagcaggccagcccaactttttcgtggcagcaacattctaagagggccagatccaatgcatgcaagtatttttcaagtctctaattacatcacatttgctgatgtcttattggccaaagccagtcacatgaccaatcccatcgtcagtatggagggcactacacagggagctggggagaagtctgtgattcactgggggcctttactatcgcacccttctccacccctactcgcttagagattttgctctgccttagcatctctttctgcccagggataaggtagaaggagtggatttttctgctgcttccagcgggagacatttcaggggcagaggtggcaattcttccaacctcctgccctcctgcccatcccctgcagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttgtgagtgtgggggctgcaggaattattctggccatgcccagagtctctgtggcatcactcatggaggaagtggctggccagaaccgcaggagaagagaattagggctccagcctttccctggccgagagagaacgtgagggatgacacctcaaggctgtcctccaaaaagtcttccaaagacttcctcttgtgagatgcaggagagcagagtgctcagtggacaggctggctgggttcaaatctcagctctggttttttttttttgtttttttttttgagatggagtcttgctctgtcaccsaggctggagtgcagkggcacgatctcagctcactgcaagctccgcctcccaggttcacaccattctcctgcctcagcctcccgagtagctgggactacaggcggccaccaccacgcccagttaattttttatatttctaatagaggtggggtttcaccatgttagccaggatggtctcgatctcctgacctcgtgatccgcccgcctcggcctcccaaagtgctgggattacaggcgtgagccaccgcgcccggcctcagctctggtttgtatctgtgtgaccccgggcaaactgaaggaccttgtgacctgtgcttcagtttcctcactttaaaaatgagaaaaataggctgagcgtggtagctcatgcttgtaatcccagcactttgggaggccaacacaggtggatcacctgaggtcaggagttcaagaccagcctggccaacatggtgaaaccccgtctctactcaaaatacaaagttagctgggtgtggtggcaggtgcctgtratcccagctactcgggaggctgaggcagggagaattgcttgaactcgggaggcrgaggttgcagtgagctgagatsgtgcyattgcactccagcctgggtgacagagcgagactccatctatctcaataataataataataaaaataaataaataaaatgagaataataatagtactcacagcttggagcagtggcttgtgcctatagttccagctactcaggaagctgaggcaggaggattgcttgagcccagaagttcaaggatgcagtgagccatgatcacaccactgcactccagcctgggtgacagagtgagacgccgtctctaaaaaagaaagaaaaataatagcacttgcctgatagattttgtgacggttggatggcttaaaatatacagtgtttacaacagtgcctggcacatgataagtgccatgtgagtattatctatcgttttaatatcatgagtcttcctgtacgcacacaagaggaatggactgccaggcagtaccttcctgctgggagcaggtgagaagcaagaacacctgtgttgcagccctccctctgcccagcctcgctgcgtgacttaagggggcatcacccccttctctgggtctttcgggaggattgtgaaccctcccaattctaatacaggtcagagaataaagtctctcctggagctcggtcatccttctggcaawgctctcttcttcatttactctcccctgcttagagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtaagagccaggagccgggagacacctcctgaacctgcacagcctggggtggggagaagccagggttgtcgatgggggcttttctgtaagcagcttatccagaccctgttctatttgcaaatgctcctcttctctycatgctctgtcatcccagagagggctcatttccccatggtggtcacagcttactggccaaatagtggtgggagagccacaggaaacacaccaaggagggttcctggaggaccgyggtgccaagctgagtcctgccagacaaatgggagtagctggcctagggcacaggggaggcagagaggggccctgcaggcagagggaacagcatgtgcagaggtgaggaggagcttggtgtattcaggagaacaggtgtactttggtaaaactggaattttgcccagagtatgggtagaacagggagcagggaaaggaggagaaaggaaggaaggagacaggtaatggagggccccagaggccagatggaggggctcasctctctccctgggcctggggaatccacgcagcrctgactcgctgacccaggctgtctgtgcaggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggtgagggctccgggacccaggccaccgcaggaggcccgagcctatgctccagcccggcctctgtcccatcttcatgtggtttctctgagcaactcccatcatctccctgaacctcagctcttccatgtctaaaaaggcaatggccgggtgtggtggctcatgcctgttatcccaacactttgggagacagaggcaggtggattgcttgaggccaggagtttgagacccgcctgggcaacatggcaaaaccccatctctactaaaacaaaaagtagctggggccaggtgtggtggctcacgcccataatcccaacactctgggaggccaaggccggtggatcacctgaggtctggagttcaagaccagcctggccaacatggtgaaatcctgtttctactaaaaatacaaaaaaatgtagccaggcgtggtggtgcatgcctgtgatcccagctactcaggagcccgagacagaagaatcactcgaacccaggaggcagaggttgcagtgagccaagatcgcgccactgcactccaggatgggtgacagagcgaggctccatctcaaaaaaaaaaaaaaaaaaattagccaggcgtggtggcgcatgacctctattcccagctacttgggaagctaaggcaccaggtcacttgaccttgggaggcacaagttgcagtgagctgatattgagccatggcactccagcctgagcaacagagtgagacactgtctcaaaaaaaaaaaaaaaaaaaaaaaaargscaacaatatccccaggcctccttgcgtcccagaatctccatgaagctctgatgaactgagctggtgctggagaaacaaggatggctggggcatagtcccttctcccaggagctcacagacgaggaaactgaggcctagaaagagtgaactgcccagatagtagttgctcaaggagaacctgggtctctaccctcagccgggttctcttcctgttacaccaagcatggttccttctgggagtgaggccaagctggactgtcccctgactcagtttctcccttcacctcggcccacagcagtctcactgggcttcttggcttgcaggcacggttggagacgcccttcactaccagctggcacagattggcttcagtgctcagatcctggatgaggtacgtggctgactcagcaccaggcaggcttgcccattggtgaggggcccaggacacctaggattcagggactcctgcctcccatccagggctctgccctacctgtggtgattcctgtaaaagagcgattttattttaattaattaattwatttatttattttgagacggagtcttgctctgtcgcccagtctggagtgcagcggtgcartctckgctcactgcaacaaaagggtggccatattgatgacaggaggtcgcttttttctgtgtgctcaaacatccagttgttcccctgaatacagaccaggcaacaggactcggcctgggtcagcttatcaaccaagctgcttgcttctcccggaggagggagtgcaagggcacgaggcaggagcccagtgttggccatctcaccttcccgcctgcatctctggccaggcgggcactagaccaccgaacgcccccctgctcccagccaggttagccgcgctggcccggagacccgcggccaccgtggcccggccttgggtccctcccactcatctgggccccatccccgtccccttcagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggtgagggcggggccacctgatgagggcggggccacctgatgagggcggggcctggaggctccctgatgagggcggggcctggaggctccctgggcgagggtggggcctgagggctacgtgggcgagggcggggcctacctgggcgagggtggggcctgggggctacctgggtgagggcggggcctggaggctacctgggcgagggtggggcctgggggctacctgggtgagggcggggcatggaggccacgtgggcgagggtggggcctgggggctacctgggagagggcggggcctggaagttacgtgaggagggtggggcctggagaccacctgggtgagggcggggcctagaggccacctgggcgagggcggggccgagatggggacaccgaggctgcgcattaggctgcacttgaggtttccggatgggggcgggacctggtcagtcacatgggccgaggggcgggtcctggttagggaccstgaggctgagtactacagcctcctgggtaggtacaaggcctgtcaggtacaccaggcacagcagccacccaggggagggcggggcctctccattaataatagtggtgcagtagctcacgcctgtaatcccaggaggccgatgcgggcggatcatctgaggtctggagaccagcccggccaacatggcaaaaccctgtctctactaaaaatacaaaaattagctaggcgtggtggcggatgcctgtagtcccacgtactcggaaggctgaggcacaagaatcgcttgaacccgggagggggaggttgcaatgagccaagactgtgccactgcactccagcgtgggcgacagactgagactctgtctcaaaaataaataaataaataaataaaaataataatagtggtgggcgtcctctcacccctcttctccgtcctcctagggtgtgtgtgggagcgtgggtagtgaatgtgtgcgaacgagtatttcgagcaaagctgcatacgtgacagacagcgtgtgcatcatatctgtgtgatggggatgtgtgtgactggcaaagtgagagtgctcgctgatgccgatttttaacatagtgagaaagacagtctctcctattttgccccccwccccaggccactttgaaggcctgactgggaaggtgccggggccaagagagaggccaggtgggagcacacggtgtgttcacagccacaccacccttgccccaggttacgctgtggccgtgctgcacaagacctgcagcctctcctacrtcgcgggggctccacrgtacaaacatcatggggccgtgtttgagctccagaaggagggcagagagkccagcttcctgccagtgctggagggagagcaggtacctgctggggaaagcctccaccccttatgaccgatggggaatctggaggcccccaagggaaaggagtgggtcccacggtgcacagtgggccagggcccgggctgggtgaaactcaggctcctgagtggagctcgagggctctgcttcagctctgcatgtctgattgctaggcagtttcctccgctgtggggcctgggctgctcctccactcttctgttactctcagtgagcaaattgatatgtaacgacccaaaytgggtggtccaggaagcacgcgggcaggggtgtagccttgctgaggggtgcaggagcggggctcctggtgagctgagttcctcccgggctgtagatggggtcctattttggctctgagctgtgccctgtggacattgacatggatggaagcacggacttcttgctggtggctgctccattttaccacgttcatggagaagaaggcagagtctacgtgtaccgtctcagcgagcaggtgggagagtctccatcttcatgagcttgctgaggctgtggcactcagcctgacacagaggtgatggaggctgggagtgccctggccctgcctggcaccagtgggcagtgatggggaggtgctcaggctggatggcggctgggcggggcagcggcatcgctctccgcacccactttcttacccaagggtgatcgttgatgataatatctctaatatcyctttttttgtggttgttgtttttgagatggagttttgctctcgttgcccaggctgcaatgcaatggcaggatcttggctcaccgcaacctctgcctccggggttcaagcaattctcctgcctcagcctaccsagtagctgggattacaggcatgggccacacacccggctaattttrtatttttggtagagacagggtttctccatgttggtcaggctggtcttgaactcccgacctcaggtgatccacccacctcggcctcccaaagygttgggattacaggcgtaagccacctcgcccagcatttttttttttttttccgagactgagtctcactctgttgtccaggctggagtgcaatggtgcaatctcaacttactgcaacctctacctcctgggttgattctcctgcctcagcctcccaagtagctgggattacaggcatgtgccactacacccggctaatttttgtaattttagtagagatggggttccgccatgttaaccaggctggtctcgaactcctgacctcaggtgatccacctaccttggcctcccaaagtgatgagattatgggcgtgagtcaccgcgcccagctgataacatctcttacagctgcatggttggcaaagcccgtttagtccaggatctcacttgtttctcatagtaactatgggaggtagctgccactctcatcttacgggtgaggaagctggggctcggcgagcctcagtgatgccgagacttgctcaagtgtacctggcatgtgtgtggcagagccacgagtgaaacccaggcctcccatttgcagcaatgcacccctgcccatggaactagaggggggcgggctctgactcctgaacttccaggtaggaggaccccagctttcccctggtgctcactgtatggccttgggaagktccctggccagtgagcgtgcatcctgggtggcaacggagtgggcacccaccagcccagcgagcgtgcatcctgggtggcaacggagtgggcacccaccggcccagtgagcgtgcatcctgggtggcaatggagtgggaacccaccggcccagcgagcgtgcatcctgggtggcaatggagtgggcacccaccggcccagtgagcgtgcatcggggtggcaatggagtgggcacctagcaccccttcttgagggctgagctgtttgtttgctttacaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaayggacactgggacggcctctccgccagcccctcgcaggtgacccatgggrccctctccttcctctcctctggggctctgacctctctcagatatgatgacccaagccccaagtcggcttcagtcctaagtgctgggcaggtctcgggggttgggaatgcccagtgaaagaaagaagtcccccaggctagggggagcttccagaccagggcctcacctcagccccttcaggttgggrggaggttccagaccagggcttcacctcggccccttcaggttcrggggaggttgtggcggtacctgtctccttccctggcctataccccctccttccacccacctgcctcgggtccctgcttcctctctttctgtccctcgctcctgtctcccacccagcacctccgcgccttatctctcattccccagggctcccttgccagcctctcacactgcatgtattaacaggcacttccacccacctccagctcctcatgagcacctccacctggatggcccccaggcatctcactcccacacggcccatctgagagcacctgcttcccctagaactgatgctcctctgagacctcatccccctccacaccccacaccggaaacctcagacagtcctcagcacgctcacagcctgcacagcctgtcagttcccacgtcctcatgattctagctgtctcccaactccagccccttctctctatccccacccctgcggtcccagctcaggccttgccatcccactcccagcccacccagcttcctcctcctctccatcttccaccccatgtcttcagtgccatttctaaagtgttatcctgattatgtcacttcaaaacaacagaacctttgttgacaccccccatccccaagccccacatcaagcctccttgtaccccaatcccctgtggtccaccccgtccctggccctggctgcttctcagaaggccctgctctttccccaygcctcactctttcccttactctcccctgtcaagtcccacctgccctwcgaggctccatccaaatgccacttcctctgggaaagcttgctccctctttcctggttctagactcggggctccctggggctggatggtgcctgcgatgctgatcgggatagatcatgaaaggactccccgccccgtttccctcccttccctcgccccacgccttgtgtttctgcctccacagcggatcagagcctccacggtggccccaggactccagtacttcggcatgtccatggctggtggctttgatattagtggcgacggccttgccgacatcaccgtgggcactctgggccaggcggttgtgttccggtagggttctgtcctgctttctggggtcccaggcccagcctcacccatttgccctgctctaaatagctccatgcagacattaggcactgagggagggagccagcaccgtggttgtgggcacaggctctggagtctgcccgtctgggtttgaacctcagctctcagccctctcagcctttgggcaggttatttaactctaagaccttacctaggaattataagagcacctacctcccagagctatgaggatcatgcaagcgaatatatacaaagtatttagcacagtgctcagcgatggctgtgattgcagagttttttgttttttgttttttttctgaggcrgagtcttcctcttttgcccaggctggagtgcagtggtgtaatcttggttcactgcaacctcygcctcccaggttcaagcaattcttctgcctcagcctcctgaggagctgggattacaggtgtctgccaccacgcccggctaatttttgtatttttagtagagacagggtttcaccatgttggccaggctggtcttgaactcctgacctcgtgatccacccatcttggcytcccaaagtgctgggattacaggcatgagccactatgcctggccaagaattgcagagtttttgtgccccatccctcagtgaatgatcaagtcccgtggctgtaaatgagctcatggagcgcccgtctgtcccgtcctctccaagctgcagacttgctgtctacccagcacctccctgagctgctgctcacagtcatcccgaagtgaacacgtctaaaaacagagcttttgctgggcgcagtggctcacacctgtaatcccagcactttgggaggcccaggcgggtggatcacaaggtcaggagatggagaccatcctggctaacacggtgaaacctcatctctactaaaaatacaaaaaattagccgggcatggtggcgggcgcctatagtcccagcgactcgggaggctgaggcaggagaatggtgaacccgggaggcggagcttgcagtgagcggagatcgcgccactgcactccagyctgggygacagagcgagactccgtctccaaaaaaaaaraaagaaaaacagagcttttatctccccccacccttcattcccccaaatctatcctgccctcaggctttctgtctcagcaaatggcatcatcatccacccagcaattcaggatgaaaacgtaggcgtcatctttgatgcctcttttccttcctctccaccacatcaacaagtcttagttggctctgcctccagaccagtgcaggcactgtcttcactycctggacactgctgccacagcctttcctgcttccagcccctgcgctccattctccacacagcagcagccctatcccttcactctgctgcctgaaactcctccacggctcctatttagagtaaaatcccaattcctcaccatggctttacagggctcttcgtggcctggcccttcccgcccctccattcccatctcctcctcccatcctctgtctcactaattagattccaggcatgctgacctttgtgctcctcaaacaaaccaaaagtgttcctgccacaggcccttggcactggctgtgctttcttcctggagtgctcttccccagatcctcacacagctggctctttcttgttaacaaatctcaaccgaaatgcctcctcatcagccacgccatctgtgaccacccagtctcagtagccctcggtccttattaccgtatttttgttgttgttgttgagatggagtcttgctctgtcacccaggctggagtgccrtggcaggatgtcggctcactgcaacctccgcctcccaggtttaagcaattctcctgcctcagcctcccaagtargtgggattacaggcgcccgccaccacacccagctaatttttgagttttttagtagagacgatgtttcaccaagttggccaggctggtctcgaacccctgacctcaggtgatcctcccgcctcggcctcccaagtgctgggattacaggcgtgagccaccgcactcggccaacagtattttaatttttctcatagccttgccaatacatagtatctccctgtttctctcgtttatttgcttgttgtctgctttcccaccaaagcagaaacttgtctctttccccactgtaccctgagactcagggatcacctggatgtgggcatgtttgatagagaaccattgaatgcatgaaccaatcagccaggccctgacccagaggctgagcagtcacttctcccatcctctttgctgtcttgtttagctcccggcctgtggttcgcctgaaggtctccatggccttcacccccagcgcactgcccatcggcttcaacggcgtcgtgaatgtccgtttatgttttgaaatcagctctgtaaccacagcctctgagtcaggtaaaaaaatggtccagctgacccctgcctggtgtgatggtctttcctttttggcttctgtaaggggcagggaaagaggactggggcggggggtgggtgggtgttggtctgaggtcctggtgcttgaaatccctcgattagagcttagctccttagtctccaggtttgttaaatgcaaactgcctcaagaaagggtggtctgaggttatgtccacactcagaaggggtttagagctgacactgttgggaagagggacactggggcccttcctcagggttgaagggttgagtttctgaaaaaaaagactcagaaggccgggcgcggtggctcacgcctgtaatcccagcactttgggaggccaaggcgggcagatcacgcggtcaggagatcgagaccatcctgcctaacatggtgaaacaccgtctctactaaaaatacaaaaaattagccgggcaggtgcctgtaatcccagctactcgggaggctgaggcaggagaatagcatgaacccaggagacggagcttgcagtgagctgagatcgcaccactgcactccacgctgggcgacagagcgagactccgtctcagaaaaaaaaaaaagactcagaaaaaggcagccatttctccatgcccacgtgtgtgcgtgtgtgcgggggcttctgagacacaccctcctctttctctctgacttgtgtcttctccccttccctcctcactatgtgcctccggcccaggtgggattggatcacctgttggaggcctggtttctctttccttacctgaaactcattaggagactgttcccagaaaggaggtggtgggcatggctttcacagcccaggtatttactgctcatccaagagctcccccctggaacgattcctcagcaacagtccccgaggtttaatctctcaggagcaatctctgagatggtctctgcctcccacagtcagagagcagtctcctggggtggggtggctttcccaaagcagcaggctattatccacctggggattgaaaatgacagacctggccgggtgtggtagctcacgcctgtaatcccagcactttgggaggccgaggtgggcagatcacgaggtcaggagatcgagaccatcctggctaacacggtgaaaccccgtctctactaaaaatacaaaaatyagccaggtgtggtgacagatgcctgtagtcccagcactttgggaggccgaggcgggtggatcacaaggtcaggagatcgagaccatcctggctaacatggtgaaacgccgtctccactaaacaaaatacaaaaaattagccaggtgtggtggcgggcgcctgtagtcccagctacgggggaggctgaggcaggagaatggtgtgaacccrggaggcggagcttgcagtgagccaagatcgcgccgctgcactccagcctgggtgacagcgagactctgtctcaaaggaaaaaaaaaaagaaaaaagaaaaaaaaaagaaaataacagacctgtcccttccaggacacagagctcgatgggctgtgcgatgctgggcaagtgtctctccctagctgagctggttctgttctgtacagtaagagaggcggccccgggatctccacggtgcttccagctgtgccgtcctggggtttttctcckcagagtccctctttccctctccattctctttgttgtctctcttcctccttattttcttcttcaatctcgatccccttcccragccctccttccctaaagaaggctgactcagtcctgggaatgtgctgctccgggtttggggcgggagcactcagagaccctggtcaggtgtcagaagacggtgagaaaaatatctttgaaaaaccgacgcaggagtccagccgcagggaagtacctgcatggggacactgttcaggaggggccacaaggaacctcaggcaggctgggggccttctgtctgcggctggctcatccccacctcatcgggaaggtctggtcttcattcccaggcctccgygaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagaggtaagtgacggagtttggatgggagtcaggaggggtctttgtcattgagaaaggatttgaggtgatgcagtgaagggcacatacccagacctacaaatgaggtgattaaaataatcataacaggccaggcacggtggctcacgcctgtcatcccagcactttgggaggccaaggcggggggatcacttgaggtcaggagttcgagaccagccgggccaacacggtgaaaccctgtctccactaaaaacacaaaaattagccgggcgtggtggcgggtrcctgtaatcccagctactcgggaggctgaggcaggagaatcgctggaatccaggggagggaggttgcagtgagccgaaatcatgccactgtactccagcctggccaacaagagcaagactccatctcaaaataataataataataaatcaagaaccacgtaatggcacggaagatggagatgctgtcattgctgacgtttttcttggtaataactcaggaatgccagtgttcttggcatgcgttatcmgacctcacctgataataactaggaccgagggcctgaatgtcagttggcatcaaaaaagtgaacaactaaaaggaagaataaaaagatagaaacgaccatctagaaaggtttactcctggcaaaggtgcccagagacatggggtaaaaaaagtatgtcgggactcaaaccctgacaggatctcgaactttggatctatatggatcgtttattccaataaacaaatgcatgaattcttcttctgaatacacatttacccccaaagtgattgttaattggattaaagtctacagccttccttaaataaaggcttaatcacattctctaccagagaatcatgctcactttctcccatgggcttgaggctcttataggggcagaaaggcttatttaaacaaagagagtggcaaatggtatgctaagcaatctccttatcttctctcttacctctctaatatgtcctccatgttgctttgagaaagatcttggttggttgggcgcagtggctcacgcctctaatcccagcactttgggaggccgaggtgggaggatcacctgaagtcaggagttcgagaccggcctgaccaatgtggtaaaaccctgtctctactaaaaaaaaatacaaaaattagccaggcgtggtggcatgcacctgtagtcccagctacttgggagactgaggcaggagaaccttgaacctaagaggcagaggttgcagagagccaagatcgagccactgcactccagcctgggcgacagarcgagactccatctcaaaaaaaaaaaaaaaaaagagagagaaagaacttgataaacccaggtgtggctgtgactcttcccttctgtctgagccagttctttacccctttgtgactgggataagaaccatagcagctatagacacaaaaccgtagtagaatgaaggagatttttcccaaagcacttggcagcttgcttgaaggacgtgtcccttcagcctggcttatttggaagatgcttaggacttctgactcaccacttttattgtttatttcttcttatgatgacatcaaagtagaaagtattcttgcaaggtgcrgtggctcatatttggaaatcccagcactttgggaggccaaggtgggtgaattgcttgagcccaggtggttgaggctgcagtgagccatcatggtgctgctgccctccagactgggtgacagagtgagtgagaccttatcttaaaaaaaaaaaaaaagaaaagaggccgggcgcggtggcttacgcctataatcccagcattttgggaggctgaggcgggtggatcacttgaggtcaggagttcgagaccagcctgaccaacatggcgaaaccctgtctctactaaaaatacaaaaattagccaggcgtggtagcacacacctgtcatcccagctactcgggcggctgaggtaggagaatcgcttgaacccgggaggcggaggttgcagtgagccgagatcacrccactgcactccagcctgggcaacagagcaagactycawctcaaaaaaaaaaaaaaagaaaaaaagaaaaagaaaaaaaaagcattattgttgtcatcttctcccccacatccaactctaaccctgccttccgtggtgaccccacagctctgtgaggaggactgcttctccaatgccagtgtcaaagtcagctaccagctccagacccctgagggacagacggaccatccccagcccatcctggaccgctacactgagccctttgccatcttccaggtgactctacccacagccagtacccagccctcttaagagcctatcccacagaaaccacctgctcccctaacttccaagaatggtggagttgggaggcaatgtcttcagacggcatttgggcccctcaccgtactcatggtgaaactgagtccctgagatggtgttaatgtgtccccgtgagtgaggactcatgggtaacgcaggtctccatctgcccctggggcttgttcctttatgtctttatgttcacaaaagcacttgctacatctttcatgaggcacatgcatacattgcatcctggggacctcacttggcaagcggctctgatgacgctgtgatgggggttccttgtgggagctagactggagctgtcgtgtcttgcactgcagagaggatgccctttggcacacctgcctgttcatgccctgccagggccttcaggctgaatggccccaccaaacctgtatcctagcctctcctcctggtgcccatcagtgcagcttagacaggcgggtagtgtcataagaaacttttgtcagccgggcgccctggctgatgcctgtaatcccaacactttgggaggttgaggcaggtggatcacctgaggtcaggagttcgataccagcctggccaagatggtgaaaccctgtctctactaaaaatacaaaaattggccgggtgtggtggcatgggcctgtagtcccagctactagggaggctgaggcaggagaatcatttgaatcctttgcccaggaggcagaggttccagtgagccaaggccgtgccattgcactccagcctaggcaacagagcgagactccatctcaaaaaaataaaaaataaaataaattttaaaaaatacaaagattagcccagtgtggtggtgcatgcctgtagttccagctactcaggaggctgaggcaggagaattgcttgaccccgggagacagtggttgcagtgaaccgagatcgtgccactgcactccagcctgagtgacagagaaagactccgtctcaaaaaaaaaaaaaaaaaccacaaaccttcaatatatatttcctaaaaacaaaggcattgtcttaacatagtacaataatcaaaatcaggaaattcacattgataaaatactattatctaatttacaaactttattcaaattttgccagttgtcctattaatgtcctttatagcaaaagaaaaaaaaggttctggtccaggatcattcatagcgttctacagttatttatcyttagtctcctttaatctggaagggtttctcactcagtctttccttgtcttttaatgacattaacatttttgaagggtacaggccagtccttttgtagaatgttcctcaatttgtctgatatttcttcataattagattcaggttatacatttttgttttgtttttgagacagagtttcgcccttgttgcccaggctggagtacaatggcgtgatctcggctcactgcaacctctgcctcccaagttcaagcaattctcctgcctcagcctcccgagyagctgggattacaggcatgtatcaccatgcycggctaatttttgtacttttagtagagacggggtttcactatgttggccaggctggtcttgaacacctgacctcaggtgatctaccctcctcggcctcccaaagtgctgggattacagacgtgagccaccatgcctggccaggttatgcatttttgtcaggaatatcacagaagtaaagtgtgtccttctcagtacaccatctcaggaggcacctaatgtggacttgtccattcctagtgctgtttgcctgtgtcattaataagcacgtctcattttatggtgagatgccttgcgattgtatcctgcttaacatctctttatgtgtctttccttaaccagtgatgactattatgctatggcaaagagatttttaaaaagttattccccgtataaaatgggtgaggaaaaaaccacgtggtattaggcacatcggtgttaccagagagtgcgttctggctgggagtttagatggcttaaccccattctctttcactggggctgggtggaagagatcaggctatgtggctatattaaaaatacaacaaaaggccgggcgcgggggctcacgcctgtaatcccagcactttgggaggccsaggctggcrgatcatgaggtcaggagatcgagaccatcctggctaacacagtgaaaccccgtctctactaaaaatacaaaaaaaaaaaaraaattagctgggcgtggtggcgggcagctgtagtcccagctactcgggagkctgaggcaggagaatggcgtgaacccgggaggcggagcttgcagtgagcggagattgcrccactgcactccagcctgggcgacagagcgagactccgtctcaaaaaaaaaaaaaaaaaaaaaaaatacaacaaaaaaccctgcatgaaactgttgacccacttagagagagcgccacgctttgacttctgcaaatggcatcccccttccgcaggaagtagaaagttccctttcaagccctgggctgtcattccccctctaggccrtgggaacagacctgcagacagctgccgaggtggccaccgggagagaagtgcgaagtgcagaggctctccagccgaggagctggctgccttccttcataatacaaaaacagacccagctactttagaacactggaatttttaaaaacacgaactggagcttttcaacctccatggggccttttgaaatgtggctttcagaattagtcgattatgtgtaggcaagggaaatagttagcttacagagacgactagccaggccgggcgcrgtggctcacacctrtaatcccaacactttggaaggccaaggtgggtggatgacctgaggtcaggagtttgagaccarcctggtcaacatggcgaaaccctttctctaataaaaatacaaagttagccaggcgtggtggcacatgcctgtaatcccagctacttgggaggctgaggcaggagaatcgcttgaatcckggaggcagagatggcagtgagccgagatcgcgccattgcactccagcctggatgacagagcgagactccatctgaaaacaaacaaacaaacaaccraaaaaacagatgactagccatgaggaaggaacctccaaggcctggaccttgacgatatttggctaggcatcccccactcctgcccgggctgttctgcctatatccgaaaggactaaggaagcttctcttygcgtaggtgtctgctccctgaatgctcaaagtcgtgagctgtgtgttgctgctgaattcgcatgatgtaaatgtcatgggcacccctaacattccgtgaaggtcaccccagtttttaccttggtcaaaggactgggtcacagtgtgcccatgttataggacagatccaggaatgtcacccaggaatgtcacagtccctgctcttcggggacaatcccagcctgcacccctcacctccctgtaactgcacttctcagggtgagcaggaggcacagcccaaaacttcctataaggagaagagccggaggcagggctgctggggaaggcggagcctgggctgatcgggactctctgtctggttacagctgccctatgagaaggcctgcaagaataagctgttttgtgtcgcagaattacagttggccaccrccgtctctcagtgagttggacatagccgtcagtttcctcgattaaccttctcccgaacgcttgcctgggcaattccttcattaggacaccctgcacatccccttcccctctccccgtggcccacaaatggcttctgcacttattatctcaatatgtcctcagctaccccagaagggaggcaagacagagatctgtcttcccactttctagattaggaagcagactcagtcgccgagggccctgcataggccatttggtggacttgaacctgggtctcttgacatcccggacaatgctatattcagaacccagcgttcttcacagccaggctgacctctacctcagttagaggtaacctctttcccggcccacctcttggccaaattaactaatcaatcaaatatttctggaccatctactttgtgccaagcactctaggtgctggggatacttctgtgaacaacacagacaaaaatccctgccctcctggtgctcttagggggagaagatggtaagtaggtaaattccatgttgatgagatgaacgttgaagacacagggaaggtgggaaggagtgttgggtggcagctgatgctgaagttttcaatggggtggtcacggagggtgacactttggcacacactggaggaggtaggggaacgagctatgtggwtgggtgtctaagggaagagcagctgcaggtaccctgggttggaagcctgcctggtgggtggggggcagggtgagragctagtggctgcagtggagtggggcggggtgtaatgagggaaggggaggaagggggaagaggccatggggcttcttaagccctcagaagggcttttgctgtgagctgggaagtcagaggagtgacacactcatgcagcttagcaggatccttcttgctgcttagctgagaagagaagcggcacttgctccctttgtaaccactcaggtgagaggcggtgtgggctgggccatgacgggagtaacagtttaaagtgacagctcatacgtagcacgtgctgacagaatggaggcggagggaggaaagagggccacagccccagcatgcggcactgcactgtccaacacaccagccacgcttagctgtttacatgtacatgagttaaaattaatcacaatgaaacattttgttcctcagtcacattagccacacttcaaagactcagtggccgcctgtggctggtggtgttgggcagcgcagataccgcctgtctccatcgctgcagacgttctattggaccacactgaattccagaatgacagtgttgccaagcacatgagtgtgggtttagacatgtagtggtcttagaatgccccccaggccgggcgcggtggctcatgcctgtaatcccagcactttgggaggcagaggtaggcggatcatgaggtcaggagtttgagasaagcctggtcaacatggtaaaacyccgtctctactaaaaawacaaaaattagctgggcatggtggtgggcgcctgtaatcacagctactgggcaggctgaggcaggagaatcgctcaaactcgggaggcggagggtgcagtgagccgagatcgctccactgcactccagcctgggtgacagagcaagactccaaaaacggggagggggggagggtaacaaaacaaaacaaacaagcgtccttggcgactagtgttgtgtatgtattgtgattctgttggccagctggctggagttgccgtatatggggaagaacgcagttccccaagtcctggtcagccctttcatagacatttgcaggaccarttgaagactttcaaatgctctggaatccaggctaacaagcaggcacagctgtttccagcagggaattaattacagccaagaaccaacctcccagccagctactgggggtagtagagatacagcacgcatggcttgccctacatcgccccctagtgtacatagcaagcaaacgcttctctttcaaaaacgctagtgagcctggtcgtcggtgtccagctgtctcagtggtttttgacctgaggacatagatccccaaaagaatctaatgaagactacagacccctctccttagaagatcacatgtgcatacataaattttggcattccgggccctctgagacggtccctaggcctcagattaggcaacgctgttaatattctgatgacactgaggtctcacgcctgagctctaagatgtgtgtccagctgacatgtcagcatctctgctttgttatcctatatgcacctcttgtcatgtccccgattgaacgcatcttcttccacccttgggtcttcctcccatgttacctccctcagtcaatggcaccactcagccaccggcaccactcagccaccggcaccactcagccacctgagctagaaactcagaacttgcccttaactcctctgtcccccctcccctgcctctttttcgtttcatttgctttactgtctctgacttctttccttctccactactgttgtcttttttcttcttcttcttcttttgagacagggtctcactctgtcacccaggcaggagtgcagtggcgcgatcttggctcactgcaacctccgcctcccggcttcaagtgcttctcctgcctcagcctcctgtgtagctgggatcacaggcgcacgtgaccacactcagctaatttttgtatttttagtagagacggggttttaccatgttggccaggctggtcttgaactcttggcctcaagtgatccacctgcctcacctcccaaagtgctgggattacaggcgtgagccaccgtgtccagccatccactactgtttccttatttcaggcatgtatcatctctcgggtggagacagcaggctctgtctctgcttcctgtctctccctccagtcaatccagcctcttctcagctgggataaaaaccaaaccaaaaccaaacaatgggaacaaaacacacctcacattacttcctaggccgggcgtggtggctcacgcctgtaatcccagcactttgggaggccatacttcctagatctgcacatctcatctttggacatttcagatggaaaacagttttctcggtattgctaatatgtttttctgtcdatctcagctactgagagtggttctgcactctgggtccctgtgatacctcagcattctggaggaccctttcacacatccccaggaccctcttttccaggacatgtggacccatgtcttaaaccacagccttttaatgggaagggtctgaatgattttgtgggtaggaagctgaggccaagaaacggggtaggacagtatgtcttatgcacactgttctccagtgcacagcagtgccccataaatattgtggcatggatgaatttgtgtcatagagtacctcacctagggtcacagtgaattggtggtagaaagaggatttgggtacaattctctcaattctttggactactagactccaggcatttaattagccttttatttatttatttatttattttgagacrgagtttcrctcttgttgcccaggctggagtgcaatagtgtgctcatggctcactgcaacctctgcctcccgggytcaagcaattctcctgcctcagcctcctgaatagctgggattacaagtgcctgcaccacacctggctaattttttttttctttttttgagatggagtctcatgctgtcacccaggctggagtatagtggcgtgatctcagccctctgcaaactccccctaccgggttcaagcaattctctgtctcagcctcccgagtagctgggattacaggcacctgccaccacacccggctactttttgtatttttagtagagacggggtttcaccatcttggccaggctggtcttgaactcctgacctcaggtgatctacccgcctcggcctcccaaagtgttgggatgacaggtaattagcctgtcttggcttctgtttcctcttctataaaatggagagtagctgtactatttcacagggttactatgagggttgagcgtgtgagacgcagtccttggcacatggtaagcactaaataaagggcagctattatcgtcatctcatgcaacaactgagatgggcgtggcagtccagctgtttgcttatgttgagaggaagaatgtctaagctaaacgtattccttaggcaacttatctaagaagttacttaagaaggtgctattctgggctgtgtgcggtggcttacacctgtaatcccagcactgtgggaggccaaggcaggtggatcacttgagcccaggagttcaagacccgcctccacatggcgagaccctgtctctacaaaaaatacaaaaattagctgcacattggccaggctgggtggctcacgcctgtaatcccagcactttgggaggccgaggcaggcggatcacctgaggtcaggagttcgagaccagcctgaccaacgtggagaaaccccgtccctaataaaaatacaaaattagccaggcatggtggcgygtgcctgtaatcccagctactcaggaggctgagacgggagaattgcttgaacctgggaggtggaggttgcagtgagccgagatcgtgccattgcactccagcctgrgcaacaagaacgaaactccgtctcaaaaaaataaaaataagaaaaatattagctgggcatggtggtaaacacctgtagtcccagctactcggsaggctgaggtgggaggatcacttgaacccaggaagtggaggctgcggtgagccgtgatcattgcaycacagcaccacgctctagcctcggtgaatgtcctattgtattgcgttgaggtttttacagatgaaataaactgtaacatttttatctgtaccctgtgcaggcaggagttggtggtgggtctcacaaaggagctgaccctgaacattaacctaactaactccggggaagattcctacatgacaagcatggccttgaattaccccagaaacctgcagttgaagaggatgcaaaaggtgactgtgacggtggctgtggaaacaggtccctcacgcccctccctcgctgcatgcctgcttttctgtggtgrccccctcactggcacccctgcctccagcctcctcctggtccaaccaacagatggttaataactagataaatccccgccagtccrgctccatgcctcccgaggcaccatattctgctgcagtrccaccctccctatgtgcggccctttcttcaccagggttctgagagagaagtgagtctaatgccctaagacactgagaaagtaaaaattagcttagactgggaaagtgaaaatctgccctgccattcccaaggctggatacagacacagatactaggaaacagtctgtttcccgaggacaccctgtggctgacaagtatcactgcactgagaaattttattctctaaaatcacagatsagaaaactttgggccgggaacggtggctcacacctgtaatcccagcactttgggaggccgagacgggcggatcacgaggtcaggagatcgagaccatcctggctaacacggtgaaaccccgtctctactaaaaatacaaaaaaaattagctgggcgcgatggcgggtgcctgtagtcccagctactcgggaggctgaggcaggagaatggcgtgaacccgggaggcggagcttgcagtgagccgagattgcgccactacactccagcctgggccacagagcaagagtctgtctcaaaagaaaaaacaagaaagaaaactttgctgtttgaagtagttacgtcrgtaattatgaacccctatccctcttgcctggagagtgtaagtcattttgaccaagagaagagtctgtttccacctgaggtagagagcttcagatacagtgtctgtcaactttctactccatattaatggtttcccaggaagcgggccctgggtctgattcacaggctggcctgctggtgactgactccttgacactcagccctgctttaccatcaaaacaggactttatttacatttcatctgaactccacccttccctggagtcctttaataaccgccttttccattgttcagtgatacacacaatagtgtagtttttggatgggtgcagtggcccawgcctgtaatcccagcactttgggaggccgaggcgggcggatcacctgaggtcaggagttcgagaccagcctggccaacatggcaaaaccccgtctctactaaaaatacaaaaattagccaggtgtggtgatgtacacctgtaatcccagckactcgggaggctgaggcacgagaatcacttgaacccggaggtggagattggagtgagctgagattgcgccactgcactccagcctgggcaacagagcaggactctgtctcaaaaacaaacaaacaaacaaacaaaaccaaagtgtagttttcctcattgcagtgagtcaataaatttgaatttgttggactgtagatttgtccccggtcatcttaggctatttgggctaggacagtatccattatatgaatgaagcaatctcctaggcygggcaccgtggctcacggctgtamtcccatcactttgggaggctgaagtgggtggatcacttgaggtcaggagttcgagaccagcctggctaacatggtgaaaccctgtttctattaaaaatacaaaaaattagccgggcgtggtgktgggcacctataatcccagctacttgggagactgaggcaggagaattgcttgaacccgggaggtggaggttgcagtgagccgagatcgcgccacttcactgcagcttgggcgaaagagtgaaactccatctcaaaaaaatgaaaacaaaagcaaaaaacaatctcctaggcatctagaggggaactagggatggaccgtccctgggagaattaagaaaactcactgcagtcatcacctgcccctcgggggtccaggtggggagccctggtggctacgtggcagtgctggtgtgtgccggccttccagccaggctgtgggttatatttgcatcagtccatggcccagctcaaatgcctccttccccaggaagaccttacgaattcctccgagttggaattcatatttctccactgctgttctctgcagctccctcacagaagcaccccttcgaccttgtatttaaattcctcggggatctactgctgaccctgcctgtccggcttgtgaggaagacagggaccaagtggactttatttctttagctcctggcagggtgtctgacaggcagaaaaattagtgaatgtttgctgaattgctgtgaggaaaccacgtttttgttttgttttgtttggctctttaagagaatgtcatctgctctkttaacagcctccctctccaaacattcastgtgatgaccctcagccggttgcttctgtcctgatcatgaactgcaggattggtcaccccgtcctcaagaggtcatctgtgagtcggtttggacygattcgctcttctcaccaccctgcagttggcgtcttctgcaycttggtctcayctcaatctctcggttccagctttgcgcttcgcttgactgcagtgtgtccccagcagtgcttacagtggctaagctggctctgaaagtagggggtgatggggaygagagctttccagtacacagccctaggtgaactgcctgctcacctccrtgaagcagagtgaagttgtgggtagtatggagggcgtgtcagacaaaaagtttttttgtttgtttgtttttgagatggagtttcattctgtcacccaggctggagtgcagtggcacartctcagctcactrcaacctcygcctcccgggttcaagtgattctccttcctcagcctcctgagtagctgggattacaggcgtgcagcactacacccggctaatttttaaaatatttttggtagagatggggtttcaccatgttggccaggctggtctcaaactcctgtcctcaagtgatccacctgcctcgacctcccaaagtgctgggatgacaggcatgagccaccatgcccggccaagacgaaaagttattaaccctgatctgtcccttgtcatctctgtgctgtgggaaatctctgaagtggcttcttcacctgtaaaaggggaatgaggccgcctgccttgcttactccatatttgtatttgaggcttaactgaaataacggggccaggcgcggtggctcatgcctgtaatcccagcactttgggagaccgaggtgggtggatcatttgaggtcaggagttcgagaccagcctggccaacatggtgaaaccccgtctctactaagaatacaaaaattagctgggcgtggtggtgcgtgcctgtaatcccagctacttgggaggctgaggcaggagaattgcttgaacctgggaggcagaggttgcagtgagctgagatcacaccattgcactccatcctgggtgacagagcgagactccctctcaaaaaaaaaaaaaaaaaaaaaaaaggaagggaaaggaaacatgctgtgttagaaaaatgtgaggaatgtgaaaatctgaggaatcgtctcctaggtctgttccacgagtagctagcggtctgaattgtgagtggcatagagagaatcaactgaccatttttccccctttaaaataggctcatgtttcagtcgtttggcagctagaggagaatgcctttccaaacaggacagcagacatcactgtgactgtcaccaagtaagtactgcctgggtcacagcagagtcaggctatgaccccggaagacatctccctgccacatgcacgctgtgagaggaacggcccccttacagcccagggagaaaggaaaccccagtgagcccacagaaggcatctgtttccctgcagggactcgactttctcttcttgttaccagagataatgaaaatgttcttttgttcacacacaaagtaaaactgtggtacagcctggtggaatgagccctggagttctggttctcgttcactcagctttggaatagcttgggatagctatgttayctgcaagacctctgtgttggggggtaaggtggggaacgctgctgggaagagttctcaaagggaggtgattctgcccaccagaggctgtgcctgttttgattgccatgacttggggaggggggtgttcagtaggacatctggtgggtagaggccaggaatactgccaaacatcacgcagagcagtacaggacagcccccacaaccaagaactaactggcccaaaacgtcaatagtgtggaggctgagaagcccttttaaaatcagtattcttctaagtgtggtcttctagagacaattctgaactccaattgcttatctctgaaagccttttatttatttatttattttttgagacgagtctcgctctgtcgcccaggctggagtgctgtggcgtgatctcggctcactgcaacctctgcctccaggttcaagcarttctctgcctcagcctcccgagtagctgggattacaggcgcccgccaccacgcccagctaatttttgtagttttagtagagatggggtttcaccatcttggccaagctggtcttgaactcctgacctcgtgatccaccagccttggcctcccaaagcactgggattacaggcatgagccaccgcgcccagcctctgagagccttttcttatctgactcccagtgaccctggggagccaggtgcagaagcacctgttctgcagtgagagcacatggacacagggaggggaacagcacacactggggcctgtgggaggggcagggttggggagagcttcaggaagaatagctaatgcgtgttgggcttagtaactaggtgctgggttgacagctgcagcaaagcaccatggcacacgttcacctatgtaacaaacctgcacatctgcacatgtaccctggaacttaaaaaaatagccaggcgcagtggctcacgcctgtaatcccagcactttgggaggccaaggcaggcagatcacttgaggtcaggagttcgagaccagcctggccaacatggtgaaaccccatctctactaaaaatacaaaaattaactgggtatggtggctcacgcctgtaattccagctactcaggaggctgaggcatgagaattgcttgaacccggggggcggaggttgcagtgagctgagacrgcaacactgcactcctgcctgggcaacagagcgaagccctttttaagaagcacttgctatgtacaaagcaggtgtgctatgaactaacactcttattcctagttccaatgaaagayggtctttggccaacgagacccacacccttcaattcaggcatggcttcgttgcagttctgtccaagtgagtactcccaagaggccagcagcggtgtgactccatcgcccagggggcagctttgggctctctctcgtagatggagctggtggtcaggatgaatgtggacactgtccttctgagaggagcctgcttagaacccaggctctgatattgatctctagggtgctaacatttgggtcacaraaaccccactgtggtcatcaaaggaggtgtattgccaactagtcgtgctacaaaagggaattaatatgacgctgtggagggaagaaggcagctgtgggactgggaagtaaggaggggatgagtaaggccatttgagggataattagaaaatgaaccagcccaacgatacagaattcaaatattccacctcaccccaactgcgctacgaccactttatattttgacattcagcttttattccttttttttttttttttaaactgagacgaagtctcactctgtcgcccaggctggagtgcagtggtgccatctcggctcactgcaacctctgccgcccaggttcaagcgattctcctgcctcagcctcccragtagttgagactacaggtggacaccaccaggcccagctaatttttaaaaaatttttaatagagacrgggatttcaccatgttggccaggctggtcttgaactcctggcctcrggtgatccgcctgcctcggcctcccaaagtgctgggatgataggcatgaaccactgcacccggcctcattcctggtaaaggtctggtgccctctgtcctaatgtattcagttgaaagcagtcgagttcattcaaaaagagaaggccgggtgcggtggctcacgcctgtcatcccagcactttgggaggctgaggtgggtggatcacctgaggtcaggagttcaagaccagcctggctaacatggcgaaaccccgtctctactraaaatatgaaaattagccaggtgtggtggcaggcgcctgtaatctcagctacttgggggcttaggcaggagaatcacttaaacccaggaggcagaggttgcagtgagctgagatcgcaccactgcactccagcctgggcaacagagcaagactccasctcaaaaaaaaaaaaaaaaaaaaagggatgagtgtagtggctcatgcctgtcatcccaacactttcgcaggctgaggtggaggatcacttgagcctgggaggttgaggctacactgagccatgattgttccactgtgctctagcctgggcaacagagtgagaccctgtctccaaaaaagggagaaagactcctcaagggctgacgcatgtcctstcaattgcagaccatccataatgtacgtgaacacaggccaggggctttctcaccacaaagaattcctcttccatgtaagtacttattwttgtaaagctgtagatggcaaagcaataccagctttgatttcctactctgattttaatttgcaggtacatggggagaacctctttggagcagaataccagttgcaaatttgcgtcccaaccaaattacgaggtctccaggttgyagcagtgaagaagctgacgaggactcaggtatttaaaggcagttmtttatcagtcacacctctttccacagtgactacagagtctcaagtataaaaaccagagttctagaaacagagtgaagrcaagttaaccatgggaaaagattaggagtaaattcccgaagtcctgttcagaaggactctcaatcactcagctcttaaagcaacctgtcagttttcctccctttgaggaaaaataagcaaaaattggccaggtgcggtggctcacacctgtaatcccagcactttgggaggccgaggcgggtggatcacaaggtcagcagatcgagaccatcctggctaacacggtgaaaccccgtctctactraaaatacaaaaaattctccgggcgtggtggcgggcrcctgtagtcccagctacttgggaggctgaggcaggagaatggtgtgagcccgggaggcggagcttgcagtgagccgagatcctgccactgcactccagcctgggagacagagtgmgactccatctcaaaaaaaaaaaaaagcaaaaattaaaaccttgtcagtagacagagacattttccctttgaaaattgataaattctgcttctctgtgtgagygatgtaacatgtgacatttcttacactgccccctataagttgcttactagcttcccttcttctcccctgaractcttttttggtctctgctttgcctcagcctctttgctttcagttgtctcatctgtagtctggttcccaaagctagccttgatacctgaagcaacaggctctgctcagtatgaagctgaagcctgggcattttttttttgctcagactacataagtgttaaggctcaaaaaacggaaaggaatttacagaaaggactctgctgacaattagaaagagggcttataggtcaggtgccatggctcactcctgtaatcacccagcactttgggatgccgaggtgggtggatcacaaggtgaggagttcgagaccagcctggccaacatggtgaaacccccatctctactaaaaaaatacaaacaattagccgggcatggtggtgtatgcctgcaatcccagctactcgggaggctgaggtaggagaattgcttgaacccgggaggcggaggttgcagtgagctgagatcgcaccactgcactctagcctgggtgacagagcaagactctgtctcaataaaattwaaaaaaaaaaaaagagggtttataaatataaacgtttgttttcacatgtagtttatttatttaaaaaaatagagacaggggtcttgctatgttgaccaggctagatatgaactcttgggctcaagcgatcctcctgcctcagcctcccgagtagctgggaytacaggcgcacgccactgygcccggctagtttacttctttcagaacatttgttatcagcaaatttaaacatttcaacaaatatttcagtttccatttggaaacaaaattcttgtttgaaaagctgactggaaacctgtgagaatgggagttccaccctcctgtggggayggaggttgaaacagcaccagaggcttcaagaccagtctcctctcatttcggggcagtaagatacatttagcttacttaaacagactgtgctggcagagcaagtcagtggcagagctgaagttcagcattgtcctgtggaactcctggatttttctcttaatttgcttcatggcaggagtgttacatttagtcttgaaggtcatttgtttcagcatcttgtctgtcaggtaatgtaaccagagcacattactataagggtgatattcaccccagcggttgttattctccttcttcatgagcctgtagatgtcaaactggtagtcaccgtcaccggtaaacaggtcctcatccatggaaacgtcacagaaaaccacaatcccatcccgttccaagcgcgacagggtgtagtcaatgatgctcacttgcaacccacagctggggatagtgctgctcttcccattgagggtgtagtggagttttttgaggctggttttctttaagagcacgttcccccagtgtaagtctcggtgctcaaagcgcagtgatgcctctgccactgcgagggaggctgtgagctggtgtagaatgctctttgcagtagccaaggaagacaacttggttcgcatttgctctaagtcaatccctccaaactcaaattccagcacaatgaagagctggtcgtctttaaaaaaatcaggccggtcatttgcagagcctttggttgaattatagtgatcccaggctttgaggagcaagggagggtaagatccctggacacagtgcactgagttcagcccgataaagccttctgtgcggttgcacacttcaccggataagaggctcaactctttggagatgatgatctctggcaggatttcctcaaaggttttctgatgggatccattgactaaatctggtccttcaatagcaatgatttttatggctacgggtgtgtgatcagcaattgtttgaaacacttcgccaaacaccccttccccaatcttctcacagmgttgcagtttttctgtgggaaggcaatggctaaaggggacaggacccttctgactgcattccccataaaccttttcagcatcagatgcctttttgtttgaaatacttagagtgtttaaggggcttagcaaatacatagaggaggagtgccaagaggacggagcaccacttgttctgttcatgacaggccggtttgaacattctgatargagggatccagagagagaagtggcagtggtatagatgctgcagacctctgacacatcagtcacaattttcttcttgtggaaactgaaggaagccctggttttggtccaaaagcagrcattctgtaaaggagtcaggtcctgggtggggaacgaatcttttcccagcttttggccctttttaaagcggtgggaatggaggagagaggtttccgttgcctcctgatgtttgctcttccggcttgatctagttctctccagcctgtctrttccccttggcacaatgcggcccttgggaacactggcctcctgatgctctctccggacggcctcttgaagccctctctcttgacaagagtcctggcctgtggccctcctcttgcctgtgcttgacagacctggaccctctggtccatttcccaccaccagtttccttttacagcaggactctctcatattcttcccatctgcccgaaactcagaatcctcaggggttcctgagttcataaggccaaagagaactgacctgaggctggcgcgggtttggtggaccatcctggtgtccttggctcctcctgtcgcttcctcctgggagcaggggagagatgctcggtccagggagacttctgggaggtggaggycgctcgggacggctgaggctgcaaccagacaggcggaggtgccgatcgagatgacactgtcccttggcgttggggacccggggcagggcgaggccagagagctgaacagggaggcactgatgcccagctcgtcgccgtccctgggctggccgcacacgctgaggtccgggctgaggcggccggagtcgcggctggggaagggcggaagtcggagcgggccrcagggtgtgctgcacttctgcgggggccgagctcgcagccccaggcgtcttggggtcacggttaggcttgggcgagctcgcagcttccagcgctttggggtcacggtcaggctgggccggtccttgggcactcggccgccgggacacctccgccgccgcctcwccgggctgccggggaagtcggggtcgtcgggatcgtcaggatcgtcggactgcgaggggtcgccgatgctggcgtcgctgctgccgctgctgttgaagaaacgcctccggtcctgcggcgggaaccactgcgcggcttcccggcccggccgccgctgtctcctgccgtccgcagccccatatgtgcggaaaagccggctcccaggtcccgggagcgaagccgccatggccggcacccgccaagaggttcaaacgcaaacatcgcgagacttccgtgcgacgcggacgcgcccgcctgccgcggggtcctagctcccggccctgcgcatgcgcacctcgccagggccggggccgggacgggacggaaaactggcggcttggtttgttcagcgcgtcgcggtcatggctctcgtttcaggcctccacggtgtgcacctggagtcaggagcgcgcttgtgcgtacagttcggttcaggtaagcgcggccgtcccgagaggccaggggagggcggagggcctgaagcgggtaacgagaggccaggagactgtttttcctgggttacccctgcckgccagtgccgggggctgccaggccctccctagcttcgtccctgggtctcaattgctcccgctggagcttygcttgggccgaggtgagcgctgaaattgctcacaccctctattctgggaccttacgatgctctgtgtccgaagtgttaaaaagatttcagactttccgcacggaaaggaattgtgttcactagacctcgcttttccagcatgtggaagaakggcattcagtgagctgtgtcatcgcttcagataaagaaaatgtcaccgtggctgcagagatctcctgggatcactctgaggaggtgtttgagactgaaatgctccagatttgattatccagttgctcacgggcatcgcccctagaagagataatagcatctttgcataacrtgtccatgtccawaatagrtcttttggtgcaaaaaaccaaccctctgtcccaacccgttccttagctaccctcaggagggagatatactccagttacagtacaaggaactcgagggattacctgtgactcctctttcctacatccccacgtctattccagcagcaagccctgccatttcagggccaaaatatatcctaaacccattcacttctctccatttccactgccgttgtaattcaagctaccctttcttgccagggctgttgcaataascttcggcctgcctttcttgcctctgcttttcccacattctttacaaataattcccacgtaacagctatccgtcttctaagagcagacattagattgtgccaytcccctgcttattaaaaataacaaacaaacaaaactgatgcttgagcacacttagactaaaatccatacttttttcatggccagagcaaggcagtacttgatctggtctctgcttaattcttcaacttcatctcctagtactcgcctttctctcccactgccccttttataatcgggttattctgtcctattcttctagctcgccagtacagcattattctggccacaagactttgtacttgctgttcctttgcttgacactgctcttcctctaggtcctgacgtaggtggtttcttcttaaatttagctcaggtgttcttttcttttytttttttttttttttagatggagtcttgctctgtcacccksgctggagtgcagtggcacgatctctactcactgcaacctccgcctcccgggttcaagtgattctcctgcctcagcctcccgagtagctgggattacaggcgccggcgaccacgcccagctaatttttgtatttttagtagagagggggtttcaccatgttggccargctggtctcgaactcctgacctcaggtgatcgcccgcctcagcctcccaaagtgctgggattacaggcgtgagccaccgcacccgacctaggtgttcttttcttttcttttctttctttcaagacggagtttcgctcttgttgtgcaatggcacgatctcggctcactgcaacctccgcctcccgggttcaagcgattctcctgcctcagcctcccaagtagctgggattacaggtatgcgccaccatacccggctaattttgtatttttagtagagatggggtttctccatgttggtgaggctggtcttgaactcctgacctcaggtgatccgccctcctyggcctcccaaagtgctgggattacaggcgtgagccaccacgcccggctaattttgtatttttagtagagatggggtttcatcgtgttggtcaggctggtcttgaactcctgacctcagatgatctacccacctcagcctcccgaagtgctgggattacaggcatgagccaccacacccggccacacgtgttattttcttagagaggccttccctgatcacttattctaaagtgggaactagtgatcaagtgatcaagtttaatgttttacagtgatccaggtgacatttgtgaggtctcaactgaagaagtagcaatgggggtggaaaagaaagggacagatacargaaataatttaaaaaaaaagaattgtgagtgtggtggctcacatctgtcatcccaacactttgggaggctgaggcgggaggattgcttgaggccaggagttcaagatcagcctgggcagcatagtgaaaccccatttcttaaaaataaataaatacataaattagccacgcatggtggctcatgcctgtagtcccagctacttgggaggctgaggcaggagtatcgtttgagcccaggaatttgaagcttcagtgagctatgattgagccactccattccggcccgggtaacagagtgagaccttgtctcaaaaaaaaaaaaaaaaaaaaaaaaaaaggaaaaatctcttacgttaaataaaatgaataagctgggtgtggtggctcatgcctgtaatctcagcactgtgggaggctaaggtgggtggattrcttgagcccaggagtttgagascagcctgggcaacatggtaaaaccccatctctacaaaaaatacaaaaattagcccagtgtggtggggtgcacctgtggtctcagctactcaggagactgaggtggraggatcacttgagcctggaaggttgaggctatagtgacccatgatcatgccattgcactccagcatgggtgacagagcgagatcctgtctcaaaaataagtcagtcagtcaagaactgactttggatggcacaagggaaaagaagttgaagaaaaggccaggcgcggcagctcrcgcctgtaatcccagcactttgggaggccgaggtgggtagatcatctgaggtcaggagttcgagacaagcctggccaacatggcaaaaccccatctctactaaaaatacaaaaattagcctggcatggtggcacatgcccataattccagctactcgggaggctaaggcaggagaatcgcttgaacctgacggggtggaggttgcagtgagccgagatcgcaccacttcactccagcctgggcgaaagagcgaaactccatctcaaaaaaaaaaaaaaggaagttgaagaataactgcagatgtcttgtttgggtaactttatgtagtgttgtgtacgttagggccattaactaagcccaggaatacctttaaagggaaaggtggtgaaggctgttcaaacacagtgagttcatgtctaaaatatgttttgtttccctcattcctttccccatcttctagttactaaaagatgtaactgaactgcagatccttggtgaaatatctttcaacaaatctctatatgagggactkaatgcagagaaccacagaactaaggtaattcctggctggcttctgagtastgcccaaggaaaattgtgcctaacctttgagcacctccacagacattctgttgccctcttcctgttttcagccttaacacttctgatcttggctctgccatcgctgcctttgtgacctttgagtgagtcagcttcttatgaaataaggcaattaagaggcctaagctgaggagttctgagttgaaataactaggctggaatctgcagtatatactttgatttgaaaatggattgattaaaaaaaaaaatttcgcagctgggcgcaggtggctcacgcctgtaatcctagcactttgggaggccgagacaggtggatcacctgaggtcagragttcaacacaagcctggccaacatggagaaaccctgtctaccaaaaatacaaaaattagccggacatgatggtgggtgcctgtaatcccacctacytgggaggctgaggcacgagaatcgcttgaatctgggaggcagaggttgcagtgagccgagatcacaccactccactccagcctcagtgatagagygagactcagtctcaaaaaataaataaataaawaaaaaatgaattacctaagtgagaaattgttttttgtatccagtaactgtcttagtgtgctgtatcagtgtttagttatagtattaaacagtactcaggaatgcataaatcttttataagatttagactagatactggaactcttggaattctttttgcaaaagtatgactagaagtcagactgatgcctgtgatttgtggactgaatgctttgtgtgttaccstgtgttttcattcttgttgacccttgcctggacatggcttcagaggtgatctatctgtgagctctgagctctttagttaggcatgattctctactagagggaatgtcaggagagtgatgctggattgctaaatataaggtcctctgttttcctccctggaggrggagaaaggagcaattctctagacatgccaatataacatttccttttatttttaagtagtgtatttctttttcttttcttttctttcttttttttttttttttttgaggaagaatctcactgtgtcrcccaggctggagtccgttggtgccatctcggctcactgcaacctccacctccccagttcaagtgattcttcttcctcagcctcccgagtagctgggattacaggtgcccaccaccatgcctggctaatttatttattttttttaaatagagacaggatttcaccatgttggccaggctggtctcgaacttctgacctcaggtgatctgcccgccttgacctcccaaagtgctgggattacaggcatgagccaccatgtccggctaagtagtgtatttctaatacagaaaatagagggaaatggaaaatacagaaaacggaagaaatagaagtgccccattattgcactgcccagattttaacaaataaaartaatagcaagaaaatccaagccatacagagaatggtaccaaatgaaaaataatkgttccttcatttctcccttcccatgcccccagcagggaggagttactattaagtttcttatgtgcacattttaaatttgtatgtttccccctcttacttactgatacttttatttctatagcatggattccccaaaattcctttctttaaatccaatatcctaagcaaagtgttaagtagttcctgacaataagcccctgacttacagtgactctatgagtataaacaaactgtatccaaatgcatttcagccacaagaaagggaaaatccagctcatgcagcataagggcatatgctgtttatccagtgagggaggccggcctggggcgatggcctggcttctttggtccttgtactctgccgtgtgggggacgcattccttcatggccagcacaaagttgccacatctccaaatgctgtattttcacatggcaggatacaaaacaggaagcaagaagtcagtagcaaaaggatgttggatttttcttcatgtgccttcccttttcagggatgaaacagtttccaaaagctcccaggagacatcctcttacatcttattagtgagatctgaatctcatgtcagtcactggcaaaggagaatagctgtgtcatgatcacctgagaccaacgatgattcctgaataaaatccgaaaggagagaggggcccctgggcaggccagcatccgtgtttgctgcaaacagtagtacccggtgccttgcttctcccttaacctctacttgggcatctttggggcacttttgggaatctgtgggtttagaagaagataaagggaggtggctttgagaaatagggacatttcttctactcacatctggcctgtttcccsagtcaccttgggacttcctttcacttcccaaacccagggtcttgagtccccctccttctcctgtagaatattccagccctctttctgttcttcctccctctttgttgctatggtacctccctattctcaaagcctaggacttcactcctatttagttcagctacctatgagctaaataggactggaaggtcaactttaggtcaaccagcatttataacttaattggaagaggccttaaaggtaagtttgtccagcccttcaccccgtacagaaacctctccaaagcacccctgaccttggtgcttaaacatacacgtgaagggttgctctgggcaggcagagaagtcttgttggctctctggccccacctaagtcctgggaacttcctctggccacaacttggaagggccatacctgggtctcaggaagsacatctcctgaactttctagctgagccctgccagaagagagattagactcccgaaattgggagagcctttggaaaacaaaacctgmggatgacttctaatagctgagctctgcaagtagtacacatggatataatttgcatttattatgtcccttaggtaatacacactttttagtctggtgaggggaagaccagtacttttgtcatattttatgtggggaaagtgtattaccaaagcctttagggatctgtgcaagatcaaaaagagccgtcagaacggagttggaaaggacttggagatcatttaaaggaagtcatcattttaaagagcataggcacggggctcagggacatagagcagtgtagcggcgtgacagcctcacagtcctgtgttgagaccggattccgtgggaccctctttcaagctgtcagarcatctttaacagaaggtcataatctcctgacagacctagcccttctagataaggggccagaatagtttcttacgaagtatttgggtgattggatagttttagatgatctaaaatgctgcatcagggaatatctagctttttgctttactgtcatcagctttgatcaatacacgggttgttgccaagtcctcgtattttgctccttaaaataacatgtaggattttttcctygtttgcttcacctgatttattgggcgatctctttgtcttgtctagatcactgtcgtcttcctgaaagatgagaagtaccattctttgcctatcatcattaaaggcagcgttggtggacttctggtgttgatcgtgattctggtcatcctgttcaaggtcagttctactcatggcatcacagtgagggaagactgggctctagttttgggcacagaactccttaggacagccaacctctgacttagagcagctgccctggcctcgtggccacttttttctcctccttcaactgcacacccccatttagacaaatgagtaaaacagtatctgtctgaaaagagaaaactctgagtwataaagagtgattttatatatatttctttggtacctccctrttctcaaggcccagaacttaatactgttatgttcggttacctgtgagttcaatagggcctggaaggtcaaccctaggccagcatttataacttacttggaagaggccttaacrgtaaggccttaaaacagatgtgactgttgttcccctgttgaaatcttttccttgccttcccgtcttaatgtgcaaactcttctactgctatttaagatcctctcctctgtccgctacccgtctctgcccttaagtgttgcttttttttctttttttttttgagacggagttccgctctttcgcccaggcttgagtgcggtggtgcgatctcggctcactgcaacctccccgtccccccgccctgaccccgggttcaagagattctcctgcctcagcctcctgagtagctgggattacaggaatgtgccaccatgcctggctaattgttttgtatttttagtagagacggggtttcaccatattggccaggctggtctcaaactcctgaccttgtgatcctcccgcctcrgcctcccaaagttctgggattacagkcatgaaccaccactcccagcctcttttttaaaaataaacaccagggtctttgtcccccaagctggagytcagtggcacagttaagggctcactgcagcctcstactcctaggctcaggtgatcctcccatcttagtctcctgagtaactgggactgttactcaggtgcatgccaccacacccagctaattttttaattttaattttgtggagatgaggtctccctatattgcccaggctggtctcaaactccggggctcgagcsatcttctcatcttggcctcccgaagtggtggggttacaggcataagcacctgaccttgcttttttctcccaacaagtcaaactattccctaaataggttcgtgcctctgcgtacgcgtaggctgcttttcttgtcaggaatgccctccatgactgctcacttcactcactgtcttccctgaaagcrgtctagagactcctgagtcctctgtgctggcttctgtgtgtttgctgtgagctcccttctagaaacccttccaaatggcagtcatcacactgtrttgtaattatctctttttcctactagatgatgagcttgatgtaggaagctgtacttgatctccttctgtcttcagcatcataggctatactgagtatttttgcataaataagatkagatccagtacagccgaaattatcatgctttgcaaaataagttaawaaggttcarctgctcgggagagcagggttcagaggaaggtggagtcagttctgattgagggatgagcaccagaggtcttgaaggattggactctccaggagagattcagagtaagttaggagaagggagtagtaagtatgagaagcagaggaatataggggctatttaggcaacagccagaatgccrgttttctgaaacagatggctatctttggcctgtaactggacttttccttcctttgtttcagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgcartagtgcctttaatctggaaatacagtattacttaggatttgcagtacattttgcctgatagggcaagttttcattcttatttttaaaaaatgatagattgtggctgggcatgatggctcacgcctgtaatcccagcactttgagaggctgaggcaggcagatcacgaggtcaagagatcgagaccatcctggccaacatggtgaaaccccatctctactaaaaatacaaaaattagctgggcatggtggcgggcgcctgtagtcccagctactcaggaggctgaggcaggagaatcatttgaacctgggaggcggaggttgcagtgagccgagatcgtgccactgcactccagcctagcaacagagtgagactccatctcaaaaagaaaaaaacaaaataggcggggtgcggtggctcacgcctgtaatcccagcactctgagaggctgaggcaggtggatcacgaggtcaggagatggagaccatcctggctaacacggtgaaaccccgtctctactaaaaataaaaaaaattagccgggtgcggtggcaggtgcctgtagtcccagctactcgggaggctgaggcaggagaatggcgtgaacctgggaggcagagcttgcagtgagccaagatcacgccattgcactccagcctgggcaaaagagcaagactgtctcaaaaaaaaaattatcgattgtatcctttcagataattcttaagtatcaatttttcagatttccagaagaaactctttggggttttaatttaaacatacaggttaagtttgggagcattgatatctttatagatttcctttctactccgcttgctgcgatttattttttattttttattttactttatttttttttttttgagacagagttttgctcttacttcccagactggtgtgcaatggtgtgatcttggctcaccgcaacctccgcctcccaggttcaagcgattctcctgcctcagcctcctgagtaactgggattacaggcatgcgccaccacgcccagataattttgtatttttagtagagatggggtttctccatgttggtcaggctggtctcaaactcttgacttcaggtgatccacctgcctcagcctcccaaagtgctgggattacaggcgtgagccaccgcgcctggcaatgctgagatttttaaaaacactctgtagcaaggttttataattttcttcaaaggggtcttaatttataaagacttacttccagctgcatttttatttgtttatttattttgggggggtctcactgtgtcgcccaggctggagggcagtgatgcggtcataggttgctgcagccttgaacttttgggttcaagccgtcctctgcctcagcctcctgtgtagctgggactacaggtgcaagccactatgcccggctcattttttaatttttcttttgtagagatgggatctagctatgttgaccaagctgatttcaaactcctggcttcaagtgatcctcctgccttagcctctgaaagtgttggggcgtgagccactgcgcctgacctgttattatgcttttgttgctactgtgtgaaaataccgttttttccccctgactgtttagagtttgcacttagaacagttggtggttttgaatgtttatcttmtctggccattttactgaactgtggttttgtttttttggagacggagtctcactctgtcgcccacgctggagtgcagtggtgtgatctctgctcactgcaacctccgcctcccgggttccagcaattctcctgcctcaccctcccgagtagctgggactacagggacccaccaccatgcccagctaatttttgcacttttagtagagatggggtttcaccatgttaggctggtctcgaactcctgacctcaggtgatccacccgcctcaggctcacaaagtgctgggattacaggcatgagccaaatccgggcccggccaaactgtttttaaatcactctttagttgattctttgggatttttctaaggagacaattttatttgcaaataatggcaatttggagtctttctgatatttctacttttggctacccttacttctttgactaggacgtggagagctctgagaagtaaaccgtgtacctggttgtaatgggagggcttttctggccctcctctgcctgcctcacacctgcctgttatcccagccccggctgctctgcctttgggtagtttctagggcttggttggagcagcccattcacctctcatggagccccgtaccttgccagtgttacatcactaggctgttgggcacgatctgcttccctgttgatctgattccatcatcttcatttcgttcagaaatccgtctgtgctatcggtcacttgatgatattgttctctgttttccaatgctgccacaggcttttccccttccttgtaactcttgggttgtttcagtggaatttgcctttgagggaaaacacacaggtaagtttgcttacttattttcctgttgtgctcaggagttgtgtccaagttttcatattatataaaagcccctgctttttatactttttaaaattgcaaataagaccccacttccatcgtcactgggaagcctgttattgacttactgagtcgtgctgatccaattggcgttagagcaaggcagctgtaatcgggggactacatcaggaactacttaatgaggaggaagacacttttaagtgcgacatggttagattttacaaattcatatgctatggcttgggccaaggtctgtggcatacacctgtagtcccagctactcaggaggctgaggcatgagaatcgcttgaacccagaaggcagagtttgcagtgagacgagatcgtgccactgcactccagcctgggcaacagagcgagaccctgtctcaaaaaaataaataaataaataaataatgaggccgggcgcagtggctcacgcctgtaatcccagcacttcgggaggcgccgacgtgggcagatcacctgaggtcgggagcttgagagcagcctgaccaacatggagaaaccccatcttcattaaaaatacaaaattagctgggcgtggtggtgggtgcctgtaatcccagctactctggaggctgaggcaggagaatcgcttgaacccgggaggcagagcttgcagtgagccaagatcgtgccactgcactccagcctgggtgacagagcgagactccgtctcaaaaaaaaaaaaaaaaaaaaaaaaaaaagaatgagtgctgggctcagccctgtggagtaaccttttctcgtaattgaatgaggtctaaataacgtggccaatttaggttttcacacctgcttggtttcattggtttcatccctccaaagttcagatggtatcatgagagaaacaggttattcgaatctgcactcactatcctgtaccagggcaaaggagaacagaaagcacatggggtactttcccagccggtctttcttctacaagctgccttttaggtgctaggcctttctcatttccttttcaccctctgcctgggacaggaaatggtagagcttgcatagatccaagaacagtgagtcatgccatagggccactctgctacccagaaaaggactgagctgggacccgctgaactttggatgcagttattggagggaacagcagttttttttgttttgttttgtttttttgagacagggtctcgctctcgttcatgctggagtgcagtggtgcgatctcggctcattgcaacctccgccttctgggttcaatcgattctcatgcctcagcttcctaattagctgggactgcaggtgcatgccgccacgcccaactaacttttgtatttttagtagagatggggtttcaccatgtcggccaggctggtcttgaactcccgacttcaagtgatccgctcacctcggcttcccaaagtgctgggattccaggcgtgagttgccacgcccggcctcctgctgtcttaaataatctgcactactgcattattctgtgcacatctctaatacatttacaaggaggggtttttggttaagattttctgggtcttctagtcataattatattataatggcaccagaattttaccattacttgaactaggaacagattcagtatatggaatcaagggaaactttcattttattaattwattwatttatttatttatttgagatagagtcttgctctttctcccaggctggagtgcagtagcatgatctcggctcactgcaacctccgcctcccaggttcaatcgattctcatgcctcagcttcctgagtagctgggactgcaggtgcatgccaccacaccaaactaatttttgtatttttagtagagactgggtttcaccatgttgaccaggctggtcttgaactcccgacttcaagtgatccgctcacctcggcttcccaaagtgctgggattccaggcgtgagccgccacgcccggcctcctgcagtcttaaataatctgcactactgcattattctgtgcacatctctaatacatttacaaggaggggtatttggttaagattttctgggtcttctagtcataattatattataatggcaccagaattttaccattacttgaactaggaacagattcagtatatggaatcaagggaaactttcattttattaatttttgtttgttttgttttgtttttctttgtttgttttttgagacagagtctcgctctttcgcccaggctggggtgcagtagcatgatctcggcttactgcaaactccgcctcctgggttcaagcgattctcctgcctcagccccccgagtagctggaactacaggcacccgccaccatgcccagctaatttttgcatttttagtagagacggggtttcaccatgttaggctggtctcgaactcctgacctcgtgatccacccacctcagcctcccaaagtgctgggattacaggcttgagcctccactgcacctggctattaaaattttttaacttttacttttggagactggggtctcaccttgttacccaggctggacttgaactcctgagctcaagtgatctgcagtagctgggactaagggcatgtgccactgtgcctggcttagggaaacttaatcacttcaggaagcatcgtcgtcctaatagcagagttcaggaggatgcacctaaattgacaattcccaacttcggttgacttgctttgtttttttattagtgggagcaaattttgtaaagtacatgagtaataggtacatttctcatagtgaaatcagtaaaaagtgaaaatttgcctttgtcgcaaccttgcttcattcaatgctcttcctcagaggctgagatgacctggtttaacgtgtatctttccaaacccatattctgagccgggcactttgggaggccgaggtgggtggatcacctgaggtcaggagttcgagaccagcttgcccaacatggtgaaaccctgtctctactaaaaatgcaaaaattagcctggcgttgtggcaggcgcctgtaatcccacctccttgggaggctgaggcaggagaatcgcttgaacacgggagggggatgttgcagtgagccaagattgtgccattgcactacagcctgggtgacagagcaagactctgtctcaaaaaaaagaaaagaaagaaaaccaaaccatattctgtgcatctctaagtatttatatatatttatatctaagtacaaaggttttttttttgaggggggttgcataaataagatggtatcttctgccatttgtgaccgttttcaaggaatgcatgtcagaagctaaatgctgctgctaaatgctgggggtcaggtgggggaatagagggaagggtatcatcttgggctaacataatctttggggaattaatcacaatttgtaaagaagcccttttagctttttccaagagtggaattaaaaactttttgtaattgctctgcagtgccgaagtgctttccagaaagaccgg

SEQ ID NO: 17755 - DNA, 25895 bp, Homo sapiens
gaggctacaaagcaaatgccatctaaggggcagatggaccaaggtcagggcatagaagcaatgtcaagctttaggtccaagagtgatgaccagagtcgtgtaagagatgggacagcaggccaatcaggatttgaggagatagggataagttgggaagttgtgtagggacagaaggaggaagaaagtttcaaatcttgggctccaattagataaggctgggcccaattcttttgggtgtgaaaaatgtgggagagggagtggcagctgtttaaaggcacggagctacacaggtttaacagcaatacacttgacccttgaacaacatgggtttgaactgcatgggtccacttctatgtagattttcttctgcctccacccccgccccccaccccccagacagcaagatcaacctctcttcctcagcctactcaccataaagatgaggaggatgaagacctttatgatgatccacttctgcttaatgaatagtaaatataatttctcttccttgattttcttatttttttcttttctctagcttactttaagaacacaatattcataaaaaatatgtgctaatcaactttgttattgtcttctctgtgatgtacaaactttatgttattgccggtcaacagcaggctattagtggttaagtttttggggagtcaaaagttacagtcagatttcttttcttgtttttttttttttctaaatgttttattggatttttttttttttttgagacaaggtctcactctgttacccaggcaggagtgcagtggcgcgatctcagctcactgcaacctttgcctcccaggctcaagcgattctcctgcctcagtctcctgagtaactgggactgcaggtgcttgccaccatgcctggctaattttttgtttgttttgagatggagtctcgctctgttccccagactggagtgcagagtgcagtggcaggatctcagctcactgcagtctccacctcctgggttcaagtgttttttttgttttgttttttgtttgtttgtttgtttgtttgtttttgacactgagtcccactctgtcgcccaggctggagtgcagtggcgagatctcagctcactgcagcctccgcctcccgggttcaagcgattcttctgcctcagcctcccaagtagctgggactacaggtgcgtgccaccacgcctagctaatttttgtatttttagtaaagacagagtttcaccatattggccaggctggtctccaattcctgacctcatgatccacctgcctcagcctcccaaagtcctgggattataggcgtgagccactgggccctgccaatttttgtatttttagtagagatggggtttcaccatgttggccaggctgatctcgatttcccgacctcagatgatccgcccacctcggcctcccaaagtgttgggattacaggcgtgagccatggtgctgggcatatacgcagatttctgactgtgaagggaccagcacccctgacactgcatcattcaggggtcaactgtacattcatatcccccttactacctactagctctatgtgtgaccttggtcaagtcactgtctttgcttacagcaggaataaagcatttgacttagtagctagcaacatggaggatctgctcaatgatgccgactccctttgccctttatggacgtaatcaactcatgattacctgcgacacatgcccactttatccctttgtttaacagaacacttttgttctgaaccaagctcctcctttcctttccagtagttaatgtgttctttgaggatgcaatctaatcgtaattttgcccgaagtggggaaaaaaattaagctcacattgaaaccttaatatagctctataatcattttctcttttagcctagatcacttcattttggcaatttaagtactacttttggtcctattaacaataccactcttgcaaaggacaggttacaaccaattctcagattcctgcctggataagatttgtgaccccaaattttaaaaaagcagaaaaaaaccccacaaaccacaggcaggaagaaagaaaaacaagagaatgtagctaaggtaattccattaatgatcagtttatgtcaaagcatgtggaaataatgccttataggaggatatttagcaacaacaatttttttaaactcattttctcctgtaggtacagaattgcaagttttttctgacttcaaatgtgtatagctgactgcgtgtgtgtgtgtgtgtgtgtgtgtgtgtgtgtgtgtgtgtgtgtgtgtcagggtctccttctcttgcccagactggagtaaggtgacataatcatagctcattgcagccatgaactcttgggctcaagtgatcctcctgccttcagcctcctggcgtagctaggactgcaggcacatgctaccacacccagctactgttttttggtagagacagagtcttgctatgttgcctaagctggtctcaaactcctggcctcaagcaatcttcccacctcagcctctcaaagagctgggattacaagcatgaaccactgcacctggccccatacctgactacatttctcagcttcctttgtggctaggctgtgctaggtagccttgtacctaaattttgaccagtgagcagcaagtggaatttgttggatgaatctaccacaaaggatccttacaatggagatagtggggccaggcatggtggctcatgcctgtaatcccagcactttgggaggctgaggcaggcagatcacttcagtctaggagttcgagaccagcctggccaacatggtgaaaccccatctccactaaaaatacaaaaattagccaggcatggtggcacgcacctgtaatcccagctactcaggaggctaaggcaggagaatcacttgaactcaggaggtggaggttgcagtgagccgagatcgcaccactgcactccagcccagcaacaaagcaagactcttgattcggaaagaaaaaataaaaaaaggttgggggagacagtgggagcccagacttttgtccttccccttgcctagaagggagatgaggttgctggtgctgtggaagctattatggaccatgaggcagctttgaagacagaaagcctgcatccttgatgactcaatggaatttcatcccaacccaggactgactgccccagatctttgttacatgagggaatacactcttctgtgtttaagaaactgtggttggatctgttactggaatatgaatgcagttaataactggctcaaaatgacttcatctcaacccacattggttgcttcttccaaacaatatataggtctgtactgtggtgggtctcaggatggctgtgatgtagccttaggaagtttatctatgggaaatccatattcatggtgtcctgatgttgcagaggacatcctgagctggctggagtaacttgggacacaggtcaatcgactgtaatctaacttctgaggccattcagtaccctctacagtggccacctaaaaaaaaggcagccaggtgtggtggctcaagcctatatagatcccagaactttggaaggctgaggtgggaggatcacttgagccaaggagtttgaggccagcctgggcaacatgaagaaactctgtttctacaaaaaataaaaaaaattagccaggcatggtggtatgcacctgtagttccagcttcttgggaggctgaggtggaagaatgacatgagcccagcaagtcgctgcaatcagccgtgatcacgccgctgcactccagcctgggcgacaaaaagaaaaagaaaacggagcctgttcactgggtgtggtagacaaggtaaacttttctttacctcccatatcccacaaccttggatgtgctcacagtcatggtagtgttttgtaatgatgtagctgatgacaggtgtgatgttggagattcttctacctgactgctgctatcagtcctaccagcccccaacgtttggtgcttgttctaaagggcatgtcctaggagtcgctttaaactctcaaagtatcactctctatacaaacaagaagtgcaagtaagtagcctgagctcagcctcccaataggaatatttcattatcactagatcaagtctttccattacaatgactgatctgtctctgaatcctgtggattcatccttcaaaatgcccttttcttccagttctcatagctagtgccctaaaagtgacctgcagtacctcctgctgagacgaatgtaccagcttcctaactagcctgcactcccttcatccccccaagtcagtgccagaccaccttgcctgaaaaaccactttcagtgtgtctcacctcagcagaaatgtttctcagcttccaattaacaatcacatcaaacccctgctcttgtctgcgttttaagggtatctataggccgggcgccgtggctcctacctgtaatcccagcactttggaaggccgaggcgggcagatcacttgaggtcaggcgttcgagaccatcctgaccaacatagtgaaaccccgtctctaccaaaaatacaaaaaaaaaaaaaaatagtggggcgtggaggtgcacgcctgtaattccagctactcgggaggctgaggcaggagaatcgcttgaacccgggaggcagaggttccagtgagccgacatcgcgacacagtactccagcctgagcgacagagcgaggctgtgtctcaaaaataaataaataataaattaaaaaaataagagtatctataacctggtcccagcctgaatttcctttttcaccccaacacgtagccctagttacattcttctgacgtctgtaaacaagcccagcccttcctgttgtgaagccaagttcaggtggttcctcttcgcctgactgttttcccattccacttaccggaagcctagtcatccttcggagggctgtacgggggttgcaagaagcaacggaaacggttcagcacctgctaccttccatcatattcttttcaataaaggggcaactcccgccaatggcagtgtagatttcctaacctctacacatggaagattcacaccattcaggattgttgtttaactgttgagagagcacttgatacttaacagcttactaggctacaagacagcgcaggaaagaatcctctgttgtccttttatgttatcctgaacagttggttcacagagttactgtaaacacacaaaacatgactgccagggcttagtagtgaggaaggtgggaactagtcctgactcagttaactgtgcccaggagaagctgcttaacctcaaaggatttcactattactagaatcaataataccaaccctaggggtaaaaataaagataaatgtgtgcaaatcctgcctgcagtctcgggcacgtcgtgggtgtccaagaactgttcttaggcagccggtggggacaaagtctgtgtgcctcctgtcctggaataggtcccaaggtcggcttacttgcaaagcaagggtacggcgcaagagtactgaatacgggttggaagggcgctggctctaccctcagctcataggccggctgggcggcgctgaccagcagctaggccccgtcttccctaggaacggccacgggggccctgggagggtatgaatgtctttttgcagtgaggcctctggaccccgcggccccccggcagcgcaaccaaaactcaggggcaggcgccgcagccgcctagtgcagccagatccccgccggcaccctcaggggcggagccggaggcagggccttcgggccgtaccaactccacgggggcaggggccgcctcccttcggccgcgcgccactcaagtacggcagacaggcagcgaggttgccgaggccgaggctagcctgcagcctcctttctcccgtgccctgggcgcggggtgtacggcaagcgcgggcgggcgggacaggcacgcagggcacccccggggttgggcgcggcgggcgcggggcggggcccgcggggggggggggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcgggtgagaagraaggggacccggtcacggccccaagggcgaaggggctcgcggcgggcagggcctccgcggcaatggcgacagtggccgcaccgggcctggcgggaccggggcacctgcaggcggttctcccgggagtgcccggcgcggcggctggagcggggatccgcagggaggggacgcggggactcgggggacgccgcgcgctgccgttcctcggcagcccagcctgcgtagacggtcccgcggcgctgactgaccgggctgtgctttctcgtcttcagcaccagcaggcagctggctccggytttggggtatctgggctccaggcagaagcacagcctccccgacctgccctacgactacggcgccctggaacctcacatcaacgckcagatcatgcagctgcaccacagcaagcaccacgcggcctacgtgaacaacctgaacgtcaccgaggagaagtaccaggaggcgttggccaagrgtaggttccaggctgagcggcgggaggcagtccccggcagaggcgaccccagggagccaggccccatacggacgggcctctccgtggaggagaactcgcttcgtatttgtaccggttccgagttttccaggcacgatagtctctcttttaaacacatggtctacctcattgtagaaggagtgcctcgatgggtttgaacacacttctgtcatctcagggaacttggggtcctgcgaaggagcttgccttactgttgtgagccacattccgttacacatattgccagcactggtgaattgtagggcctgaaaagaaagctctactgtgtcactcgttttttttgcaaattgaaattgttcttgttgtataatrygctttggggaaatgtttggtctctcaggtaggtgtgccagccgtttgcaggagggctgagagcgcctgtccactggtggccagacatcatcgggtccgcaggtgtctctgagtgtcagggtcacctcctgatagaagtgggagtggtgtcttactgccaggtcacactgaaggtgggagacaggaggacactactccgtgctaggaaccatggtccttgtcatcttcctgagagcaaacggggtcgggactccagcctaggacttggagactccctgcatccccagctaccctgcaggtgaaacttcactgagcccacttgacttcaggtgggagaggaggaggcacaccrttgtggtgtgcgttaccaaaaaagcagtaacctaactgtggaacagttcaggatctttagacttgatacttttcttgatttcccttaggggtcaaagttcacaaggaaaatagccctttagtgggaaactgaaacaggcttgtttttatttactatttactcatatttgtaatgcaattaaaatatatgttgttaactttttttttttttctcaagagctcggttgataaaaccaggggtatgtggactttttgagtctgtgccttttgggggtgtgtatgggaatgttatgttttaacrttttttacaaaatagtattgtctttttaatttattcgttagtggtttgcacaaggaagataatcgatagtcatgttttttagackctctgtattgcttggtaagctacgtagtaaaaaatgtttacttttccttaaatgttttgaatttcggggttatgaaatttgttgagtaatttttagacagtcacatcttgttgactggaggcatctagtggaaaaatgcagtatttcagcctgattgtgtttgaagtaaatgattaaaagaggaggaagttaccacattctggaagatttacttgagacagacgaaccttgaattacgggaaaaggccccgtgatttaggaaataacaaatttgggaaacatgtaatggggagagactggggaataccccagttgtgaaagtacttcctgtaaggcaacatctgacaccaggaacctttctcttcagtattttaaaaacaacttaatttcagtcctttacttgtggaatcagagccttacttatgtaatacaacccactggaaaaaagctttttattgtattgtactatattgtttataagtgattgagtacctgcagagctttcttttacttaaacatattttaaaaattattaaaaagattttcatgtttgaaaacttggggaaaaaarataaaacaatgtcataatctcatcacatttaactgactaatatgaatatttttcaacaaaaagcatttgacttttattattatttgaggcaaaaactaaactgaaaccaaataaaatgttgaatttcagaaaagtgttcttaaaagcagatattaagccctcaatttttattaattttaaaatgagtaagcaaactgtaagatgttaagattattaaattatctctcattaagcatgtatctttcccattttaaaaattcagttactattgatttattaaaaaacaatagaaaagttacatctatttttagagtgactctcaagaaaatttaataagggaaacacagatctataaaaaaactgtttgtaaacctaacaaaggaaaaaaaaagttggtgtctttaaaaaaccctttgagattagctgtgtattcagatatcagttggttctctcctttctgaatcgctaaacaactggagcttgtttcagaaagcagcattgtctacgtatgttccttttaaaaattttttttttaattctrtctaaaaaaaacagacggggtcacactatgttgcccaggctgctcttgaattcctgggctcccctatccacgcacctcggccttccagagtgctgggattacaggtgtgagccaccgtgcctagtcagacatacttttttttttttttttttttttgacggaatctcagtctgtcccgcaggttggagtgcagtgatgtgatctcggctcactacaacctccgtctcctgggttcaagyaattctcctgcctcagcctcctgagtagctgggattacaggcgtacgccaccacgcctggctactttttgtgggttttttagtagagacagggtttttccatgtcgtccaggctggtctggaactcctgacctcaagtgatccgcccatctcggcctccyaaagtgctgggattacaggcgtgagccacctcacctggccttgtatgtatgtttttttctttttctttctttttttttttctgtgacggagtattgccctgtcgcccaggctggastgcagtggcgtgttcttggttcactgcaacctctgcctcctgggttcaagccattctcctgcctcatgctcctgagtagctgggattataggcacgcgccaccatacctggctaatttctgtatttttagtgaagacagggtttcaccatgttggccaggccggtcttgaaatcctgacctgaagagagctgcccgcctcggcttcccaaagtgctgagattacaggcgtgagccaccgcacccggcccagacatatgttcttaacgtacactttcagaacagcagttgagaactttttccaaaatgtaagctccttgagagcaaagctctcagtgggtctctgtgtcctttactttgcttctcttggtatcttgtggataatatgcacaaaatatttattaaacaagaggatttccatttttttctaatattaatagttcatttagtctgtagcttcttgaaggcatagaaaagactattttattttgcctacttatttggcraggtacccatgcagtatgccaggagttacagggcctattgagaaggagtaaagggtctgggaggggtggcagggagttgctaattcatgtatggtggctagagaaggcttcactgatggggttgatgtttcagtggagacttgaaggaggaacaggaacgcagcatgagactgtcttggggaagagtgttcagcagaggcagcagtgctcagctagccttgaggggaacatccaagttggtcatgtgagtgcaaaaaggccagtgaggctgcagctgcgtgagcacgtgctcaatgacggggtcaagtgcagcrcctcttggtagtaagagtagctgagtgtaaacacctagggttcgctccagtgagaaggggagcctttggagggggcaaggcccacccccaccccccaaaactgaggggatagtggcaccagtgcagtgagaaatactggtcctctgtcccaatgaggtggcagtagagttagggagaagggattaggttctgcttgtgttttatttttttcttttatttttctctgtgtgcttttatatagattggatgtattttaaaggtagagctggctttgctaatggatatgctggtggattggatgtggggtgaagggagaggagtcaaaaatgacatcaggttcccaaggatgtcctgagggacagagctggcatttactgagacgtggaggacaataggaggagtaagtttggggtagaacatcaggagttcaattttgagtatgttgagtttcttgttaatgtgacttggagatatttcccaatgaatcgtcgtctgtcttgaaagtgagagttgaaggttttctgtacagtctgtatgttgagccatacattttagcattctattattttgattgtcctctttggtgtttcatttcctaaaatctcttctatctaagagatccctgagcctagcagccaggagtgaattttctagcttttccacctctgctaggtccttcatcagttgttcagcatgtctgggacaaataattttggggcgggggggtgctgaattttaggacaaacggatgttatagataagctggtcccattatctaatagcttacaaagaaaaaaatataatgtatacagtggttgaaaaagtaggagtyacaaaaaaatgtgtttgcattttaacttttcaggagatgttacagcccagatagctcttcagcctgcactgaagttcaatggtggtggtcatatcaatcatagcattttctggacaaacctcagccctaacggtggtggagaacccaaaggttggtatatattggtgcacccttatctacattttgtgcacagtaggaatcgattgttgatttactgaagttaccttatacttgttttttgttttttttgttgttgwttttttgagacaagagttttgctcttgttgcccaggctggagtacagtggcgcagtcttggctcactgcaacctccgcttcctgggttcaagtgattctcctgcctcagcctcccaagtagctgggattacaggcgcccgccaccacgcctggctaatttttgcatttttagtagagatgaggtttcattcaccatgttggccaggctggtcttgaactcctgacctcatgatctgcccaccttggcctcccaaagtgctgggattacaggcatgagccaccgtgcctggcctaagttaccttattcttaccagaggtatcatagtggcatatttttcataacaacgagtatgataaaagttgtaactttcaaaaggacacaagtaggaatggagaatgctttcatggggttatgtcataagattttatgttcacgccaacatagaatatcacatcaactccaccttctggtttctggatggtacttcatattagggaaagactgagagacttcattttatgaactttttttttttgagacggagtcttacagtcgcccaggctggagcgcagtggtgcaatgtcggctcattgcaacctccgcctttcaggttcatgcaattctcgtgtctcagccacccaagtagctgggattacaggcatgtggcatcactcccggctaatttttatatttttggtagagacagggtttcaccatgttggcggggctggtctcgaactcctggcctcaagtgatccacccaccttggcctcccaaagtgctgtggtatggatgtgagccaccgcgccagtctagaaaagatgaactttctgtctactagtttctagggcctggattagatagttaaccgtctgtaccttttttcatctatgtgatacagggataacaatggtgttgttttgagaattaaattatagtgtcatttgctatttttcactctttcctaactgataaaaagtcagttgttccaggaaattaggttttctgggtatttttaaaaagtgttcagggaatgaggagagtacagggctagatggtcttgttcgctatcactgtttccttgacttcctgtgtagcttgtggaggcccagatgactttaattatcttcttcacccagggagggcatgaggcgtaaatgtagttcttgtctcttgtttctgggctccggatatgcaccctaagtttctgtggttttattgttcatttttaatcagtgttatggaaggcagcctatcttatgcacttgaaataagcaatttcattttaaggtaatgatgaatgaggagagtaagcttgggaaactgggcaactttttctttatttttgtttttatttattattattttggagatggagtttagctctttcgcccaggctacagtgaagtggcttgatcttggctcactgcagcctctgcccatcccgggttcaagtgattctctgcctcagcctcccgagtagctgggattataggtgcctgccaccatgcccggctaatttttttgtatttttagtagagaggagtttctccatgttggtcaggctggttttgaactcctgacctcaggtgatccacctgtcttggcctcccaaagtactaagattacaggtgtgagccaccgtgcctggccaacttattttttttctgagttcagtcttctagactatcggttaatacttttgaagttttgtcagttaccagaatatcagatatattcatatgcaaccagtggttttggtatgctgccatttttgtttaatctgtaccacattccatcatttgtgcttataaagatgattacttttaaacccgtagaataagagaagtgagattttgacccagttgatttagttgatgtgactaatctagaattatattctgtattactacagaataaaaggattacagctcttaaagtatacccttagttcagtcrtagagaaaactgcccatcaagacaggaagagctgggctgccttggagaagaacaatgactttattcccaaatggaggcgtagaagaaggagggtagaagtcaaaggaaaattttctattcagggaaaagaaaaagctaacagaaagtagtatttctttcctaacaaagatagtacagtgagtggggaaatccctctaacacgattcattaaaaaatgtgaactacgcagctggaggccattatcctaagcgaattaacccaggaacagaaaaccaaataccacatgtctcacttgcaagtggaagctaaacatggagtacttatggatataaaaatggcagcaacagacactgaggacagagcagggagggagaaagaagggggggggtgaaaactgttgtatactaagctcgctacctgggtgatggcatcaattgcaccccagacctcagcatcatatgatacccgtgtaacaaacctgtgcgtgtaccctctgaatttaaaataaaatttgaaccgggcacggtggctcacgcctgtattcccagcactttgggaggccaaggcgggtggatcacctgaggttgggagtttgagaccagcctgaccaacatggagaaacccgtctctactaaaaacacaaaattagccgggcgtgatggcacgtgcctgtaatcgcagctgctcgggaggctaaggcaggagaattgcttgaacctgggaggcagaggttgcagtgacccgagatcatggcattgcactccagcctgggcaacaagagtgaaactccgtctcaaaaggtaaaaaatgaaaaaaaaaaaaaaaaaaaaaaaaagttgaagttataaaaawcaaaaacgtgaattaaaattgtgaaacttagatccaggtgtcgcattctgatgttgtctaatttcttgggccctatgacaaaaatattttaatacatgtaatataacattttactgtaattattgaaatctgttcatttgtgggtggttttggattttttttttaataggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggttagatttaaaaattgtgatttcatttgggagagatgctctactgtaaagcattcaactagaaataaggaaaactaacagtgttttaagaacatgtaataatttgcaaatcttaacagataacacccagagtcttgtgtaagtaaaaatgttttagaagtcctgatatttcataaaattaagtacacgtaattttataggtacattaacaaacatgttttatttttatttattttttttgagacagatctcactgttgcccaggctggagtgcagtggtgcgatctcggttcactgcaacctccgcctcctgggttcaagtgattctcctgcctcagcctcccaaatagctgggattacaggcacataccaccatgcccagctaatttttgtgtttttagtacagacagggtttcaccatgttggccaggctggtcttraactcctgacctcaggtatctgcctgcctcggcctcctgaagtgctgggattacaggcatgagccaccatgcccagccaaatgttttacttattaaccctgcttcattctacagagaattaatatcagcttagataattatatgtactaaaataaaaaaaaaattagctatagaacaagagtgaggaaaagaaatacaagcagagactgatttcagagcttgtactgttacctcctctgctgagcatttgaggttaaactgggactagatctcaggtttccagaccttctgcctttctggggctctttggtagagtatatgaaaatattcggcttggaagtgccaggctgggctcaccaaatactttgctgttgagcctaattggatttaaaaaatgtcactgaagagtatgggaaatagagccatgagttgtctggcagagggttgggactttgaacttaaagtgataccttcacatcaacaacagtcattctctgccccttcttctacccctgacattggaatactcttgatctgtggctcacttcacaggatagacccagattttggcagaatctgaacagctcttttgggacagtgamatggcrtaacaatttgtaaaagccacaaaaaatttgtaagcaccgatctgtagagtcaggttatttgtagagctgcatgaccagaaaggctgatatttgtaagtgagtcccagctacactccttcctctccctgtggaaagcacattagaaggaaaatgagggaatgtcatggccttttgtttataaaaatcattaataaattttgctacttgaaattattaataataaattactagtgacctccctcacaactgatcaagacatactggttaagaattgtttttgtagagagagctataatttattttgagtgtttttgtgtgtgcgtgatggagtctcactctgttgcccaggctggagtgcagtggcgcaatcttggctcactacaacttccgcctcccaggttcaagcaattctcctgcgtcagcttcctgagtagctgggattacaggcgcctgccacctcgccaggctaattttttgtatttttagtagaggcggggtttcaccatgttggccaggctggtctcgaacgcctgacctcaagagatctgcctgcctcggcctcccaaagtgctgggattacaggcctgagccactgcgcccagaccaaaagtttttttaaatggatgttttacagatagaactaaattcttcatttacctcacttaatttctgaaaacactgtgtcctccaactgctctgtattcccaaagattaaaattagccttggggagcagagctggttcctcgtaaacccctgtgagtgcccagaccctttggaggaggttctcagtgggcttttgcctgctcccacagatgtaacccacccttcctgctgctcctaagaccaccatgaggaaggctgggaattggctcttgaattaatttgttggtatttttaagaatagctattaaagtactgttgttaattttcccaagtctattttattgttagtatttgtcacattttctttgtaaacagtgaattaaaaatattttataggaatattcattcttatctagatttcctacttatataaaaaaacaagtgaatgagattgttacaaagggtaattttgtgtgagtagaataataaaagttgaaattgagaagatgcaatgttttagactgaaactgatggttggtttgttttccccttctttctaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgytgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttsgggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgttttttttttttctttttttttggagacagagtcttgctctgttgcccaggctggagtgcagtggcgcgacyggagctcactgcaacctccacttcccgggttcaagtgattgtcccacctcagcctcctgaatagctgggattayaggtgcatgctaccatgcctggctactttttgtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaamatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattaytgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatacwgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaagaggtctgcattatgcttgcatgtcaaaaacattaaaaatcctataatcttctgtcattttcactgagtttccatgggaaaggaatagtaaataatgggtagttgaaatattactcttaagaccaagacctgtatctccagtcatatctgtaataacatcatctgataacctaaaagcatagtattagggatatacgacaaaaccaaagtgtttttgctgttgtcacataccactcaatacttttacaccaggttgtccagtggacaccagctggatgtcctataattcaattctgacactgtctacctggaattggagtcagatcccacaggtggagggctcagcccacaagactgcccccactccagataccaatcgcaagtccctatacttctgactggctataaagtggggttcccgtgaccctttccttggttttgatttatttgctagagcagctcccagaacacagagaaacactctacttatgtttacccatttttaattttattactttattaaaactacatattggttacaatactaatttattgtaaaggatatttcatttatttatttttttatttagagatggagtctcactgtgtcacccaggctggagtgcggtggcacagtctcaactcactgcaacctccacctcctgagttcaagcgattctcatgcctcagcctcccaagtagctgggattacaagtgtgcaccaccatgcccagctaatttttgtatttttagtagagatggggtttcactctgttggccaggctggtctcaaactcctgacctcaagtcatccacccacctcagcctcccaaagtgctgagattacaggtgtgagccattgcctctggcttgtaaaggatatttcaaagaatacagatgaacagccagatggaagagatgcacagggcaaggcatgtgggaaggggtatggagctttcatgctctctccacgtcatcagctacccagaagctcatctggaccccgaccctttggggttttacggaggcttcattatgtcagcattaccattggcaattggcgattaactcaaccttcagcctctctcccctttctggaggttgggggttgaggctgggagtccaaaccctccaatcttgccttggtctttctggtaagcagccccccgtcctgaagctacctagaggctcccagccaccaatcatttcattggcaaaccaaagatacttcaaggggtttaggagccaagagaccaagcaaggattgagacaatatatatatttcttataaataacatgatcacaaatagtattttatatatttctcataatagctggttgtggttactcacacctatcatcccagctactaagaagctaaggcaggaggatcacaggcccaggagtttgcagctgtagtgagctatgattgtgctactgcactccagcctgggtgacagtgtgagaccctgtctcttaaagttcttgtaacatcttagaacattaaccaaccacagattattgccttaactctgaaaaataaagtaatcatacttttacaagatgtattttacataaagttctggtgatattttactctggtcattggaatataggagcttaccacctggtaccactcttcctaaagtggtatactatttggtatagtactggcatactatttggaaagggatgtgaagttggcatgacctgtctagggtgaagtcatgctgtctgctattcattgtgggctttacagtaatgagagtgcttctgttgtcaagatgcttctgggacacgttaaaaaaaatttaagatttctcagtttgtgaaaaggaaggagcacgaatgctttcaagttcctatgacatgctagtcatctttcagtgtgtcccattgttgcacccagtagtctcgatgcccagygtcacggtgattccaagtttgcctctctgcccactataatttgtgctccatgaagtcccaggacatgaggttcttgttcatttgtgcgtctgggcccatatccaaatattaaacaatgtgacttaatgtatttatcatattgtaaatatgggtatccccaaggctcagaagttaacacagcatatccacagagaggtttgacagcatggctgtggtgactgggaaggccttatgcttgctcctccttctgctgcttgcctttgtgtgggcatggaaagaacattgaattaggtactggaagacctgggtcctggtcttggagattttaccagagcacctgtgggatattggtcaagatgcctggttttagtcctgctcctttgctgtgaaagaggatcttaaggtgccaactctggcattttattttttatttatttatttttaaattatactttaagttctagggtacatgtgtacaacatgcaggtttgttacatgtatacatgtgccatgttggtgtgctgcacctattaactcgtcatttacattaggtatatctcctaatgctatccctcccccttctccccacccctcgacaggccccggtgtgtgatgttccccttcctgtgtccaagtgttctcattgttcaattcccatctatgagtgagaacatgcggtgtttgtttttttgtccttggaatagtttgctgagaaggatggtttccagcttcatccatgtccctataaaggacatgaactcttccttttttatggctgcatagtattccatggtgtatatgtgccacatcttcttaaaccaatctatcattgatggacatttgggttggttccaagtctttgctattgtgaacagtgccacaataaatatacgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaccagtgtaaaagtgttcctatttctccacatcctctccagcacctgttgtttcctgactttttaatgattgacattctaactggtgtgagatggtatctcattgtggttttgatttgcatttctctgatggcccatgatgatgagcatttttttcatgtgtctgttggatgcatggatgtcttcttttgagaagtgtctcttcatatccttcacctactttttgatggggtttgtttttttcttgtaagtttgtttgagttccttgtagattctggatattagccctttgtcagatgagtagattgcaaaaattttctcccattttgtaggttgcctgttcactctgatggtagtttcttttgctgtgcagaagctcttgagtttaatgagatcccatttgtcaattttggcttctgttgccattgcttttggtgttttagacatgaagtccttgcccatgcctgtgtcctgaatggtactgcctaggttttcttctagggtttttatggttttaggtctaacatttaagtctttaatccatcttgaattaatttttgtataaggtgtaaggaagggatccagtttcagctttctacatgtggctagccagttttcccagcaccatttattaaatagggaatcctttccccatttcttgtttttgtcaggtttctcaaagatcagatagttgtagatgtgtggtattatttctgagggctctgttctgttccattggtctatatctctgttttggtactagtaccatgctgttttggttactgcagccttgtagtatagtttgaaatcaggtagcgtgatgcctccagctttgttcttttggcttaggatcgttttggcaatgcaggctcttttttggttccacatgaactttaaagtagttttttccaattctatgaagaaagtcatgggtagcttgatggggatggcattgaatctataaattaccttgggcagtatagccattttcacgatattgattcttcctatccatgagcatggaatgttcttccatttgtttgtgtcctcttttatttccttgagcagtggtttgtagttctccttgaagaggtccttcacatcccttgtaagttggattcctaggtattttattctctttgaggcagttgtgaatgggagttcactcatgatttggctctctgtttgtctgttgttggtgtataagaatgcttgtgatttttgcacattgattttgtatcctgagattttgctgaagttgcttatcaaattaaggagattttgggctgagatgatggggttttctaaatataaaatcatgtcatctgcaaacagggacaatttgacttcctcttttccttattgaataccctttatttctttctcctgcctgatggccctggccagaacttccaacactatgttgaataggagtggtgagagagggcatccctgtcttgtgccagttttcaaagggaatgcttccagtttttgcccattcagtctgatattggctgtgggtttgtcatagatagctcttattattttgagatatgtcccatcaatacctaattcattgagagtttttagcatgaagggctgttgaattttgtccaaggccttttctgcatctgttgagataatcatgtggtttttgtctttggttctgtttatatgctggattacttttattgatttgtgtatgttgaaccagccttgcatcccagggatgaagcccacttgatcatggtggataagctttttgatatgctgctggattcagtttgccagtattttattgaggatttttgcattgattttcatcagggatattggtctaaagttctctttttttgttatgtctctgccaggctttggtatcaggatgatgctggcttcataaaatgagttagggaggattccctctttttctattgattggaatagtttcagaaggaatggtaccagctcttccttgtacctctggtagaattcggctgtgaatccatcttgtcctggactttttttggttggtaggctattaattattgcctcaatttcagagcctgttattggtctattcagggattaaacttcttcctggtttagttttgagagggtgtatgtgtccaggaatttatctatttcttctagattttctagtttatttgcatagaggtgtttatagtattctctgtgtactctgtatttctgtgggattggtggtgatatccactttatcattttttattgcatttatttgattcttctctcttttcttgtttattagtcttgctagcggtctatcaattgtgtttatcttttcaaaaaaccagctcctggattcattcattttttgaaggtttttttgtgtctctgtctccttcagttctgctctgatcttagttatttcttgtcttctgctagctgttgaatgtgtttgctcttgcttctctaatatttttaattgtgatgttagagtgtcaattttagatctttcctgctttctcttgtgggcacttagtgctgtaaatttccctctacacactgctttaaatgtgtcccagagattctggtatgttgtgtctttgttctcgttggtttcaaagaacatctttatttctgccttcattttgttatgtacccagtagtcattcaggagcaggttgttcagtttccatgtagctgagtggttttgagtgagtttcttaatcctgagttc

SEQ ID NO: 17756 - DNA, 36255 bp, Homo sapiens
  misc_feature (1)...(36255): n = A,T,C or G, or insertion/deletion polymorphism (see Tables 1-2)
atagatagaaagaaagaaaaagaagggaggaagggaaagagggagggagatgtgacctggacttcaaatataaggaagcacaggaagacagaggcactaggggaaggcagggccagggagcgggaggccaggccaacaggaggttatgtgggggccaccatgggaaagccaggtttcccttcttgaggggagtggaagagaggtactgatgacacaaggattcctctcccagcagagtgggaacccacaaaggcaagtgaagtttaggtggggtagaaaggaaagaactttctgaacatgaggttagggccaagtgcgtggggagaggtctgtccctgaggaaatagggggacaggagctggggagctcagaagctcaagaccagcctggaaacagggggacagggcagggagctgcatgtggagaagaaggtcccacaagggtaaggggccttgagtcctcaggacatttttgccagagcaggtgctcaggttagaggcccaagacgttcctggtggaagggcctacagccaacggaactctgtggttgggttcaagttaaagccaggggcaatcccgggggacagcagtttgcagtagggagggaaggggctgtcctgggccaatggatgatggggctggcttcacacaagctagcagaggcccctcttcctccctcgcctgctgctgtcacaggtctgctgactcagctgactcgggacagctgtgatgggtgatgaagggctgacagagcgagggacagatggctccctaggagaggcctctgccccatccctccctggtgcacaatcatttcttgccacagtttcagagctttgtgagagaccatccctctgtctcccctggcagtgggtagaaagtctggtgtgtagtttgttggccaggtgcagtggctcacacctctaaccccagcactttgggaggtcaaggcaggtggatctgttgaggtcaggagtttgagaccagcctggccaacatggtaaaaccccatctctactaaaaatacaaaaaattaaccgggtgtgatagcacacgcctataatcccacttacacgggaggctgagacaggagaatcacttgaacctgggaggtgggagttgcagtgagccgaaattgtgccattgcactccagcctgggcgacagagtgagcagagtgagacttcgtctcaaaaaacaaaacaaaacaaaacaaaaacaacaacaacaacaacaaaaaaaacaggccgggtgcaggggctcacgcctgtagtcccatcactttgggaggccaaggcaggcggattacctgaggtcaggagttcgagaccagcctggccaacatggcgaaaccctgtctctactaaaaatacaaaaattagccagacgtggtggcacgcgcctgtaatcctagctactagggaggctgaggcaggagaactgcttgaacctaggaggtgcaggttgcagtgagccgagatcgtgccattgcactccagcctgggtgacaagagtgaaacaccatctcaaaacaaaacaaaacaaacaaacaaaagtctggtgtgtagtttgtctctgtttttccggaaggcattccactagttcttctcaggttctcctagggttaggctgggagctgaaagttgaggttggttttccccagcctctagggcacagtgtcccagacagcagcatcctcttccctctgtcccacccaggtggtgtgcctctgtcccactcacctgtcctgccctgccctgttccggaacctttgctcgtagtatctctggttgtgtcacggctctgcctaaaacccttgagtgactcctcatggctccttgaacagaaaccaaatgcttcttgatgcctggaaagatcaggcccctcctacctccccatccccagtccctccattgtttcccagggactccctcacactcaccttctctctctgctcctccaatgtgactgaggcccaggcagaccattctgtgtcctgttgacttaaggaaattttagtggaatttctagatatttactcaatctttacagaatatgacaaagagagagagcattctttttaatttttttaatttaaaaacagatatggggtctcactatgttgtccaggctggtcttgaacttctgggctcaagcaatcctcctgcctcagcctcccaaagtgttgggatcacaggtgtgagccactgcactcgaccaagagggcattcttaatatgcagcacaacagtaaaaagaaaaaaaaaagaaagaaagaaaaaaggactcttctatatgtatatcatacttcaaaaaatgttacccccaaaatggcaatatcctcttcacagatgtccccgtctcccagagcccagccctctcccttccaccttggctctttatcctgcactcagccacagtctctttagctgtctttcagcttgatccattcccccgctgcccagattctgcccccaagagagcccaggaggtgaccaagtacacaggatacacaggtgaggttgggtgtgggggagagtggttgcaaacacagtgtgacatggcttctttccaccctttctaatctccaccaggcccttcttatctggagtgtacatttgctattcctcctctggaacatcctggcccctttcctccctcctcctgcaggccccagcttaggtgacccttcctcagcagtggaggtcccagaccaggacagtctcctaccccgctctctgagctcccaccataattaaacctacaggtttatttcacagctagactgtaaactcccacactcgactgcacgctatgtaaatgggcagccactgtgtctgctaggttcacggccaaattccaagtgccgggcccacagtctggcacacagcaggctctcaatcaatatttgttgtagctgctattcaaaccttactcattctttacaggttgcgcaaagcctgcctctctgcaaacatctttggtctctcttctctgaaaggcccgtgtcttgcccatttcctgtccatatgtcttcgactaccgggcctaggctgaggcacaatcccccgaggtcccggctgtttatctgctgaaaacctttttccccagcgcagatggatcaccaaggactccctcacactcactttctctggttctctggatacctctggccgaccttccccaccccactgggtcctttcctcaatttgccttccttagcgggagcggccggcgtctgttcctcccctacactctccctcctccaccaaatgtaacatggccctgcttaggcttccttcttcagcacagagcctgggagccaagcttctcctgttcccagctggtcttctaccctccccgttaggagagactggacacagtggctccccgacgtctccaaccccacctccttccttgatgggcctggagggccctgagatcaccctccctcccttttaccaacagaaaagccgaggccagagaagaatggatgctggccaaggccatatgatgtacacagagccaaagccacagtcccctcaccccgtcccgggccactgtggggacctaagcagtcgttccacgggagagggcgacccctggtggtgaggaggggcatggcagcctgtcgctcatttcctgggcccggaggctgacggtggaaggggcgtggcctggaggaccaccgacccaggctttagttatcaggaaggtaaatgaaggcaaggcccgcagagcgaaagaacgtgggaagttaggacaagttttgctgggctttgcccttccttagccacattccctgtaatgacctaacaacactgctctgtgactttaactgcaccctgctgattgctggttggatcttcagggagcaggaatgggcattcaacagcttttggcacactgcatgtcccaagggtcattactgacttgagggtctggtgcgaagccctggaatgcagaaactcacattctgataataagatttctaataataagagaatgggctcagtccgggcacggtggctcatgcctgtaatcccggcactttgggaggccaaggtgggctgatcacctgaggtcaggagttcgagaccagcctggccaacatggtgaaaccccgtctctactaaaaatacgaaaattagccaggcgtggtagtgtgcgcctgtgatcccataatcccagctactgaggctgaggcaggctgaggcaggagaaccgcttaagcccgggaggcagaggttgcagtggaccgagattgcgccactgcactccagcctgggagacagagcgagactctgtctcaggaaacaaacaaacaaacaaacaaacaaaacagaacgggctcttattaaagagtccagggactgagtcaatagctgtctccaagtttctatggtacctatctctcctctctaggggcaaaagggctactcaacaaaaggctgattgttttaacagaaacactcagaaaaccaaacctttgagaacttcccaggcagaaataggcatgcttagagaccacgcgaccagttaatatgaaccccacatctgctatcaagagaatctgggcaatctactttgaatatcccttttggagctgtttctaggtgtttagagatcaaatgaaatatttctaggaagtagctcgcctcgaactaaccacacaagaatgaaatctcactgacttacaaggtcatggctaaaccttcattgactaggtattttcctccttccttgatgatccagtatgtagcagtatatgcccagatcaggaagtgtaaaagctgaaaatggagttggagacagaaagtccaatgtgttgctggccactgtggtgtcactgctcccgatacaggtgtaacctgagtctcccgcttgggagccagaaatcagctgagaagaggcctctggaaagaggctgccctggcccagaagggtggatgaagtagggcctcagcacagctcatcctaccgagcaggccggaccctgagttcctggcttgcactgaagggtctgggtaagtcccttctgtagcgcctcagaagctccttgggcaacctgggaagttaggacaagagctctgacatttgaccctgaggtgtgaggagagtgctttgagagagaggatgctgaatgcgagcgccctggttattacctcctggcagcctcctaacctcaccttgactctgccatgtaaaattgatgcctgggcgcagggcgccgacgatggtcagataccgcggcctgcacaccctgggacctacatccctgacctggaggacccaggccttccccgggcttcaccacgagtcctgccggccacacagggaccctaacagacctagtccagtctcagggtctgggctgctcctccttccaggaatgggagtttgctctaggcgatggaggaagggttcaggaggccactctgcctgcttagcaggctgtgggcccaaccccccacccaccatcttcatctcccacggccccaacctcgtagggagggcagggcggggctcaggttcgcagagaaggagggctcggaccagcgactccagggcagaggggcgcgtgcaggggtggggagctgggtttgcgaggagagaaggccatctcttccccagcagggtagcccccacctagctaccgggatcccaccctggctggcgcaatctttgcgtccggatcagcacccaaggccccgcccaacggcccgctgcctgccgggatttgtagtttgtaggggaggggccaaaaggcgcgcgcgcgcgcgtgtgtgtgtgtgcgtgtgtgactgtgtgtttgtgagactgtgtgtgtaagtgtgtccgggggtctgttgtggtgctcccgtccccgagggccctccggacctgggctcagcaaaggcaccacaggccgcagcttccgagaccccgccccgcggcccactgcctgctgggatttgtagttcttaggggtctagggcccaggctggggccgggttggggccttacacgcgtcctggcgtgtggctctcctgcgtcctcgtttttctcgtgagccctggatctggacagtgggcccggcgcgaggccctcaactccggctgggctcccggtggcactttctgccgaccctgagatgtacccgccacgcctgcgggactgacctctaggtgggcaaaccgaggcacaaagaggggcgcgctctggccggagtcggccctcttgtgagaatttgggctgggagacccagcccaggcctggcaggcaaggctgggtcaggcgagggtcctgggccctttcggtgtaagagtgtgcaaaataatgaacaggcctgcccaggactggctctgcacattagcgctagttaccttacaggcttgactgatcagatttttatttggcaccactacagaggggagcccagggagggaggaagtctctcgtgaccaagaaaacctatggtccaccctggcctacaactctgctttaacgacaaaaataaaccgagtttgggagggggtgaggaggaggggtgttttgtaaactgtgaagtccaggttatgagtgaggtgttattatcatcaggatcagacctcaaagcactggaggaaaggtctgggccttcaagagcctcacctcaaaagggagggtatggccgggcgcagtggctcacgcctgtaatcctagcattttgggaggctgaggcaagcagatcacctgaggtcaggggttcaagaccagcctggccaacatgtcgaaaccccatctctactaaaaatagaaaaaattacccgggcgtggtggcacgtgcctgtaatcccagctactcgggaggctgaggcaggagaattgcttgaactcaggaggcggagtttgcagtgagccgagatggtgccactgcactccagcctgggcaacagagccagactctgtctcaaaaaaaaaaaaaaaaaaaaaaagagctgagatagctgtttgcatgtgaaaggactcacaactggcactagcatgcggtgatagtggggagggcatggactcccactacatggctcccatctatcctctgccgcttactaagtgggacctagaacaagtgattttgacctactttatctctctttatctctgtttcctcatctgtcaaaggaggataataagaggatccatgttagagagtaaatgcaaggattaaatgagaaaatcatatcaaggatagcacctggcatatagtggcagcacacaatagtgttagctgttatggtgttgagtacccagtgtgacgctggctgtacaggggtaaacttgtcttctgggggactagtccccccatcccaggcacctggtgccctccccaggccactcatgctgtactggacagtcccactttcccaagaagtcacaaggaattccagcatgtcactgttctggttgcccctgagcacctagcagtgatttaagaaaaggcaaaaccaaagttttggttttgagctttattcggaaaatatggccacccagacccctggccattccccagggcctgtgaggtgatccagaaaaattcatttgcaaatcaaatttaatggctagaagcatcctgaatcaatgtcttcaaataaatatttggggccggtgaggtggctcacacctgtaatcccaacactttgggaggccgaggcaggcagatcacctgaggtcaggagttcgagactagcctggccgaaatgatgaaaccctgtctctactaaaaatacaaaaaaattagctggcatagtggcgtgcgcctgtagtcccagatattcgggaggctgaggcaggagaatcacttgaaccggcgggggggaaggttgcagtgagctgagattgtgccattgcactccagcttgggcgacaagagtgagactctgtctcgaaaaaagaaaaaaaaaggaatatttgggggaattttgatgttagaattgagcattgcaaaagatccctgtcagtcccccgtgatgaggaaatgcaactgctcagcctgagctgtgcctctcggttggagttagaggagccagaagggacccttcgagtctagtgctttcattcacagatgggaaactgaggcccagagagggccacatggcagggtagttagaagacaggtcgagaacttgctaggaagaatcttttgcaatttcagaacttctcagcactggaaatgagtccataccccgagtttatgggcacagaagcagaaagctgattgtcctggacatccccagaccttggccagagtccaagcagctaagcccagaagccagtgtccagtgcttctctctcctgggtttcttcagccaggtgttcatcctagaagtaggagtttattaataatggtgatggtatcttgcattgtccaggccttcattctttttgcggatcctcccggctgggcacagtggctcactcctgtaatcccagcactttgggaggccgaggaaggaggatcacttgagctcaggagttcaaggctgcagggagctatgatcatgccactgcactccagagcctaggtgacagagtgagaccctgtctcttaaaaaaaaagaaaaaagaaaaaaagcagcctttcattgaatcctcacaaccttccaaggtaggaggactggggcttctgttctcgtttcacagatgaggaatctgtggctaggaagtcttaagggattatcccgaggcaacagaatctgggcagtattagaatgtgggggttttgctgtctaatctgttaatgcattcagtaaaaatttttttgagtgcctattacctgctgggcgctatgcagggtgctgggattgcaaggatgacttgacacggtccctggctagaggtgctaacattatggtggaggaagcacatggtggggagggaactttctggtgtgatagaagtgttttatatcttggtagggatgtgggttacatgggtgttgcatctgtcaaaactgatttaaatgtacacatgatttgtgcatttcactataaatttgacctaagcaaaacaaaacaaaaactgaatgctctggaaggactatgcctgggcacaaccttggagaggcctagttgtctggaagcaggccaggttgcccatggatccaaatccacttttgctatcgggtgtgcctgagaagtgttcccatgggcgtgtagatgcaggtggcccagtggcttgatgtccagaatacctggggagcactgcagagggagtttcagaggagggatatttaagctgagtctgcagagtgagcagagttggtcaaaggaaggcagatagtaggcagcgggaggtggtttccgaggactccttgctggagtgtgcttgtctgaggtcacccagatagaaagattgtttccttaccccaggccccacccatggacttcagagaaactcattctggttgggattttcgaagctgcctcccacaaaaggatcttaccactgtgtcacaaggccatggcctgatcctcatgctctttgtcaactgacatctctcatgggttggctatgccacattcaggagccaaggcggaagtgtggacccatcgctgtccaacacatttccagaaggcctggcctcctggtgcagatgcttgctggcctgttttcctctgaataaagaagagaagggtcaggtgttgcaggtcagatcagcctgggttagaatcctggttcagcagttgggtgcggtggctcatgcctataatgccagcactttgggaggccaaagcaggaggatcacttgagcccaggagtttgagaccaacctgggcaatagagtgagacacagtctctccaaaaaaaaaaaaaagtttagctgggcgtggtggcatatgcctgcagtcccagctactcaggaggctgaggctggaggattgcttgagcctgggaggttgaggctgtagtgagctgtgatcacagcaccgcactccaggtgccgcgacagagtgagaccctgtctcaaaaaaaaaaaaaaaatcttagttctgctactgaactagcaatgtgacactctggacaagttagttaccctctctgagcctcccaaagacttcatgtttccagcaggaataatgatagtagatgtgaggacgcaccaagcacatagtaggctctcacagaacagtagctgttcacagggtgattgaggccgggggcctaacgattgaatggaagtgaacactgcaattctctcgcaaagtttacagcacagtaagcttgtccttagcttcccctataccctccttcccacgcccaattctaggaccctttcgggcgccccagcctcccayaggggctccccgccagctcagaccggccgggcccctccctctgactcaccggrggcggctcctggccgcgcacctccagggggcggggggcggctgagacagcgcccagggcctcggagcaaggcgttggcaggcaagtagtgcgcttcggggtccggtcgccggggacctgggctccccatgtaggggtcgaacgggcttagccggttcgggggcgccccgctccctcctcttctcccacagccggggtcctctcttaggggcgcgccgtctcctggcttcctgtaagaaaaggcgggagagggtgggtccgtgctaaagaaatactttattttacttcatttgggacaaactaagcagtagtgctcaggggagaccacaagggtaggaacactgtgcgtctggtaaaaaaactagttctagagcgtcgttaccagataactcattagcatgtgcattgagttcctagccgctcccgagagtcctaggctgagcgaccggcccttttgtttcgctgttgttgttgtttgttttttgagacggagttttgtttttattgcccaggctggagtgcagtggcgagatctcggctcaccgcaacctccgcctcccgggttcaagcgattctcctgccttagcctcccgagtagctgagattataggcgcccgccaccacgcccagctaatttttgtattattagtagagatggggtttcgccacgttggtcaggctggtctcgaacttctgacctcaggtgatccgcccgccacggcctcccagagtgttgggattacaggcgtgagccactgcgcccagccagttgtttcgctgttaatgtgtaaacctctccccttttttcctgtggtgataggagaggctttagcctagacagctgagtgtgaggaacagtgattcccattgatccttgttccctccgtgggtcacagagtccagaacttaagagccacccaaggtatgcgctgttgtgaccaaaatctatgaagctttccagcgctggggctggggatggaaataggagagtgctctgtggtttaactttctttcctcctgtggagaaaccgggagctaggggagtggccaggcacatttctacctcaggtgctgatggcacattgcaaactaaagggaagagaaagaagtctgggtttatcgagcatgtattatttgctcattaatcataggatctcatttcatcttcacatttaactgtatgcacgtgttacagattggggcacagggaggctccaggaggttaagtcacttgcacagctagtaaggagccaaattgtctagctcttatcactctaccaggttaaccgcccagcctgtggttttgtggggactaggccctactgggattctcacccagactatccttttttttcttttttaaacttttaagttcaggggtacatgtgcatgtttgttatataggtaaactcgtgtcatggggctttgttgtacagattattttgtctccccggtattaagcctagtacccattagttattttcctgaatctctccctcctcccaccctccaccaaactaccctattattattgttattattattattttttgagactgagtcttgcccagtcacccaggctggagtgcaatggcgcaatctcggctcactgcaacctctgcctcccgggttcaagcgattctcctgcctcagcctcctgaatagctgagattacaggcatgcgccaccacccccggctaattttttgtgtctttagtagagatggcggtttaaccatgctggccaggctggtctcgaactcctgacctcatgatccacccgccttggcctcccaaagtgctgggattacaggcgtgagccaccgcgcccggcccatattaccctatttttaagcctggcagtttggccatggagacacttggatgctagctacaggccatgttctttggggagaagatttaacttcccgtcttgctctagtgaaattttatcaatttcgtttcaatgagaaacattcatccagtattgctttttttttttttgagatggagtcttgctttgtctcccaggctggagtgcagtggcgccatctcggctctctgcagcctccgcctcctgggttcaagtgattcttctgcctcagtcgctccagtagctaggattacaggcacccatgaccatgcccggctaatttttgtatttttagtagagacagggtttcaccatgttggccaggctggtcttgaactcctgacctcaggtaatctgcctgcctcagtctcccaaagtgctgggattaccggagacagccaccatgcccagcctatccagtactgtattttctccagacttttcccacgcagtcaaataatgaggttttgtttgaaggtctgctaattaggaagatttgttccagattttgctccagggtccccaggccttgaccctgaacctggagccttgtctcaagccagcctgctgaccaatacctttccaggacaggccggctaggttctgggcagaggaactacgcttgtgtggctgcataactgggtgctcactttctcctggagcctcatactgagtccgctcatccttcccccagggattcagaagggaatgggagcctcccttgcaggggcttccactccctgtgtgtttgtgggcagtctcttgtgctctcaggacctcggtgtcctccagaaagccagcgagttggaggagacaagctctagggtctagtgactgtgatgtaggcaggatagttgccctgggtcaacccaggatgggctgtctctcagagggcccagggcccagaagtcatgatgataaacatctggtgaatgagaagcagaccaaagggtagagacctgagaggcatcagcatggcatgcggaagatggygaagaatgttttatggcctcagccattccctgagaactgagcttagccaggtgcagtagcccacgcctgtaatcccagcactttgggaggccaaagtgggaggattgcttcagttcaggagttctagaccagcctgagtagcaagactctgtctccagaaaaaataaaaaaattagtcgggcatgttggtgcaggcctgtggtgtcagctgctcaggaggctgaggcaggaggatcgcttgagcccaggagttcaaggctgcggttagcggtgataatgccacggcactccagcttgcgtgacagtgaaccctgtctcaggaaaaaaaaaaaaacaaaaaaaaccaaaaaactgatcttaaaaaaaatcaaatacttgcattcagggcaaggagaaagacaaactgagggaggaggaaaaagtaatgtgaagccagtgaccctgcccagaaaatgtgactaacccagcagcggtgggggctgtgccgcgcctgccccaggccctgaatggagaacatggctttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggcctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagaggtaggaggaagaaaggaaagtaggagtgttgaaaggtgaaggtggcagggtggctgccagcgcggctggctggtaccctcctgggtgggcaggcgagggctggctgtggtggcctgggaacagagacccacatttctggataccacattgtgccagggtggagttcccccagcctgctgtcctgccagccttatgccaggctccaggcacctgatctgatggcagctgtgaagctgcccgggaggatgggtgggctgtgcccatgctgcacatggaggaactcttgggtcagggcttgtcccagctgtgccagacctcctgacggaggccaccacactgctcctgaaggccctcagccagactggaggtgaaatcagattagaagctgcctgtccccaagacaggactgtggtgtgatgctatttgggtgggagtggcttggggagggggcagggcagtcctagccatttgaattcaaatgcaagtggcacatttgattattttgcaaactctggaagaccttggctgagggtctaggtggactgtctgaggtaggaggtggggagggaggaagtggttgaccctggggaagggtaggagacctatttggtatcaggggaaaaaccatttggaatccccaaatgaggcctctggacctagattctgagaatgccatgtcccaggctgggagattcagtttggtttcgagggtgggcacctacctccaccaggagaagtggaggtgctgtttcatttcacacctaggggcaagcagggactgtgaagggaagagacctattgggggtcagtggaatcagggtctgaggaaggcaaaggtaccactggaccccggcaggatttttgtccctctgatggctgtcaagtctttccttaaaggtgtgtgtaacggtgacctcctctccgaggtcccccagtgtgtcctcaaagacagcctaagtcaggaccatgggacagccagcaggacttgcgtcctcccctcccccagccccatggcagtctgggacccctagcccctgctctctgcctcctggggctgctccagcctgtcccagccttttgaaatcctgggctatcccttaggtgccaccccagtctaataatcagagcccagcaggtccagttaatcaaatgcattctttgagcacctgcatgaggttccagctagatccagaggcaaaatacacttcctgccctaaaggaccctacagtgtagtagtggaggtrggygggtccataactcaccacactatggcagagtggggaaaagtaaaggctttaagaggtgtagaagaggctgtttggtaaggtggtgagtttcccatcactggaagccttcaagaagaggatggtaagggatgctatagaagagatttctgcactatgcgtgtatgggtatgtgtagggcggtgcaggcagagcaggactagataagaactttagcgctttcttttttttgttttattcctcccccccggccccagctcccctcttcaactttagcactttctaatgctgacatctgtgattctgtgacattccccacttagaggaagttcgtctgcggtttcactgggtatggtggctcccttgttcactgcaccctgcagctaaaccataaaacatgggctattctttgtctctgtgcatgtcacccccagtgccaagcccccagcacagacgttgagtggaatggaatagactctttgctgggctgcttgaggaacagaggcatcaggtgtgtccttgctccagttgagatgtgaagcagccagtttatgctataaaacaggctaaagtatgtgctcccaggggagagggctgggagaactcccagagaaggcggaggccacttaatgtcctggaagtttccttggacagctggggcttgatacgggcctggaaggataagggggcttgtgtgtgtgtgtgtgtgtgtgtgtgtgtgtgtgtgtgtgtgacagattcttcctctgttgcccaggctagagtgcagtagtgccatctcggctcactgcaacctctgcctcccgggttccagcaattctcctgcctcagcctcctaagtagctgggactacaggcacgcaccaccatgcctggctaattttgtatttttagcagagatggagtttcaccatgttggccaggctggtcttgaactcctaatctcaagtgatccacccgcctcagccttccaaagttctgggattacaggcatgagccactgtgcccagcctaggatgagggggctttaatggatgtaagggtgaacatggacactgaggaagctcaaggagctgtgggcttggacagagggctgggataggggaaagaatgaaaggccagaggtcagggtggacccttccccaggagagactggaacaaaaggtctcgggacagagatctaatgaggcagcaggagtttcaaccctgaccaagcattagagtcatctggagcttctcaaacactgacatccaggctccacctagagagtctggttttaatgagtccaatatggaagctagtcactggggtttttctttcttatttttctgtaaattactttttttttttttttttttgagacagagtctcactctgtcacccaggctggagtgcagtggtgtgatctcggcttactgcaacctccacctcccaggttcaagcaattcttgtgctgcagcctcccaagtagctaggatgacaggtgtgcgccaccacgcccagctaatttttgtatattttgtagagacaggatttcaccatgttgcccaggctggtcttgaactcctaagctcaagcattccacctacctcagtctcccagtgtgctgggattacaggcatgagccaccatgcctggctggcactggggtttttcaaaagcccccaaatgattctaatgtgcaggtgagcatttgacactgttctggacagaattcactggcactactaccatcactttgaacatatgttcaaaatatgggtgatcaagccccattccagacctgtggaatcagaatccccagaccaggggcttgggcactgttaaagaaaaaaaatatggcccaggcgcagtgcctcacgcctgtaatcctagcactttgggaagccaaggtgggcaatcactggaggtcaggagttcaagaccagcctgactgacatggtgaaacctcacctctactaaaagtacaaaaaattagccagatgtggtggtgcacgcctctaatcccactacacaggaggctgaggcaggagaattgcttcaactcaggaggcagaggttgcaatgagctgagactgtgccactgcgctccagcctgggcagcagagtgaaactctgtctcaaaaaaaaaaaaaagaaaatttctaagtaggaaacatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaggattcctttttttttttgagacggagtttcgctcttgttgcccaggttggagtgcaatggcatgatctcagctcactgcaacctctgccttccgggttcaagtgattctcctgcctcagcctcccgaatagctgggattacaggcatgagccacgaagcccagctaattttgtatttttagtagagatggggtttctccatgttggtcaggctggtctcgaactcccgacctcaggtgatctgcccgccttggcctcccaaagtgctgggattacaggcatgagccactgtgcccggcccctaacaggattcttgctgaatacaggccagagtgatcagacatcactggggcggcgggggcagggtgttgaggaacccaatcagatatccacgattatcagatcgaccagatatcaagggtagggggttctaggtaaatggccttagcagggttcttttgctaaaaccggattttacaagcacacagatgggcctacggggtggttcagaagcctagttaaagtttggccaagcaaagaatctttgtcagtaccgacattttaataaggtcccaaggtcattctaatgagcagccaaactcctttcttttctttttttttttttgaaaccgagtctcactccattgcccaggctggagtgcagtggcatggatcttggctcactgcaacctccgcctcccaggttcaagtgatttccggataatttttgtgcttttagtagagacggggtttcaccatgttggccaggctggtttcgaactcctgacctcaagtgaactgctcaccacggcctcccaaagtgctaggattacaggcgtgagccaccgcacccggcctgccaaacccctttcatccaaaccctgatgtggctctctggcatgtaggctgcctgattttgagttaaacacagaatgaaaaatagtaaaggtgacaattggcgcactccgtgtctcattcttgagcgctccctgatggcttgagcttggggcagccacttcaccagctcaggcctgagtcacaggctgggctgcctgttscaggggatgtgggcacagcatgtgatcctctgtgggatggagaaacgttaaagtttccctccgcaaacctctgctctctgcatgtcctcttccggaatcgtggtgccaaaatatgccttccactattttgtaggttgggaaaggaaaaggaaagtcataattcacacagcatttcacatccattatcactgcccttgacctgtccctctttgtttcctactcagacttaataccttctgctctgtcatctgccttccccctacccctgacttccctggcccctgcgaaatattgcacttcctgatcctgctgccccagcccccaagaatctcctaatggtgccagcttgcatttttaccctccaattccccaagcccttaccctgtgccactggggctcatcttacacaaactctgtccaaatggatgcacagcatgaattgtattatgtacgaagtgcatgctggctctgtgatctctgcattttgagccaaaaaaagaaatcctctagtgatgggaacctatgaaagcgacagtgagtggagccgtagctgttgcattttctgaattttttaaaaagataatatctttttaaaaaatacttgcgtttagcattttttcccttgaatgacttttgtccagaaaaagtgttcatcattctggcatttgagggaagctgggcatacagaattgatagctgatgcctgggagtgggtgaaatttctcagggagggagtttagaattagagcagccattaaatataatgttaggtgaagggtttttgtttgtttgttgtattttaatagatgcctttttaacaggttaaggaaatttctttctattcctagtttgtgggtaaaaaaaaaattttttttttttttttgagagggggttttactctgtcatccaggttgcagttcagtggcatgatcttggcttactgcagcctctatctcctgggctcaagcgatactcactcctcagcctcctgagtagctgggatctggaattacaggcttgcactaccacatttggctgatttttatttattttattttattttatttttttgagacagagtcttgctctgtcacccaggctggagtgcagtggcacaatctcagctcactgcaacctctgcctcctgggttcaagcaattctcctgcctcagcctcccaagtagctgggattacagacgcatgccaccatgcccagctaatttttgtattttagtagagacagggtttcaccatgttggccaggctggtctcgaactcctgacctcgtgatccacccacctcggcctcccaaagtgctggaattacaggtgtgagccactgcacctggccttggctgatttttaaaatttttgtagggttgtggtctccttatattgcccaggcttgaaaaaattttaaactaggaatgaatgtagaattttgctaaatgctgtttctgcatctattgaggtgattacacatacatgtttgttaatagggtgtatagcattgattttcaaattttggcctgtttttttttttttkgcgttgtgagcggctttatttatttattttaaatttataattgacagataataattgcacatacttagcaggagcagtgtgatgtttcattgtacatatgcaatgtatgtgtatatattgtataatgatcaaatcaaggtaattagcatatccatcactttaaacatttatcatttctttgtgatgataacattcaaatcctctcttctggctatcttgaaatatacactgcattattattagctatcatcaccctgattttcagatattaaaccaaccttgcattcctgggataaacctcatttggtcatcatggtttattttttatatattatttgatttcatttgctaaaattttgttaattttttttttttttttttttttttgagatggagtctcactctgtcacccaggctggagtacaatggcatgggcttagctcactgcagcctctgcctcttgggttcaagcaattttcccgcctcagcctcctgagtagctgggactataggcacgtgccaccacacccagcaaatttttgtatttttagtagagatagggtttcaccatgttggccaggctggtctcgaactcctgacctcatgatccacccaccttggcctcccaaagtgctgggattacaggcgtgagccacygtgtccagccaaattgtgttaatttttgtatgtgtatgttcatgagagatactgatctgtaattttctttttgcataatatatttatctggttttgttatcaggagaatgttggcagcataggatgaattgagaagtgttctgtcatctctttttttgaagattttgtgtacaattggtattatgtcctttttaaatttttggtagaaattaccagggaagccatctgggcttgggttttttggcgggggaacgagttttttactacaaatttattttctttaatagatatggccactgttcagataatctgtgtcttcttgaatgagctttcataatttgtgtctttgaaggaatttgcccattttatataagtggttgaatatattggcataaagtttttataatattccctttatccttttaatatctgtaaaatctatggtgatctcacatctctcatttctgtattgatatttgtgttttctctttctgttaatcagtttgtctaaagatttatcaattttatcggtttaaaaaaacaacttgccaggcacggtggctcacgcctgtaataccaacactttgggaggctgaggcgcgtgaatcacctgaggtcaggagtttaagaccagcctggccaacatggtgaaaccctgtctctactaaaaatacaaaaattagccaggcgtggtggtgtgggcctgtaatcccagctacttgggaagctgaggcacaagaatcacttgaactcatgaggcagaggtcgcagtgagctgagatcacgccactgcactccagcctgagtgacagagtgagactctgtctccaaaaaaaaaaaagccaacttgaggccaggcatggtggctcatgcctatactctcggcactttgggaggctgagatgggcaaatcacttgaggtcaggagttcaacaccagcctgggcaacatggcaaaaccccatctctactaaaaatacaaaaattagccaggtgtgatggtgttgcctgtaatcccagctgcttgggtggctgagaccggaggattacttgaacccgggaggcggaggttgcagtgaggcgagatcgcaccactgcactccagcctgggcaacagagtgagactcagtctcaaaaaaaaaattcattgctcttctctcttgtttctgttttctgttaatttctgcttttattttaatttctgtgagatctcagcagayggaagaccctggcccaggggtcagagaccttatttccatgaaccactcactagctgtgtggccttggactcatttctgagactcattttctttgtctgcataatggaactagggctcctagaggtggagtagttgatgaatatgaaagtacttggccactggaaagggcctctccagccccacgtgagagktcctttttgtggcatttgtaataataatggcttcttctttctttccagatctgaagacagcatrtacacagccattccccagaggtaagctgcatgccccatctcctttcacaacttccccttctttacctccaagggctgcccctccccactgctctcctcatccccagactgcagtcgccaggcctgcccagggctgtgcttgggcaagtgggtccaggctgctgtcaaccctctctcttctcgcagtggctctccattcccaggctcagtgcaggatccaggcctgcatgtgtggcgggtggagaagctgaagccggtgcctgtggcgcaagagaaccagggcrtcttcttctcgggggactcctacctagtgctgcacaatggcccagaagaggtttcccatctgcacctgtggataggtaaggggatctggatgggggaaggttgggcccaggaaggggagggagggggctggtatggatcacaagggccttgccctgccctctcccacttgtcccaggccagcagtcatcccgggatgagcagggggcctgtgccgtgctggctgtgcacctcaacacrctgctgggagagcggcctgtgcagcaccgcgaggtgcaggrcaatgagtctgacctcttcatgagctacttcccacggggcctcaagtaccaggtcagagcccacctctaggcacccccaccctgcagcttccctcagagccagccctgcttctggctggttctcaccctgcagaagacccgggtgccyttggagccgggtccccacctttctgcccgtcttccagtgggatggggtgcagagggctctgggtctcctgtcagtccactcagatgggccgtctgggctgcaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccaggtgggtaggctggccagactgagcactccgtattggcaccatcctttataaggacggaggggcaggaggccaggaaagagggagagaagctgagaagccgtaaacccattccaagtgagatcactctgaccattggagaatgtccctatatttgtaaggactgatgccagcctccttctgccatctagacattgcctctgatgctctggagctttttccctcctcttggaagcctctgagttcactgcctgccagaccattcattaattcagtcatttatctcttcgttcagtgaatctatgatgctctctctgagccagcacagggaccataaaagctcgctctggggaggcagccaagatgggccagtcacttgccataacctgaggcaggatgtgatgagggctttaagggggacagctgccatgtgctgggggggtcttggggcagggaggggccctctagcctgagccgaagccagttgtcccaggaaggtgacattggactagacctataggaggggagatgccactccaggcaaagggagaaggtgagctgagccaccaaggtgggkaagggtgcagacatgcacacaccaggggtctagtgagactgggacccgggctgggggacaggagcagggggagggaaattcctaagcaaggtggaaggtgagccctaggtcatgaggagattggctggctgaggagtatgggctgcgtcttgtggcgctgaagatttggggcagggagatcaatccaggagctcttggtgaggactacacgtgctgagacaaggaaggggacaggtgaacagacctcgccattaccagaaaaggagaggtgacaggggctctgcctggcagggcggtgggtagaagtgtgagatgctgcgctcaaggagccattcagccattcacccatccagtccttcactcagtcagtcaatatttattttgcgcctaaatccatgccgggctctgttttagcagtgggcccacagtggtgagcaaagccaaacaaaaccttcatgtcctaatgaagctcactttctagtaggtggagataggtggttaagagacgtttaaacataggagatatgtgatgggaagaaaaataaagaggtgctgggcgtggctgctcacgcctgtaatcccagcactttgggaggccgaggtgggcagatcacctgaggtcgggagttcgagaccagcctgaccaacatggagaaaccccatctctactaaaaatataaaattagccgggcctggtggcacatgcctgtaatcccagctactcggcaggctgatgcaggaggatctcttgaacccaggaggtggaggttgcggtgagctgagattgtaccattgcactccagcctgggcaacaagagcgaaactccatctcaaaaaaaaaaaaaaaaaagaaaaagaaagaggcttgagcccagcggtttgtaaccagcctgggcaacatagtgggaccccatttctacaaaaaattaagaaattagccaggcatggtggcaagtgcttatagtctcagctgcttagaagctaaggtgcaacgattgcttgagcccatgacgtcaaggctgcagtgagccatgatcacgtctttgcactccagcctggatgacagagtgagaccctgtctcgaaaaaaagaaaggaagacagatggcaggtgggcagagaaacagttgcagtgggtggtcgtgggcattttcagagagccctctgtgctgtgctctgccttcctggttgtcctgcctcagggacagttcagagaggagagagggagagctgtgsgcccttctctgagctggggagcaggacacaggcatctggctctgacccggactttcctgcttccttgcagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggttgggggacattggagtgggtggctgggagcctctgcttgaaagtggccaagagaggtggtgatgagctgagggctgagagtggccggtggagggtggcaggggccatctggtgtactgcctagggctgtggccagctcacagggtgcccctctgggtagatgctcgtcctcgaggctgagcagcctggctggtggggtgggctggactcagccctcactcacctcacctctgctgggtgccctagtgcagggcgcagtttgccccaccagaagcagtggcyctgggcatgatgggctgggaagttccagggcaggggtccctataaacctggcctgccctggcccctgcaggtcctgggccccaagcctgctctgaaggagggcaaccctgaggaagacctcacagctgacaaggcaaatgcccaggccgcagctctgtataaggtgggccccccaagcctgccctgggacccggcagcagggagggtgggagcctgcacagcacagctgcatgcaagcagggtggaggggagaaggcagggggaaggtggggctggaaccgaggtgggaggtggggagttatacagggctgggagtgagacaaggatggggagtgggcggaaggcaggccctcctgaggagatgagtgcacctcacttccagcctatgcttggtgaaggcttgaagccaatgctgagcttttctttcttgaattctgtgcatttctttgtaatttggaatccwcctaatttccaaatgggttcggggcccctgtgctgcagggattggggtgatgagagggagtggggctgcctggmatttgcttttcaggtcttcactctcttgtctgctcctgggacctgggcagtgggcagcgaggcacagtgggagggacctagggaggaccagcctccccctcctcaggctgaggtgagggctggtgtgtggggggtgagatcaggcactgtccctcctccccaggtctctgatgccactggacagatgaacctgaccaaggtggctgactccagcccmtttgcccttgaactgctgatatctgatgactgctttgtgctggacaacgggctctgtggcaagatctatatctggaagggtacgtggctcctctgtaacagcctgagatgcctgtagctgctctgacccgggcaggcttccctttgcaggactcagcctgtctagctgcttgtaaaagacagcctcaggaagcctgcatgcttctggctgaccattttctctctttaaaaattttttttaaaagatagagatgggttctttctatgttgcccaggatggtatcaaactctcagcctccagtgatcttcaccttggcctcccaaagtgctgggattacaggcgtgagccatggcataggccttgctattttctttctttctttctttctttctttttgagaaggaatcttgctctgttacccaggctggagtgcagtggcacgatcttggctcactgcaacctctgcctcctgggttcaagcaattctcctgccttagcctcccgagtagctgggagtacaggtgcgtgccaccacacctggctaatttttgtatttttagtagagatggggtttcactaccaggctggtctcgaacttctgacctcaagtgatgcaccggcctcggcctcccaaagtgctgggattacagatgtgagccactgcctcgccattttctctttgctgttcccacctcctaaattctagacaatggctctgaaactacagcaagcctcagaatcaccccacggcctgtttagatggctgggctccacccccatagattctgattcactaggtctggagtggggcagaacatgcatctctaacaaggttatgggttatgtctgtgctgctggttccagggatcacactttgagaaccactgccctagcccagctctagacctttggggcttctgggacccctgatcctgggattctgtctcaaggtttgacagaaatgaattttagacaaattaaacatcattttatgcagtgagtggtgaacctgtagaacttgtttttccaaaagattctatcttctggaaatagaaacactgttgggcagagcctgttctgcttggtttgactgaaaatgaaacaaacttgttctcagtctctgcctggggtctgagaattttcagcaatagcatttgctcaacacccagttgtggggtcaaccaaggtggagaaaatgccagcccctagcctggtcaggaaggcagacaagtaggtgggtatctacagatagctgctaccaggcatttcatagtattgcttctgaaactcagcagggatagaagtgaaagggaggagctgggagcagcaaaagagtggaaagcgagaggcgtgtgctgcagggctgccttttctctcctgccagagggcacatatcccatggaaccaatgccaagcagaggggggttcacagaggcccacagaagcatgtataaaccggagcaaggaacccaacaactatggaaagagaaatcagaggaaaaacaggaaacttgggaggccaggaagagaaggatctcatgggtaggggggcagctggtcagttgacagaggaaggaatccagcatattaatttcagatacattgtagttcatggcattttatagcctgcctagagagccaaccacatcacggcatcgtttcggtatcatttccttggaaaaatgtctggcagcctgggcaacatggcgaaatatcacttctctacaaaaaaaaaaccccccaaaattagctgagtgtggtggcgtgcacctgtggtcccagctacacgagaggctgaggtgggcagattgcttgagcctgggaggttgaggctgtagtgagccgtgttggtgccgctgcactccagcccgggcgacagaacgagactgcgtctcagaaaaaataaaaataaaaaagcctggaatgagcagtttgagttctcaggactgctagcagaaatgactggattacgtggggtcttcatttttgtaagtgcttagttagcataactgttaggccagtgtagccctgctggcattatgggagtaaatcacctctataataaattgtaccctttgtcttatttagtttttcagaaaaggcttgatgaattcaagaggtgaggggtcctagaggaaaaggagacctgcggcctcacagtctgatgctagggtgaacacctgttcccctccctgaaatattccaggggcccaggtcagagcagagttttgcatgatcagacccgggcagacgaggggttttcatctaccttggtgctgccrgtttgggaaaattcttaagggaytgactccacatctccaaagagcccctsggcattcttgggacccctgstccatttattgtaaaaattgctggctcttctgtggactcccttaaatttcctcaagaaaaatgggatggcagctaaagagggtccctgctctttttaaaaatctccttcctatgatctagggcgaaaagcgaatgagaaggagcggcaggcagccctgcaggtggccgagggcttcatctcgcgcatgcagtacgccccgaacactcaggtgaggagatgcgcacaaccacagccctcttcctagggctcttcctgtggcccctgacccctcaaattggccaggaagggcaggagagccttgggcactgtcaggaacaaccaggcctccctcttagacccatccagtgggaaagcccatctcaatccttcaaaatgtcaaaatacttattattttcaaagaggatgttgggcagcactctcctgggtgcccagagaactgggtactcctcctctgggccgttgtccctggctggtgccacccctcctgccgcagcacagtgtccacaagtcatcccgtggggagctgacagggctcagctaccgttggtggcrtttattaaactgtgcacccacgcccttgaagcagtctgttgcctctgtctgtgtccctgaaatcttggttctcatctcatggctcatccaggggagctttcccagcctggactgcacatggattcaggccaggcgcccacaccctcctccctggctctggccccctcctgtcctcctgggcagaggcagaggtggcaactttgtgaaccagacttctcccccgctgtccctgcaggtggagattctgcctcagggccrtgagagtcccatcttcaagcaatttttcaaggactggawatgagggtgggcgtcttcctgccccatgctcccctgccccccaccacctgcctgcttgcttctctggctgcctgrtcagtgcagaggtgccccctgcagatgttcaataaaggagacaagtgctttcccagctcttttcctgcaccacctgccctgggctgattctcactgtcacccacctattcacctgggttcatccccatgctgggggtggagtagcacacagatgacaattggacagccttggaggggccagagctgctttgcatgacagaggagtcccagccaggcttgcagggactgccatgaacccaatagggaggtggcacagtgccaggcctcaggatcagttgcatccgggtgttcagttcagtctcacattcccaacagggagaaggttgtggcaatgggcttgggatgcagttccatttaaggcagtatttcttcggatgccctaataaagcactgccaggcagcttcaagtgacatatgcccactgagcaagagaggacagcctttcacaattgtaccaagcctggcttattacttcgtaggcacattgcccagcatgtttggctggtgagcccagggccactgcagggctgtgcgaaaagcaccaggctagcatggacagtcttcagtctggttcttaccctgcctctgtgatcctaggcaagttactttcctttgctagaccttagttcattctcttgggtaatgaagtggtggtgggatgtcagaggctagagagctaaatagcagggagaatgcagtagccaagaagaggtcccatctgagaaggcatgcccaggggccaagagcagggtgtgagtgagcctgtgtcagcttggaccagaggccgtgaggcctggcaaggctgcaaccaccctgactcatcctcacccccaggtcctctggactatgtggcttctgagctccagaaattggattctttcatcccaaaacaaaaattctgatcaattggcaagttgaacttgctgatttgtgccaagaaccataccatagataccccagccgggtgcggtggttcacgcctataaccccagcactttgggagggcaagacgggcggatcatttgtgatcaggagtttgagaccagtctggccaacatggaaaccctttctctactaaaaatacaaaaaattagccgggcatggttgcgcatgcctgtaatctcagctacttgggaggctgaggcaggagaatcgcttaaacccgggaggtagaggttgcagtgagccgagattgcaccactgcactccagcctgggtgacagagactccgactcaaaaaataaaaataaaaaagaaatgagctcctctgtggatctgcctccatgtcttctccatagacttcttagccctacttgacagcctacacaaagagcaggtgccagggatggttttttaaaggggagagaataaaggttgcactacattagtggttctgacaacctttgtagagacggggagtattttaagtctcctatgaaaggcctagcccctttccctataaatatacacagattaagatttttgtggctgggcacggtggctcatgcctataatcccagcattttgggaggcagaggcaggcggactccttaagctctggggtttgagaccagcctggggaccatggtgaaaccccatctctaccaaaaatacaaaacttagctgggcatggtggcacaaacctgtagtcccagctactcaggaggctgaagtgggaggatggcttgagcccgggaggtggagattgcagtgagccgagatcgcgccactgcactccagcctgggtgacagagtgagatcccatttcaaaaaaaaaaaaagatttttgcatctgctttcagagggttcaggtacccctcacaaccagttcattaacagaactgtaaatttaaaattgccagactacattattgctaatgttccagggtctgaagctgtgagtactctgtcatctggggggcactaaacaggtggatggtgggcagaaaggaccctgcagagggaagaatcacccaacctgatactccaaagtggaggccgagctgcagcttttctcccctgcaattcaactcctgccatgccatgcccagcaatctccctgctatctctgttggttagctgaggaccagactggaggaagtattgtgaatgaaggggttagttcaggtcaggcagacaacacaaggcaaactatggggtttgttaccagccccacccttgaggcatcctgctgacagcagtcaggagttcccctccacgcctgggtggccacctctcttccctacctctgtgatgtttccccctgcagtgggtcagacttaaagaggcctgcagggccagatagtggtcttccatagcattccacttgagggggtccggaggacagaaggtagcatagtggggctctcacctgccccccactccccagctcaggtaccctggcctggaggctcttttttttttttttttttgagacggagtctcgctctgctgcccaggccggagtgcaatggcacagtctcgactcactgcaaactccgcctcccgggttcacaccattttcctgcctcagcctcttgagtagctgggactacaggcatccgccaccacgcccggctaattttttgcattttcagtagagacggggtttcactgtgttagccaggatggtctcgatctcctgacctcgtgatccacccgcctcggcctcccaaagtgctgggattacaggcgtgagccactgcgcccagtctggaggctcttttgggaaggaaccaacagtgctggccttcgccagaagcaaatgcaggaaaaacgtggtgtggatgccttataccagtcaatcttaacaagagctgggctacctcgtccactggctagagcttgcaaggagtctctgggcttgtaagtatagcagaggatggacatcctatgaattcagcaaggtttggctgcagcacaggcaaccttctgtctcctggagcccatgaccaggctggaacccacctatgccttcaccyttaggtgtgcctggctctaaccaggttccggaatgacaggaccacaggatggtgcaagacttgtcttggaaaaaaacacctgagacgcttaattagaacaattcttttatttgaaaactgctggtatgaatttcctccttccctcaattaggccagaaactcatcatggggcatgcacagcatctacaggaggaagccccagcttgtgggggctaggatggagcagccgtgagagacacctagccaaatgtccgtttttccatcataaacaatggagcgggggtcagggggagaagagagtgggtaagtgaatggccagaaactccagagggggcctcacacccacctgtgaggtacctccttgccctacccccactgaggcctcaggccccttgcttgggtcatgctgccccctgtcggctgctgcccctgcctcttcctctgagttctaacaacacagacactggtgcctgaaagccctgctgctgccagggagtcagaattctggctgcctctacttgggaatctcctcccatgtggggatctgcagaacatccagatggggccatcccacctcatgatccattcactcccagtgggatacactggaattcaacccggagactggagcccaacagattaaggcagaattctccttgctctggaggcaggtctgcgggaagggggtgaagtctagctgcccctcatgtcccatgccggtgagggtacttggcttcccacagctaagcccaggagcttcctatatcccatctgctgagacagcaaggggtgcggcctggccaggctcctgacatggctccactgaccccctgaaagcccctgcagctcagcctttaagcctccattcatctcggaggtcagatcagccatacgccttcggatgagtgagactgcaggtcactctcacctgtgaaggtgagatccttgaagggaggggcttctggcccatagcacttctgtgctcccaacaaggaggcctgtccctttgacaccctggccaagtacagctccagggtcttgagcagccgccgtgggctcttcttggccaatacttccaactctgcaacagagagaattggggagcagaaggcttgagggggctctgggtgacacaacagtcaaggcctcaagcctagcagctctagggagtacccccaacccctatcccatggagagaaagtgaaggagcctcagatggagagatcaccagagaggtaggctagggagccagctacagccacagggaccacacactctaccttgtctgcacaattgcaactttgaatagtccaactattggaccctggctcccaatttttgatcagaatatatgcttgtcataagtataagaccagaaaagggcgacagtcagggcagagaaaggagaactagcagactccagggggtgggtgatggagattttggtaagctggaatttgagaaagtgtggatggggaagaactgcagccaaaaccagtctagcaaccaccttgggctctctggacctgggacactgtgcattcagcctaggcctccccagaagaaagagcacacctttgaggacaaagcccgagtctgagatggtcttccgctgtgtcctccagacatgtgcgaggtggaggaatgtggcggcatagaagctgttcaccacggggatgaccttctgctgccgattacactctctgcaggaaaaaggcaaggtgacctgctcagcggtggatgaaggctgagacctaggttccctcccgccttccttccccatttccccaggggagccagcccaaacccaggatgcccccaccattccccaggagcctgacatctaaggccaggggtgggagaagggatgtcctggggagaccggtgcatggggactttgtccaggccctccaggagccagcaggtggagtagagctggggaaaattaagccagagtggggacgaacaaggctttgctgggtcactctaaccagctggtgtttggggactcacctggagagacactcctctctcaaggcctggatggcaatgtgggtgatgttcacggacatcaaacagaaagggaattgctggaatggaggggcacccagtcagcagcaactccagctctcactgtgtttcctgtcatctgcagcctggtgtggctcgcaggcaagcacagccccagaggcaacagctgatattattattgcttccacttaattttcctaataatcttcttcccatcttacagatgaggaactaaggctcagtgacctttagtaactttcctaaggcatgggaaccaggataccaactgaggttatttgctccagagctgatgtgcataacccccgtgctagctctccagcctcttcatcatcctgacccgtcagctctccttggcctgcagcagacccaacccctgggcccacatcatctcctggtgtcaggatgaagacagaagtgagaggctcggtgctctaactagccctacgggttcttaaagtctcctctccccttctttgggcttctggttgtctggctgatcgtgagcacctcatcctaagacagagaagacgcacgtgggtagaaggtcatcctgacttggggggacaccccatctcacgataacacagaggcctgagagccagctgtgcgggtcagaccccaagaggaggcagcctgagtctggcaggggagcttcaccaggaagggcctcagaatcccctacagggacagctttaatgctctatgtttagtcaggcaagctcctttctttaataacaatgaaaccaagcttgcaaaatccctgaatggaaagggcctttttttcagggaacttgcagacatgacatgttattttcccctgttgcacatacacaaggacacccagtgagaggaacacatagaccagtgcattccttagtacagaacaagaaccaaggtctatttatcccacctgcttcccagttgaagaaaaatccattacattatagtatagaactgtactgcccagtatggtggcaaccagctgcatgtagctatttaaatgagttaaagatgaaaaacaaatataaattcagctccttagtggtactagccacatttccagtgctcagtagtcacgtgtgcttagtggctgctgtactggatggtgcatttccaatatctagaccacttctgtcactgcagaaagttctggacagtgctgaactgcagaaggtcttctggctccacagagatttttctcagggtcttccatgatacctgaattccagatcttggcctggctacctggtagctgtgtgtccttgagaaggtcacccaacctctgtgaaactcagtcttcccatctctcaaaatcaaaaaggacataaactttgagtgctgtgcagaaaaaagttaacacagcaggcctgagactccttagagcctgagccttagaaaattcttagatcaggccatggctgacagctgagaacttggattttgagatggttcccatcattccctaacattgttcctcaactgctcatgcaaacaagatagtttttgctggctgggcccagggctc

SEQ ID NO: 17757 - DNA, 43985 bp, Homo sapiens
tataggcatgatacttttccaggaattgggacaggcatctctctcaaaatgataatgcaaacttctcttcttacagtgcaagtctaatagttcaaaatgtcttttatatgtgtttttacagtagtcactggttaccataaacagaaagaaaagtaaagaaggaaggtaaaaaggagtgaggagagagtgagaagaaacataataatgctaacagttcaagaaacatttttagaactgagaattgtcccaagggtcttaagtacacacaactaaagttttcaacacaggtttaatttctctaatctgaaaatccaaaatccaaaatgctccaaaatccgaaaccttttaagcacagacaggctgcttaaagaaaatgctcatgaagcattctggatttcaaatttttgaattagggatgctgaactggtaaatataatgagaatattttaaaatatgaaaaaatctgaaagctgaaacacttctggtcctgagcattttggataagggatactcaatctgtaatggaaaatgtgatataaatgacattccagtttaggaagaaaaggatagcaatataataaacgatgctggagaaaatggttatttatttggaaaataactaaattaaacttctgtcatccatgacagatgctaataaattccaggtgtacaacatgctgactatagttaataagaatgattgcgtgcttgaaaatggctgagagtacttttttacctttttttttgtttgtttttgtttttgtttctgagacagagtttcactcttgttgcccaggctggagtacaatgacgcgacctcggctcactgcaacctccgcctcctgggttgagcgattctcctaactcagagtccagagtagctgggactacaggcgtgtgccatcatgcccggctaattttttgtatttttagtagagacagggtttcaccatgttagcaaggctggtctcgaactcctgacctcaggtgatccacccgccttggcctccaaaagtgctgcgattacaggcatgagccactgcgcacggcaagagtacattttaaatattcttaccacaaaataaaatgatagatatggaggtaatacacatgttaattggtttgatttagccattctacaatgtatacatatttcaaaacaacatgaacataataagtatatacaatttttgttaattagaatacataaataaaaattcaattttacttttagatcaaagatctaaataaaatttaaaagatattatttttaaaaatgtaaaatattcatgctcttgagataggaacctcggaagtcataaaagacagattcgactacagaacatttaaaaatacatcataagtaatattaaaaagtaataaaagagtacaaatcgggaaaatatgtacaacattcataatagttaatatctgttttacaatgagtccttaaagacaaaccatccaacagaaataaattaaggtgtagaaaggcaattcaaaagaaatgtaaatggccaacacatatttgaaaatatgctaaacttcattaatgctcattaaaatgcaacttaaatatatgatatgatatcctctttcatgtagttgagtaacacaaattaaagagactactaacacactgcaatagaagtggaggagacatggccaccttcattcattgctggggaaatgtgacatctgtaactataagggaaaaaaaatctgccagtatccatcaaaaattaatccactaatcacatttttgggaatctagtttatatatgaaaaaaaccaaaaaggctctagtatgacaggatttgcaagaatgtttattatagcattcccgatagagacaaaagttgcaaaaacctccaagtgcatcaatagtagaataaacaccatgaaatatcatgcctttctaaaaagaatgcatgtgatctgtatgcactggcctcgagggatggccatgatatactgcgcataaaagcaaattgtactttgattagtgagtctcattccttgaaaagagaaaaaaaatagacagtgtttatgtatctgtatacatttgggcgtagaaactgcttttaatactgttcctttagaaatggtaagagatcggggttaactattatttatctttatataacttagtactgtctaagctgttttaaaaaaggggtatttttccattcttattaccttatttcaaaaatcagatactctaaactatgattcagagtcaagtagagagaagcagagagagaatgtcatagtctggtgtgctatttctgattctacataaggaatgtgatagataataggataaatctttataggtctttatgggaagagcgaactctagataaactaaactctattagataaaagtgaaatttctggcttggcttaaaaatatactgtacttgcaaataatttaggtatttgttcagtccagacattcacactttgataacaaacagctatgggaaacctagtagtaaacctagtactaaaaccctgtaaaaccttcagagagaatggagaaatactgtaactcacatgcctgcagcacttgataaaacctcctaagaaatcttaaacagcaggaaattgttccttcaagaacaagaacacaaaaatggggtccatttatcaaagaaaagcctatctggtggcaactgactccaagtaaatgaaattctgctttttcaggttattgagacagatcagaagtaaaggaacttaaaaggaaactgcacccatggggaaataaagccacatatagttcatgcttttaccttatagaaagggcattccaggactgaggctaagaaaagttgggtcagttgtgcccgactcaatgtgtccaaatgagattctttacctgaaacagaaagcatcccagtcatagttacgtctgaattgaggtatgtatgagagaacatcatgaacattcaacatcaatttacacactccagacagaagtattctatttttaaatgacactatgaaatgaacttgttagaattaattatgccctcctcttgccaccaatgaaattgacttccaagaacccaagctcctagctacagaatacaattaaaagagataaaatatgttcacagaattagtggaaatttcctttaactatggagttccggaaatttgacatatttgggtggccttgaattaagatgaataataccatcctctcaaaaaaaaaaaaaaagatacagttgctcactcatcaaaagttctaacatgttaatgtggctatttccactgccattaccatatctcctaagaatgctgcaatttctcagataaggcaaaagtcagtttatctgagacagctttcttccctctacatgatttcctagcatgctttaactgtgtttatgccagcatctgttaacttcaggtctcatcttcggatcactatggaagaaaaactaaaggcaacatattgcctttatatgtgacttgaaaccactgccagttcaaaggttacttttttccaactgtcagaatttataaccaactcaccttgcagccgttgaaggaaaagaggcttgaatatttttgccagaaagttgactggatggcatycattaagtgaacatgaatgaagaagtttcaataatgatttgggtggaaaataattgaaatgagtgaatagcacgttttccagctktctaaataaagcagaggcatttggtggcaaataattgagtttcccaaatggttccattaasgcagaaatctgacgaggtgaaaatttttctgtttggcaaacaaaagtttctgccactgcattgaggatgggttttgaaagaatcagttctctactgcagtactccatgaccctgcagacaacttcaggatccaacgtgaggcacaccgcagctacacgatgctctagggcttttgtaaaaaatgtgtcatggtgcccaaaatatatgaacgcctccaagactctcctaagctcctcgttagtgaaatgtgggacatgcctcacgacrtatttgcccaattttataatcagaggaaatgcttgactttgatcaagaaccaccagggcagtgagcatttggctaatcaatttaggactcaggttggaaactattgatagggaaaagttgtttatcttatttaaaaatgtttggtgttcatccactttttcagtacatgcctgcaagattctataaagggccacaatatcctccggggtaaatgtttccaatttttcaccttgaagttgatttataatgagttctagtgtcacacaacctgaactgtgcagtgtaatcagactttccccaagaatacaaagattgcgaacttccatgccaccttttctgagacgattttggcattctgccaccaggttcagcaacaggctactttgaggatccacatgcaacagaatcagagcttgcaaagcagtcactaaactagtgtttgacagctgtgagggctccttttcaaactgaaagcataaagcttgaaagatgctattctccagtatttcttttggcagcccttgatcaccatcctttttttccacttcacaaattcgttgtaaagctcctgctgccatagtgtcaggcagggtttccatcgtgcttataaaacttagcacttcttctgatgaagtcaagttgctcagtctcctgtaaaacatctgactctcctcatttttaacattttgttcaagcctgtcgcagtcagatacttgagagaacactggtccaccgagtggatgaaggtcatttccatttttcgaatgaaactttttacaatgggcatgatggaatytgaccccgaaaggctcaggttgtcgtgaacacaaccaagggcacagacgctccttgactaccttgtgaacatgatttagaggtttattttttaaagcagccagagctctatgcatctgaaaatcagataaacgataaaggttcttcctcaaggtgattaatgccataccatcagattctcaatttgataactaaattaaaaaatttaaaaacacatggttaaatacattgagaacatgattgacccaacatcaatgtttatgaaactacaaacgagtatctggaaaaaaaaaaaaaaaaaaaaggatggttaacatataaacaccagaggggcaaagtctctgcatcctagagttagaagagtggctgacattgaacaataacaatcgctattacttgctaaacactgttgtaggtattctattaacttacacagattcagtacttttactatcattttacacgaggaagaagttgaagcacaaagttactttgcccagtttatgcagggggttaagtggcagagctagggttcaaactcaggcaatgtagctcttaagggtggcccttaaatgttggttgaaggaagaaattgcatttggatagaaatcaaagaacaggtaaagtgggcaaaattaggcgaggttagagcaaggcaagggtaaaaacgcgctggaaaggccctaagctgttggtttcccctcggtgtcgggagaaggttagtgttgaaggaaagggtctactttgtcaatggaaacaaggtaggaaaagaaaaagcaaaacatagatcaatgaagggagaaggtggggcggccagtccagatctaaagacggtgcggggggatttggcaacacgtgtgtgcaagacagacagacgggaggccccgcggcgcgttttcctaggaatgaaagggacccgcggggcgagcacccccaaactcggcgccccggggacctgcgctgagacacgggccgggcggcgcagcctgaggagaaagccggccaggtctttgacacccagccggaccaactgcgcggagaccccgcgttgacacctaccgcgctctgccgggcaatcactccgggtggtcgcggaagcgcctgggcgtcgtgggcctccgtagcaaacgcggggcgggagcacgactcagggcggcgcaatgtgattggcccaggtccccttcggagctttctattggtccygggtaccgagcatgggcgctgcgtcagtgcgcgctggcgcaaggttggtggaagtcgcgttgtgcaggttcgtgcccggctggcgcggcgtgggtaagctgcctgtcggctacggttcccggattccggccgctcgccctgcactaatctcctgggagaggcggcccggggcgggggtgggcagccggcttgcgcccgtggttcccacgcccttcggcctccgggggtcgccgcgggcgcgggctggggctcggacttggcctttggcctttggctttggtgtccccgggagcgtgtccttgggctcggcgtcggcctctgccgcgggaggcccctgggcggcgtggggtctctcctcatgttctgcctttggttctaggcgctttccaggcctagggaaaccgcactcggggacgcggggaactggggaacatgccgggttggggcggcgcgctccggggaacccgggacgttccgagcgcccacccggcgggacgcggccgtgagttctgcccgcggccgtgagctctgcccaccgcctccgcgccgcttccggggctgctggggcccgggcctccgctgagagtcgtgggaaggtggtgccggattgtggggcagtagcagggatgaggggttgattgatcctgggaagccctcaggatgtgtgtttcatgggaagtgatagaaattttagctgtagtaaggttttcattatcgtttccaccgttttctgtgagctgtcaatgtgtagtgttttcatattgtttattcactcattcagataacttatcgagtaccagtttcatgccaggtgccgttctgggcggttcattcaccgaaagccaagmttttggtttggrtttcagtttaaatctgtctctgcaaattgacagcccaccaattttagccgttagatgagtatggaaaaaaatctgtgagtgtcgtttgttttactactgcttatctcttgcggaaaaacgtgttagtaaaatgtttaagtggattggaaatattttttcgttatatgcacccgtttgtatatatgcccatacactcacatatttttgatttgcattaaataatgaaggagagtatgtgcttcagttacctttagtactatgattagtttgtttagcgttaggatcaaataagaaccaagaatcctatcattttaatatagtttttacttttatctttttttaaaaagaggaaaccaaaagctatttaagactgttgtgaatgatactgtggctcaagttttgttcaggttcttggcttgtgccacatcgtttttcaggtaggtggtaatactctcatttttaggataaaggagctgtggtacggatcatttggggagcttgtctacagggttgcacttaggaaacacagattcaagcccaagtagtttcgagcsgatcatctgatttctgagccatggaattagagtttcattcgtacactctccttaatttgatgaattcttatttaggctcatttgagattagtgctgaaaacaaatttagaaaaggccatttcatattatgtgtgggtattgttgcattgtttcttaaagattgagggagaattaatatctttaggttgttactgcttcattaaaaagaggatcttttttcccccatttttcagtttcactgttacatgccttgaagtgatgaggaggtttctgttactatatgctacacagcagggacaggcaaaggccatygcagaagaaatrtgtgagcaagctgtggtacatggattttctgcagatcttcactgtattagtgaatccgataaggttagagccgttacagtggattttaccgttttgtgctttgaagaattttggttgggaagtgatatttatgaaacaaaaggacactaataccaccacatagtctttgttttttaacagaaatgtgtttgttcaatggtatagtaagatatcaccagcatttttttaatatagaagtgtgtagttgaattagactaaatggtctcaaaaattgaaacaagtaacaactcaactgtaaatgacagaagtagcatatgctgtgtctgtttcacagggtggctgtgagaacaagtgagatgtgtgtttgcctgctcaggtgtgctttccacctcttgaatctcagtgtcccacttttttccccaaaagaaaggccttgccgtgcgtgttagagttcctcctgatgaaggaccgcctagattcttttgtgaaatagaatttaaagtagtagtgtaaggatctggaaaaaactcggctgcttcttcagggactagttgtttatgttcagtctctgcagaagttcctaccttagggtatatgcaactttaccatcttgtgttcttttatttagtttgctgcctccagattatactatttcagacaattcaggcgataacagttggcaggggctttataccacaagatgatttgccagccgctaagcagttaaaattcacttcaacatttcagagactgtcctgccagtgctctctcacccaagtgcacaaccctctctggcctttcctaaaactccagttcagaacactagactgtgtgcagctcaagtgaattataaacccagctcacggaaggagactcacctagttcctttatgcagccctgccacggtaactctggacaccagagaaaagggagcttcctggaggagactgccagtcagcagactctgtcattctacagtaacttaagttcagattgcagtgccacatgatgaagtatctgaatctgttactttggacaaaaccaaagccatcagtatcataaaactagtcctgatttggccccttgtggttgacctcagtaagttgatcagcaggtgttttggcagtcagatgaatggtgaattttttttttaacaccaagatagtcatgctatttatcctccctggctgatggtttcgtctagctgttcataatctaatatccttcctatttcacatagtccttttcaaggtactgacattacttatacaaactctgtatgtagagtttaacacacaacttacatagagtcttggaagcattaaatacttcggtaaaaagttaagttgttacctcttttatcagtgtgaaaaataaggtgaattatttggagccaaattcgatggtgttcatgggcagtaaagcttgtggagtcttacaagtaagacaaggaagtgttctatttgaaatacttaaatttacacgagagtaagaataaagaaacttgatttgtaagagtttatagctcagcttatagctaatgatattctcagagttaagacagtgaaatgctctatatgaaatatttaaacttacatgagaataagaataaacttgatttgtaagagtttgtagctcgcttatagctaatgatattctcagctctctggaaacctgagggaatgagcggttcttgatagccaggtccctgatttagaaggggtaacacttttaatttcccagttttaaaatgccctgttatccctctgccttagtgtcacatgcagtacacatggctggttttatattttgctgaagatttcagagctgttgtgtttttattgctgtttttctttaccacagtattctacttgttgcttccttgtcttggcattctaatcctgagtgcttatgtatcagttctctttatttctgagtctccccatccccattttaacacctctttccttgcttttttttactttcttatgaaaagacgtttccacccagttagctgctgttcctccttggcagctcatcacagtgcctaggtgcctcatcttggctcttagcagtgctgatttgccttgcagatttgagctcatgttaatgtttggcccatgactcagtggcaaagagttgactatatcctatttcctctgatttttctaaaaatgaaagactgggactagatggaaacctgggatgggtactgtctgtgcctgtccctgcctttcgtacacaacatgaagagaaagacgtgttaatcccccccaacctcttgatgagcatcaacaaaacagacgcatggtttccttgaatgacatcctgcattaggcaaattgattaagctgagagcgcctagtcactggactggtcgtctcaaaaaaactggcaaggaagaagattgaaatacaagacaggaaactaagctgattgctttgctgctgagttaaatcaaaaatgcatgtagtgttaggtccctgacttgatatccttgttttgtagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtaatggactctctcttctgatcttactatagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaaggatgcacctcagatgcagccatgaaacattttcagaatagcagtggctgggcctcatcctaaacctactgaaacagtccttgaagaagcaacccctcatgccattcctccatttagaaaagcagaacaaaacaaaacactcccaatgattttgataacttctctaagaacgattctcccagaatgaatgattttcatttcccagctacacatcaggattagctaggggagtttttactaaattatatgacttaggcccacctccagtgattctgatgtaattattccaaggtagggccctggcatcgttatttttaaaagctcccaggtgattctaacatatgtatcccaggttaagaaaaactgacttaggactctgtgaaccatagtttaaaaatgttaaaggatcaaaagaaccagatcagcacaatatgataccagaggggaattgagggtctgcattcctgacttgtgacctatgttgttttatctttgaggattattttttggagagggtatctagcaaggatgggttgagtataataaataactgattagaaatttgagattgtaaccctggcaatgatctgtcatatataacatgttcaagagagtatttcacagtatttataattttttttttaccttaagtttttatactttctgtattttcaaagagagaacacatacttgtttgaaaatccagaaaagacagaaacagaagcctgtcccactgttcgagtcaatgttaggcctaagcgtggaaccactcatttctcacccttttgtagagaaagaacatggagatgcctgcacaactgagggatttaagctttttttttttttttttttttacaccatgagacatagaagcaattcttgatttccccaacacagaaacataccacattgttaattgtggttatttatatggctggtgtacctttctttctatatcaggagtcagtaaactctatraaggtccagatagtaaatattttaggctttgcaggcctactcaacgctgctgttatgaataatatgtacacaagtggacttgactgtcttttaataaaactttatttacaaagaaaggcagtgcatggtatttgtcccaraagctatggttggctgacccctgctcagtatcagaaaaaatgtacagatgacagatattgtggttttgcaacctgtctgatccttgttttaagatttctatatttttacacatagtcatggagatgaaaatgtgaagtcttttctttcaacagcggccaataagtattttgtttcattatatctgctacttttatattgtaaaatagaagaaaactgcctacatgcatagaattactcaaggaaaataaaatgtgaagctctgcattattactccatccataagagcatgaaatagtattattttagatattttatttasctagtctttgtgtccttaaatttaaactttattgtgcattaattatgtatttgggttctctaggtctyggtgattcagaatacacctacttttgcaatggggggaagataattgataaaygacttcaagagcttggagcccggcatttctatgacactggacatrcagatgactgtgtagggtaagggcagtgttctctgtttactccaataagccctctatacatgatggaagttgatttgtaaaacatgtcagcttttcacttaacactgaaattttcctcatgttttacttttgttcgcttttttagctttaggatccaagagggtcagccagagattgatttacctattttgctgattttcttttgtgtccatctcatccttgtcagtatatgctaacggcaagagttagaaaaggtgctccagtacagttatctttattttaaacagtgtaggtatttgcagaaatcagcttgttctttaggaactttaatcgtgcatgtgcttctctctgccatgcacgtggagcctttggattgggctctttacatggagggagcctggtgagccacacttcgctgttagagaacacaggtctgtgggccttcgctgcaggctgcattgcttggcgtgctcttaccgtctgaacggccrtttgccaccatgccaatcagacgtttacagacgcatactttatcttttcattacttttatttttgtttttacaagtcagtatttcacccattgtgccacctttcaaatcatcctgatgtgtttattcagtggtcctacagatattgtcctataacttacttagccttcaactattttagccagataacagcacacacccttaatttttttctagtaggtccatgtgttaatttaattttcactcactatgttactgaataatctgtttatgagaaaattacaaattcagcaaatgtcttgcttttcggcatactgtatttctgcygaactcacccctgtgcccacttcttccrtctttcccttcagctctgatgccatgggttttttccatatcgccagcacacatattcttcctgattgtgacaaagctttgtgacatttccttgggaattcactttagctctgtacctttatattgagcttttttcttttgccagaagctcattgacattaaatgctcagtcttgtatgagctgtgtttaactgttaatgtaatgcttgtgtcatccattaggcccatcactcatccatatttcacttctcttcaaaggctttcattttctctgttgatttattggtgtaagtattraaatgcttgactgtatatttcagtagactatagtgcttagattttcaacctaactaccttacttgaatttttcctttttctgaaatgaagatattttcaagacattcttgcttgatgtgccaccacactaaatggggttrcgaatgcacacttgagtccaatacctgggttcaaatccttgatcccccacttactgactgagatcttggttgaattagttaagctttttgttccttggtttttgcctctrtgcaatagataacagtaatctatttactgtgtaagcttcgtaggagggtcaaacggattaatacatgtcgtcctcttagaagagtgcctgtcgtcatgtagtaaacactcagtgaacgttagttctcctcctggttgtgcacactatcaccttaatatttctgagttgtgagagtgatattttacatgtagctgttattgttgaactgtagttttataaacttgttttcacaaaggctcctcagggcagctctaatgtgtaaccacattttgagtagtgtaccacatgagcacctcccgagcacagtgaaatgacarcctgagtcataatgacacacgggcctgaaatctgcctcctcttggtattcatttcgctttaggaattagaatttaattgatcctcctttgagctgtgattaaaagtggtgttatttccacagccctgccacagtcttatccactgactctacttaaacttctctgttcagggaatggctgttgttatgataatttgttagtagtaggtggactgccacatttaaaaaatctatttatgatgaattcaactttcccaaaggagggttgctttttttttctcctgttgtcagcctccctgggaattttactaaartaaaaaaataaataaaggctttaactatttatttagtccaaggacttggcattaatccatagtgatttcttggtgatattttaatctgtaggaaacagatcagtagatcagtaaattggctaggcaaaaaaaaaaaaaaaaaaggtgcwtttgatggatggaatgagcatttgcagcattatggtagccttggattttggttaagttctgttagcattagtatgcctatttaaaattatatcttcttaaaataaagtttaccaattctggaatattaggaggaattctattcctgtcatcctattactagaatatcttcctatccctcttcatttcttytacctttatacatactcatgttttcagctacggtgctaatgaacacataatatatcctgcttgttaaaacttaatcatgaagtattttttgtattccgaatggtcttcatagtgtttctaacaagtgcatactttgccaaatggacagactgtcattatcctgttctgtgttcagatggagaacttaggcatttgttttgtttttcgtttgtttttactgtccagtttagaacttgtggttgagccgtggattgctggactctggccagccctcagaaagcattttaggtcaagcagaggacaagaggagataagtggcgcactcccggtggcatcacctgcatcctygaggacagacctygtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagwctcttggccaggtaaggaagtttttctttatgctatagatgctatttaatcatggatgtttgctttgggcttttaaattattattacattagaagagaggtcaacaaactatggcttactggcccaatgtggcccagagcctttcttttgtaaatagattttactggaacacagccatgcctattcatttaggtagtgtctatgacagcttttgagctgcaatagcagagttagtggttaccacaggggcctgcaatgcctaaggcatttggccccttccagtaaaagttttcccacccaggtattacaaaaggtcttgtattattacttctgtatttgaagaagtagataagaactcagtttcatcattattttggagaactaacaacttggtttctcattttagatgagtcaaacagagatgagttgtgtgggcagtgagttgagtatcacattgcataatagctaatttctccccacaggcagtgtatggtaccctgaagtttttctaacctgcttaaaataagtttccagagcaggcagtctttgaaygcagggctaagccctctwtctgttgagtggctgtttggagttccacatggacttttcttacaaaaaccacacccttactgcagctattaccagttttaatttcttgttttttttaatgaagacagatttagacatttaagaaataatttggatgcagcatctttcttgtatattagcactgtttgtaaacacctggtatgatagcaattttttttagcatcttttataatgtctttctaaagctttcatgtaagtatgattttgtgtataaacaactatgggctattgtttttgcacttgtacttcattattttgtgaattgtttaagtgagataattgcagtaagtgtatctcagtctggtttgggaacagacacaacttatgcctggactggtgggagcagagtgcagtgttgcaccacagacaggatcagttcatggcagcggggatagagattaatcattaatctgactaggagttttaaattagccggaagatctgttaagagtttatgggttttttccgggaggcggaggttgcagtgagccaagattgcgccactgcactccagcctgagcgacagagtaagactccgtctcaaaaaaaaaaaaaaaaaaaaaaaagtttctgggttttttcttaatagaaagtgtcattaaataggcttgagttgttaataatgtagttaaaagatttaacaaatctgaagtacttaagagagacaatataaatatgaaataatatactgagagagtaaagaattgggaaaaaaagaatgttttgtagggcatcctcttgggaccattgccttgaggcacagaggggttggaagcaggattgggcacagtgagaagctgagctgcgatgcagtctcaacaaaggcctcagtcagctcctctccatatggtacctttctgccatgtggaagtattacctctaataaccagagggtcttctgggttgtgtggtagagcrgcaggacctgttaacgagcactgtcacttggayctgctgtagagccctctcctgctctgggccccacgcaaagctggtggccttttctgtcacctggtatttgggtctcagcagtcctcccaggtatggaatgtgctacccacagatcctgaagagacttagcagtggttctgcttctctctagaagtgaggtacaaggtgcactagtgtggccttyacttgggaggggatgtcctgacgtgcaccaaactgttagaaccctaaaaattgtgctggcactgcaggccctttaattgcatagggcatgggtcttaccaaagaccgcactgtcctggcyactcctcgttgctcattcagtctgatagcacgatgcccctgatagagtaggctagtgtggtgctttgcaggtgttccacatttattcagactcttataacagcaggcaggacttatgatagccctggggcataattgtaaatttatacattgttccagcgcaaagtgaactgtttctgatcctctttagtgatagggttgggaaggagcactttgactaaatcattgtccgtgtacctgaggccatgctagtctactttgttaaggaaaaccagcttgcacggaggttacagtggacctgtttcttgtttgagtttccagtagttcagtgtcatcccccaggatttrtgtggtttttgcagtggtcaaactggtgaattaaatggagatacgatagagaccatcccctgtgtcctccagctttttaaggatgtcatttctctcaggatgctattttgtttctcttgttctatcttggtgtttagggaggaggatggcgtcaaattcagagacttcttcttggccctccccatgatgatagatcttaaygtcataggccaataattcggtgttgccctgtgccagctgctgagtggccactggaggtcctgggccaggacgccatttaccgcctggcccccatgtgccttgctgtcatagatgagctatgctgatgctttgggtccctgggtaacaacattcatttgaaccccctcttaacagaccctggaatgtttgcayattccccttagcccagtgtacatttcccctttgggagaaggactgcagaagccattgtcaagtacagtttctatagtgtctcacagtccctcctcctagggacctcttctctcctacagtcagtgggttgcaggtctggaaacagggcaaaggatcgtttttattggagcagcggcctacagctccttttacatgcctccttgatttcttttcattgtaaggattgatccagtgcctttgtgggctgcccattttttacatctgtgttctgccctcctcaatttaggacctcagctgtgttgtgtgcattctctcctagctcctgtgggggcatagtgctctgtcgtatactttcttaggggttagtcccttaccttccttagctagcccagtgctttagtggccgagtgtgtcgcaacaaccccagttattggtctagcaaccagaagaggggatggggtgtggtagtgggggtacaggcatgtgctgtgggcagaggtccttacaccatccagatgcgagaagggagttcttactcttcatgggagggactggccacatctgcaggctcaaagagttcaagggaatctgggtaggaagatttttaagggaatctgggtagtcaagatttttaaggcgttctgggtagtcaagatttttaagggaatctgagtattcaagattttttttcccagttagtccttggctttctctgccttcactgtcatgggctgcatgagatgactgtgtctttctaagctcctgaggatgtcccctggcttagttctattttagttttacttasttcttaattggtgatttgtcctttaagctttttgcattttttttcaagtgcgagtgaattttagcagtagccccccaagtcccaccagtcttctcttctgctgtttctctctagttctcaagcacctgatggatcttgcaaggtgatgcatttgcttccactggcactccctgctacttacggttgcattgttgctgtgtgccagtgccgtctgtctgctctctcactggtgtggtgttctcattgtcaaacaggcagatgatccagctctagactccattttagcatctttcccaggctaccctggcactgactgtcacaggctggttcccaggagtcaaacaatgagatgtttttagggcatcctcttgacagcatcatctttgggcatggagggatggaagcaggattgggcacagtgagaagctgagctgctgtgcagtctcagcaaaggcctcagccaatcccacagggttctctggagctggtgggtcttcagagttgtcctgagttggaacgaagaggctggacctttgtagtctttgatgagacattggatgtgggttgcctctgaaaggaggtgtgggcaggggyaaggtgtgacctaagaatgctgaagtgtttctttcaggtggcagaggtagtcattgtcagcactgccatagcctttgcagraggcagtcttcttaggggtacatctcagtacccccacattatggctcccagacacccagaactgaccttcatcccagctttcccatatagccacttatccacagttaattgactagtactgttaaaatattttgtttttaaacttaggaatatagaaaaggagtagggagtattataaagaactgggattttttgcagttttccaagacctactgtgtccagtacaggagctgctggccacatatagctactcaaatttaaattaatgaacatttgttaagattaataattagtttcttagtgacactacctgtatttcaccagccatatttcagcagccatatgaacagcattgccccacactagggggttcctgtgaccatctacacacatgttgcattcttaaacatctgtcacattcttcaagatctctccttcctgaaacatttgcagacattctgtttcccttgaygtagtttattaggaaaactactagatctttacatgaacatgccagtatttttattttctatttgtatttcagaaattctaatgtctaatagataaagcgtttgagatagaattgagcttctcttctgaaaagctagctccatatatctgccctcattcatttaccttggaaatgaatactgagtagccaggaagttttgtaagcccctrtggatcttgcgtagtcactaattgaaagaagggtataattgaaaattgcacttacgttttgtcacrtttgtttttcaaggaggaaagccaagtatctgtgacttcagcagatccagtttttcaagtgccaatttcaaaggcagttcaacttactacgaatgatgccataaaaaccactctgctggtagaattggacatttcagtaagttgcaaaatttatttctcagcacagtaatattgtcaggatgtgcagaaagagttgtgtggtgcttggttatatatgctgagtggtgtgctgcttggttacatatgctgagttgtgtgcggcttggttacatrtgctgagttgtgtggtgcttggttacatatgctgagttgtgtggtgcttggttacatatgctgagttgtgtggtgcttggttacatatgctgagttgtgtggtgcttggttacatatgctgagttgtgtggtgcttggttatgtatgctgagttgtgtggtgcttggttatacatgctcagaagaatgagaggtctctgacaggacatcttgccattttattcctgacccatcatttttttctctcttctattttcacacctattttctttccacttcagggaaggactagggaagaatggctggaggagattcagcctgagaggaagatgctggcttactcaataagccatgaaagaataatgggatcagaacagcattttatatataagaggcccaggaaaggaagctgtccactaaggtcagccaggaagttagaaatagagcctaaggtcaaacgaggtggctctcgcctataatcccagcactttgggaggctgaaggcggtcacttgaacccaggagttcctgggtaacatggcaagaccttgtctctacaaaaaaatacaataagtagctgggcatggtggtgtgtaccgatggtcccagctacttgggaggctgaggtgggaggactgcttgagcctgggaggttgagactacagtgggctgtaattgtgccactgcactccagcctgggtgacagagtgagaccctgcctcaatttttttaaaaaaagaaaagaaatagaacccagacaggcaggttagggttaattcctcagagcagtggttttgatttcttgagaatctggaaaaaattatggactctcccraaaaatgattacacttgtcccttagtatcttcgaaggatttgtcccaggacccctttcagatacccaaatcctcaaagctcaagtcccttatgtaaaatgttacagtatttgtatataatctatgcacatcctcccctacactttaagtcatctgtagattacttacagtatctaacaccacgtaagtagttgctatactgtatttttaagtttacattatttttattgttattttttattgtttttttccgtcccaaatattttccattcaggtttggttgattctgagggtggagaacctgaggatatggagggccaactgtatatagaaacatttacgtacagttttagtctgagatgtgcctcgatgcaccccctccatgggcccccttcctaccctccacaccctgctggaatccattgaccttaggttaagaaactgactgataatcctaaaataagtgtttgagtacctcttcaaagtcatttagctcaaccgtttattttatgaaagtcttgagaggttaagtgggttattctttcagaaaagcaagggcacattaaggctgttggtgtagatttaatcaaacttcctaacagaaaaaaatacaatgtgtcaaaactagatggttttgcatccataaatattaatactatgtacaccaaaatattttttattctggtattttacatttttgtcataaagaggcaagggttggtctgtgcttagtccagtctctctcccttgctggcaagaaatgtgagcttgtgtcattgtgagaggctcctccccagagccctggcctgcatctgtatcactctggggcttagaggcartgggcctagtaatagacttgacttgggaagtggtgactttttcagcccatgtttgctcacaaccagtatcgagccagatagtgtaatgttttatacttaaggaaataaagtaccctttcctgtcccctaaaggaaaagagtaaagtaaggagaagaaaattgaaaaccaatgcatttgaccataattagtttcttttggtcataatgtatgttttcgtgtgtgtgtgcatgtatgtttttgtaagagggatttttatatttacatgggttattgaaaacaccataggaccttactttgtagagaacaaggaaggtctgacttccattctttaagtatgataaaaggcaaaacactgggtaactaccagatttcgttttaatagtaactgctaataatgaaagtatgtttatttggttagttgggcttattttttaaaacaattgtgtgtttttttttttgaaattctattttctgagttcacatattaaaatcataatattgaaaactatatttttgttaccctacagcttaaactatgtaacacgtataatgtatttttttttttttcattttggctcttctctagaatacagacttttcctatcagcctggagatgccttcagcgtgatctgccctaacagtgattctgaggtacaaagcctactccaaagactgcagsttgaagataaaagagagcactgcgtccttttgaaaataaaggcagacacaargaagaaaggtaacagccctgatgctgtgacgttggggtgttgtgggccagtggactggagctgatggtgagagtgtggctctaaggttcagggtcctgtgtgttggccgcacagatgcctggggctcagctgcgcatcaaggtcygggaacacaggcatacgctggtattgstagtttcttaactttcatgttaattgcactgaataagaagataatggatgttctaattattggacatttgtggacatgaaaactgagtgtaaatgtagtttttgagaagcattggcctaggttatttttaaaaattcttttcctattatgtttacttctcatagtatgtttgtttttgctcatttattatataaaataattgctttttccataattaagagaagttatttatttttcaaaatataaatatattatttacttagaatcttgaagtagtcctaaattgattttttgagaagaataatgctaatggagtactgctgtctttttagctttcatttccttaattttaaataattttcctttcttttatttggcctatcttgaatttatagtcttcttatgtttttgtaaggtggagttttttactgtattcattttggggaatttttttggctgaataaacattgccacaagtcatgttgcactttgatgcgctgtaaagtactamagtaattgtgttttggggagtgtgtaaaacattttattcttcatcttctatgtcatgaacccctttcccgtctttacctgaaaaggagctaccttaccccagcatatacctgcgggatgttctctccagttcatttttacctggtgtcttgaaatccgagcaattcctaaaaaggtatttttttctgtcttcttcaggtaactattttaaaatatgcttagctttatttaggattgattaaacaaatttagaatatgccctttgcagtcttaaaaaatgtgatcttgatagcatgtttttaatattagttcscaagggtrtgtrctatcatcgtaactatcatctatgaatctttttatgttgtatttgcatktaaatttttgttttctattgaaatgagggcttaaatagggctttttcttagtctaaatagggctttttcttwgtcttacttttactagttattractacgtagcacattccacagtgatggaggtgactgcagttgaccttgtgttacccagctacacattgctgctccttctttaattggtgacagaaagctaatgagagcgtaggattccccccaaccaccacttgccacttcctacagttgttaagatctactttgtgtaatactmcataactatttattgctgtaacagaaagcttcaggaaaaatggaagggttttggtaggtaataatcaattattatgtgaacttggaggtagaataatccactagatgtcagtattgtaccaggaactgtttttttaaaactacttgtaactgatttcttctaaccagctccyggaagtggccattaatggatamaatttttcaratgtgccttgccacacttgtattgtcagtgagcataaagagtgttgtaattaggccgccatctccccagtgtggttttcgtgtcgttttattaatgtgtttattgcatttctagtcttgggtgagtaaagtactttagagagaggctcagctctctaaatawatatatgtatatttatatawatatagatttatatatatatatattccatcttcctttcctggtaatcagctcgagatgtaatttgagtatttagaattaatttactgtaatgaaagcttaccgattaagtcacaattttggttcagctctacccttttaaaatttgtgtaaagtgtgtgtgtatgtctgtatatgtgtatatatatgtgtgtgtatatatgtgtgtgtatgtatatatttgtgtgtgtgtgtgtgcatatatacatatatatatatatatatatatatatatatatatatatatatatatatatgggtttttttcaaaaatagtatgctcattggaaaaattctggatacagaaataacccrggaaaccaaagtattttataatcaaaccctctgagttaacacttgaattttgttttcctgaggaaaatatgggtatccatattatatgtgctgttccataacttgcctttttaacttaaatcaagaatctgtatatttcaggatggaaagagttttaatggatactatggatacaccattatttgttgatgtaattatgggcaattgagtcattttygctttttcactattaaaaaaggcaaacttycttgtactgtattaatttttgaacacttacttgaagtatatttgtaaaacaaattccttggagtagaattgctgttttaaaaatatttacattttaaattgtagtaatgtttgtcaggtttgtcatcttgttctccaaaaacagtgcagtatttcctgttgtagtaccataaagtttttgtagttctaaagtgaaaaaagtatgttaaaggaaaaattgtcactgttttagcttttaatttaggagattgtattggctttagaatttacaaactgttattggtagatgtttttattatcttgccaaagtctttgcagagatttggggcgtccattcagcagtgtttcctgagtcgttgtttttggtcaatgctgagtttggcacttggaggaacacgtgtaatttgttagtgtccaggtattttagacagagattcttcagccaaacctttggaaacctgtgactcctttgggaacagtgattttgtcctccctgttaaggaagtccaggacacaatcatcttgagccatggaatttaaagtagcagtacccattagcatttcacataacatttgatgcagataattactgaagtgctttgttcctaaagagcccttgagaaataagctatgtctgcctgtaattaataacttgtaattgcattgaaataaaaaattcttactagcaagtttgatgttttgttcaggaatttagactttgagaattgagattcagaattttattagttttatttatttatttatattgtggaatttttctaacaggtcaacattaaagcaaatggtaaattaaattccctcctcctgacaatagctcctagtggctttctcattttttcttgggtaattgggtgcatccctaggcagacatttaactgaatattctaatagctctacccacaaattgtgtcacaatttaaggcggrctcctttttgtaggcatttttrcgagcccttgtggactataccagtgacagtgctgaaaagcgcaggctacaggagctgygcagtaaacaaggggcagccgattatagcygctttgtacgagatgcctgtgcctgcttgttggatctcctcctcgctttcccttcttgccagccaccactcagtctcctgctcggtgagtagtcgctttcacaagcaycttggtggctgttcgtgcactggtaggcgggccacctttctgtagtaaagaaaatttgctgctcttgtcttaccctttgtatcctatgcctaaagaatatatctaaatgaatggtggtgattggtaagtaaacrtcttatatcttgtcttcagggtgctgtgacatctgtgtgcccttccagaagtcacagaattccccttccagacttttggttttcttttttttccttccagcagtgtcactatcattttctctcttaatagagtcagttgttactctctttttggctcagaattgagcatcttttctaatttaacttttttcagaaaggttgtttagctaaatgtctaaaaatgagcttcctataaaattttctttttcaaagctaacgaacatcatatttaattgaaagaggctgatgcagtctgtgctgtgtgcagaatgcagaaatgcccccatctgagcaagtccagatcgagggtccttcaagagcaaaaggggactgtgtcgtaccagtgcaaatcaacatactcatggtactgccaggcagagaaccatcatcccatttcagatgaagagtaacccatttttttgcccagagtgactcttctagtcctcatactccaacagaagagacctcarcattgtccctgagcagtcgatgtcctaggacctctctgtggctctcaggaagggattgaaaatgcttgctaggggtgaagactaagcgctttataggacttcaaagcctttattactttcttgtgcttgtaactttgtcatstcctttcccatagtggtaagtagttatgcctttaacatttgcatttttctttggtgacaccaaaatgtatattgtcctttttactcttgggccagcaagatccttttcgatgcccagtacaattaaagrcacccttctttgcaagtcagggcctgatttctcctcctttttcttagtgttttttccacttaggacctccccaaaatgstaagaccgtgttgctgaatgaggctgctcttctcaccatcctgtcctcaggctggccctctcaccctcttcagtgaagtcttcgagaaccatcagcaggaataggatgacagaacacagggtggggagttctaagtagtattagaaagttctcttatcgyatactaatttatttcaattcttttcgtagattttttgttaccttttagaatgttagaatgtttgtaacaataccacattacgtagttatataaaaaaattaaagtcattgggacttataaaaaattatattattttctaattaagaacaattaaaatatctaaagcttgatattaagttgaacaccctactaaaccttattttgatgtttaaaactctacgccattatacatagaccttttcatattttcaattaagtaactgctaaaaataaaacataccaaaacataaaacatttcaaagtttattagtggatagttcaatatttaaatacagattatttaacctgcttttgaaagaatacctacgtattttgaaatcactgattttttttgataaatttttaaaaaccaaacactttaattattttaaatgtaagatggaaaatatttcaagcctaagcattttcagtaattcttgaaagagtagcctttaatctttttgggatcatgactttattttaaatctgaaaactgsgcacctccctgcagaaaactgcacatatacctagtaagggtttgctgagctcctcacctctgaagccaacttatggacccattcctagaagcctttgcttttaaaattcgcctttgggtagaaatactgatttaagagtaagaaaatgcatcttatctggtttttaactttaggagttgaaagaaaaaatagtaatattttacttgaacacaaagttcaagtgcttaactatgatttaaaactagaacatgatttgagtattctaaataagacatggaatttttttttttttttttttttaggtaaggttattttcagtagtagtgaattaataattgcttgtttttatttttttctagaacatcttcctaaacttcaacccagaccatattcgtgtgcaaggtactactatttattcacgtaatatatagcattgtttctccaaaatcttagactcaggcttccagatcattagagtttactartttattcagtgaaaacttacctgctttatggaagacagtaccaggcataataaagcagaagaagaatcatagagctcctgtcctctgggacttcatagaatttaacatcttgggtggcttcccatggcccagtactatgtttccccacttaggagtctcaggctcctccacatgcttcctgtgtccgtgtgcccagccaccttcactgagtggcagccggaggcaggggagacagaaaagttccactataaaacatttgatgagtccgggcgtggtgactcactcctgtaatcccagcactttgggaggccgaggygggcggatcatgaggtcaggagatcaagaccatcctggctaacacggtgaaaccccgtctctactaaaaatacaaaaaattagccgggcgtggtggcaggcgcctgtagtcccagctacttgggaggctgaggtgggagaatggcgtgaacccgggaggcggagcttgcagtgagccaagatcgagccactgcactccagcctgggcgacagtgataccctgtctcaaaaaaataaaaaaaaagaayatttgatgagcactggcttataggattctccctgtggccttcattccattgcacagcctctaccgttttcccgtctggctctctgttttgcctttcagtaataatacaagaaggtgcaccattcttttggttgaaargggaattaagaatgaactcaagttctttcgcattatttaccgtgtaatgtgaaaagaaatctacttttgtagggatgtcttttaaagatgtttttactttgaatttttagttttctcctttctgggtgtatacttcagtcactttcaagttttatgatcttaccagtagataatgtatggatatttgttagaatttatccccatttcttcacatctttataataaatattgagtgaatgaatcctttacatgaagatccttagggcatattagattttataaatatcatctagtcctagtgcaagcaaataaaattggaaactttcttgaatawcaaaatgtagggtgtgagagtgtgaaggttgggggcagtttttaattacgtaataatggctttcctctgtgmggatttggaaggtagattagagcctataaggaaatatttctaaactgaataaaaggattggtttgacccatatgtgtagtagtactgatatcgagttcaaaacttgtctgtgtatctttgcagctcaagtttatttcacccaggaaagctccattttgtcttcaacattgtggaatttctgtctactgccacaacagaggttctgcggaagrgagtrtgtacaggctggctggccttgttggttgcttcagttcttcagccaaacatacatgcatcccatgaagacagygggaaagccctggctcctaaggtaagaaattagtaccttaacctcagcattgttaactcatactcttkgtttcaytagaaaaaacagtgttgtctcacccacatcattcattactrtcataagaaaatttatgctgttcttgaattttaaaatctctattgcaagagcagaaaactgtttacttccatgtactctttaactagtgtgtgtattttctgaatgtataaagcatgaattttatatagtayggtctttgcttgtcctattcatggaaaagaagaccttttatgttgatattcttggtacattggcctggggaggggtggagaactgtctaggaagtatttaaggggggtgatgagagacagtctcattttatgtttaagatgtatactgcctctcaaataagtagttttacattgggagtctgagggcaactaaagattaattttatattgtccarttttggctagtagggtccccgcatccctgtttttctgcttttgttatctgtggtgtctgacatctgaacttgtgccattattgagaagacatatggctgtaaatacttttacaacacctaggagtaaaaggttatgtgattttctcaacagattgtggacactttacacttggactcagtgacatctttttatgttttgatacggcactcagcagaatttcgagaccacgtgtgtaggcaacagtttaaagttgtccacaagaatggttgaaataaagcaacatttcaggctttatcatgaagtcctctttcttcatagtaatgaagaaatcagtgattsacktggagtgttgtcttaggagaagtttggtttctttattagagttgaaaggttcatagacctcaatagtggggattaggacttcttgggatatacttgagaggataagggatgattgctgcttgaaattgccgtttaacttgatgtttttccagtctgctgcctggaacagagagatgctttattgtgttctctatacatcatgtattcattatacatcaaaatattaggaaccttacagaaactttcttttttgagaagaaatattatagtactgatatacaagtatatgtcacttggtgattgtataaagatagcagatgatctccagaacattaaaaacaatgtgtgtccatcatgtatcgtaaacactaaacatgggtgcctttcacctactcctcctttcctccctccctctcttcgtccttccttccccattttaacagatttttattaactatccaatctatatgcagtagaagtgcagatatgaaggatataatttaaaactatctgaaattacctgtgcttgtgttgtgttttattacaaattatacagaatgttgacttttgcaagacctatcacmcaccctgccctactatggcggatagtacagttattcacagattaaccctgccactgatgttcagcctggctgtgtgaacagaaggacatctgccacatctaagcaggagcactaagcctgtgrgcgtggtgtagcttggctctcttcttcctatctgccatgatattctctccacatagaccctcaagtgaagcagtcccacagccttcgaggaagagagccccagaacgtagaaagtgtgctgttgtcacaggatctttgtacatgtgtttttcttttctgccaggaatatgctctggcatggctaactcccttgattcagatcgtggtcaaaggtctcattgtagacatgggccttctttgacattggtgtttgaattagcagctcactgccacacccatcatttccttatcctgtgtaattttgcttcctaagacattgggamgtcattacccatcattctgtggatatatgtgataatgtgtatgtttattttcttttccttccactagaatgtaagttccgtaaagacaggggcgttgttttgttcatttctgtatccttaatgcctgtcatggtgaatactttcagtaaatctgttaaatgaatgaagcaaagaaggctaatgtaatgttaactagtttcattcccaagtaagagcagtaatgagacacagctttgccattccttcatttaaaaggtatggtgttcaggctcgtcattacttcctacagtcgtccttgagttaaaagttaaaatgtatacagttacaccaccatgcaaggtggaggggaatcctgtcattcttaaatcttgrtatcagtatgacttttgcatatgacagtgaaactggaagtgaaacatactcagattgattcagaaatatcttttgaaattttaacaaaaagattttgataattatatgatttgtttagttataacaaaaataattctgggtaatattggacccagaatagcaaatacagcaccattatctggaatatttggagcagcccctcaatttctttttaaggtgcctgacttttatttaaaatttttcaacctcatcrtgatgctaatctttattgtcttcatatttagggtacatttctccataatatatrctattgtctgcccaccagaaagcagatcttatccatagaccaagaaacatgatttgattatctatttagagttctacctcaaagacaccatgcctatcattttttacaacattttttatttgaatagaaaagaaaaatttgcaagacaaacttctttctgtagtgacaaatgtgctcatggtttcaataaaatctgatgccactatttagtgatgtttctttgatgggaattttccctttctgatttgtttagcaaagatcatcttgattatatactcttgcctaggttttctttcatacttaccacatttgatgtaatatttcagatatccatctctcctcgaacaacaaattctttccacttaccagatgacccctcaatccccatcataatggtgggtccaggaaccggcatagccccgtttattrggttcctacaacataggtatgttctttttttggctratgggaaaatgtattcctgagtaaccgtttttgtttytttagtcattttgaggataattggacttygtaaaatttttatttaaaaaattattattcaatgtgcgataacataatttgtcaccatgggaaaagtaaacacaatgttgtagagattgtgctttgtactagaacttccttttttactgtggcacttttagttttttcttttctcagctacactggtttgtagcatatgtggttggggacaaatattgggcataccttcgtactgtgatgatatacagctgttgtatctatcccttaattggatacaattggtagtgacagagatccaattttagtaaaagtttcaacattaaactcaaacatcagtaattttcaacagaatgttaataagtttaacttcatatcagaacagaagtatttgatatgaaataagtaaaataaaattgtacttctgtttatatttgtgaagtaatgagcaagtcttagatactatttgtcagatagtagagtcctgtccttyggacagttattttatttcgttttaattttttccttaagcaaaagcataatcacagatgtctctstctcatcagtgtgttcaccatttcgtagrcrctttacacattctgsctttaacagccctgagccacttttccatagtacaagttcatttattcataaaattgctattaatgttattgaatgtagagctctctctagatctcacagtgtgatactttgaattgtcctcattttgtgtatgtcggatgtagctgcctctccacacacttgcctagtgtggcatctgctcgagtggccatgacagcctgtggagagtaaaatgctaattaaatgactgaatgttcaaatgcagagatggattttacaaatccgtctgagtttgttggtggtagttcctaatgaaagagattggttttacatattctttatatcacacacctaaactttttttttttccacttagagagaaactccaagaacaacacccagatggaaattttggagcaatgtggttgttttttggctgcaggcataaggatagggattayctattcaggtattgtacaattccagtattgtactcaaccactgagtgtacaattctaattctcagactttttcascttgacaaccttttagtgatccattatatattatatttcagaaaagagctcagayatttccttaagcatgggatcttaactcatctaaaggtttccttctcaagagatgctcctgttggggaggaggaagccccagcaaagtatgtrcaagacaacatccagcttcatggccagcaggtggcragaatcctcctccaggagaacggccatatttatgtgtgtgggtgagtcattatcgtgcctaagtcgggtaggagagggccatcagtgatgtctgtagaagaaaaaaaggaccgagaagccaataatctagatatgtagggataagacatttgattcttaagtacaggaatagaaataacagttctgaaatgattttgacatatttaatagcccagaggttgttattatcagggaaatagtggtgaaagttaatgcttgcattgtacattcttggtaccatttacttacctgtttttagcctctgaaaattacactcatgttactacattaatcatgtgacttgaaatctccagattgattttgttatatataagaataggtgatttgtgctgttgtgaactattgataagtaagaaagaaaaagtatgatttttgatgctgagaatgtggatactaggattctttttctgctaggcataattcttggtgataaagttgaaacgttctgtgttactgaatttgatctactttctgaggcaagatctgttacaggaacccataattgccatagaaaaattgtttaacgcttatttgcttattttgataagactcaaaaaatttctgctagttaaaaaggagttttgaagtaagaaattcactttttcatccaaacacattcctaggatttaacacattctctaagtcaggttcttttttttttcaactgtaatgtagaagacaaaatactggcatcgtgacccagaacatatggatraagataattgaaacaagtttcatgaaacaaagcaacgttttctgtttagtttttataacacattctgatcatttctcttccattttatttagtttgctttaaaagctagctttggctactaagttaatttcatgtcctttcaatagattttgactcctaattgaaaaacattgctttaggtcaataaagggcagaaattctagacattgttttggtttacattttccttcgcttttaatgaagtatttaatctgcattttgtttggcgaggacagtgtcatcggtggtcaaatacaggctggagttttagagatgcacctctaaatagtagaggcagagttcattgtacagatcacagatatctggtcattgagaacttgragaatatcttaaatgtccagactcctaaaacattattccagaaatagctcctcccaatcactggtgctttacttgtcacatttgtgaaatgcacttggaagcattaatagcagtggtcagagggctcagaaggaaaccctggggcacttgaacattgatcgtcygtcagggaagcaggaacaaagtagacagaaggaacagccactgaagaagcaaaattgtcccaaagccaagagggtgctgtttcagagagggagcctgtactgctgatgagtcaaatgagaagacagcggagcaggatcttggggtataagttccctgagaatagtggagaggagagcctcttgagacaggtgagacagacacctctcaagaaatttcactgtgaggggccaggacatgttcagttcctaacatagtagagtcttgtctgacacttcgcttcattcagcaaacacctgagtgctggctaagtgcttggggcatattcagatgtcgatagatacgaggatatrttagtttttctgttgaggaatacctgagactaaagaaaagagatttaatgggctcacggtttaggctgtagaggaaacatggtgccggcacctgcttctggtgaagaccccaggaagcttccactctgacagaaggcaaagggggagcaggcacctcacacggcaagagagggagcaagaggcagggggaggtgccacacactcaaatagccagatctctcaggaactcagagggagaactcactcattacagcgagcatarcatcaagccattcatgaggcatctgcccccatgacccagacgcctcccaccaagccccacttctaacactgggaaccacattttaacataaagatttggagagggcacacatccaaactggatcagaggataagtgagttacacttcctaccctcaaacaacttaytccctggtgagaaagctacatataaacagacgtttctaacgtcggaagtgttccagagaggactgcaagagcacccaggaggggtaccgcccccttcttgtaaattgaagagttaagatgtagaagcacttcaaaaggacctggcacatagtaagtcctcaataaaggtgtctgttactaactgtatgtgtataaagacctagaagtgtgcgagagatctggttcccttcaggagcacgagtctactgtgtgctttgagagtggagggcagggaatgaggggtgagccagcaggtgggtcggagccaggcaggacctcagatgcttctctgacacctaggaaatccttggcctactgtcgggacctggagcctgtggaggattgggagctgtagaaccgtgtggtcagctctgtctcctagaacrgtcactgtaggcaaaggcctggcctgggcatgagtgaggctgggagatctgtgtgagatgttctsagaagacggagggaagaactatggtggtacagtcaaaaggaattagacttgtgaattaaggaggatttactaaaaatgcctgtttgtaagcagtcatcttattattttcttttctagagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactraaagtcagctttacyagtgccaaacctttaaattttcaaaagaaaattttctttcaacatttcttgaaggacatggagtggagattggatcatttaacaatrtaacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttrcagtgccaacatttaaaaaagtatgaaaatgatttatttttatatgaygtatacccataaagaatgctcatattaatgtacttaaattacacatgtagakcatatctgttatatgtttatgtaactatcaaatggttatttgttactaaagctatatttctrataaaaaatattttaggataattgcctacagagggatttatttttatgatgctggaaatatgaaatgtattttaaaatttcactctggcatatgatttatctatcaccattactttttttwaagtcacaatttcagaattttgggacatttgcattcaatttacaggtaccagtacgtacatattttaatagaaagatacaacctttttattttcactccttttatttctgctgcttggcacatttttgagttttcccacattatttgtctccatgataccactcaagcagtgtgctggacctaaaatactgactttagttagtatccttggatttttagattcccagtgtctaattccctgttataatttgcacaaacaaaacaaaatgttatgataatctttctccactgttctaatatatattgtatttttatttgatagcttgggatttaaaacatctctgttgaaggcttttgatccttttgagaaataaagatctgaaagaaatggcataatcttaaaacttggtaagtttttgtggctgtgtaatctcttcattattatatattttataatagaaaccaatctaaaaatatgggataggaaaatatactaagcaagtactatgtaacatacataattacatgtgtaagttgtatgtatcagccaagatacacttaaggtgaaaacattaaaagagacaaaaatattccttattaataagatacaacaatcaagaacttgtgtccacctaccaatactgtctataattacatgacccaaaacttttatctataaaaagaaactgacaaatagtcaatcataacttggtgttggaaactgacctaagccaatttgcttatacacagcatccaagttatgtctagaaactgctggattatctaagttttaggtgggtatcgttcagctgctccccgcagacttacgagctagtgatagtgaaaatacatttcatgataaatgctgctgtacatacagatatgtatttattatctatttactagttatttttattatttattattatctatgatttattagtaatcaggcacaaaacagctctactatcctagtttctaagcctaatgaagttccagctgtctctttaggcactccaccacatctcgcaggaagagtttactcaaggtgcgtcacaacgtggatgtgactactccaggggcaaaattttgtccttactgtgaaccatcctctaacctagtgactggacatgctatttcagagttaagcctcaggcatcaccctagggccttgctagataaagtctttcaccttgcttatgtaggagtagggagtagttagcagtgagggaccttttctaacctgctattctaacaagccactgtagcgctcattatttttaatagccagtcttcatactgatcagtgataaaattaacaaaagagcttgtagtaggcagttctgcaatgtgacatttctgattagaatgctcactgcatctagagggttcctttctgtgcttcagacttatacagtgtttgtggattattctaaagtgagttacactgttgtactgaaacaatcattctattgagtcataaactaccggaaaaaaaaagaatttggatttcactgcaaactatatgacatatatgctacacccaacaaactgggcacccatgttgatttcaaatacacttgaaccattttaaaacattgaccatgaactaagccataaaggaaaactcagcaaattacatgaaataaagcgttgttcactgactctaataaaaaaccaactgcaaaaaaacccacaaaggccacagtgaaacattttaaacacatgcagatgattcatagcttaaattattaaatgtgcacatggaattcaggcgaaacaatacccagggggaggattcatctatttcacaaagtactgtgcacccagtgaccaaaatagttaaaacaccattgttttcagggagctttacattgaggagagacataaaataaaaaatccgtgaattgcatggggtctgagaaggtgataaaggctatggaggatgacaagtcagagtaaatgggatgtgtggcctgcagtcttgtagggttggtgtgacttcatactcagggagtctctgaaggtaaacacttgaaaaagacaaaagagccagccatcatgagtatcttgtggagggaagagtcagaacgaaggccctgagatagaatggttacaggaaatgtgtcttaatccagaccccaggagagagtttttggatctcacacaagaaagagtttgggacgaatccataaagtgaaaacaagtttattagagaagtaaagaaacaaaagaatggcaactacagagggcagctccaagggctgctggttggctatttttgcggctatttcttgataatatgctagggtggattattcatgagttttcccaagaagacggggggatttccccagaactgagggttcctcccacttgtagaccttatagggtaacttctggatgttgccatggcatttgtaaactgtcatggtgctgctaatccattataattagcgtatgatgagcagtaaggactaccagaggtcacttgttgccatcttgactttggcaggttttggctggcttatttacagcgtcctgttttatcagcagagtctttacaacctgtatcttgtgataccagtcctgctgccctcctatcatcctgtgattaagaatgcctaacctcctgggaatgcagcccagtaggcctcagcctcattttgccttgccccattcaagatggagtcactctagttcaaacgcctgtgagagaactgccagacaagttggaacagcaagaagggcattggatattgagcagtgacaaagggggaaactagtaagtgatgacgacaggagagaaatggggaggtctgataatggtttcagatcgtcataggattttggcttttactgtgaatacaaatccatttggtcagtgttaacagtggaaggtatttgagttaccagcagtgaatctgtatgggtctgcagcaacctcaattcttgcctctaaagaaagaattcaactgaggggcataaggcagaaaaagaccaaggcaagtttcagagcaggagtggaagtttatttaaaaggctgtagagcagggaagaaaggaaaggagagaatgcttggaagagacccaagctggcaccaagatcaagtgccctgtttaacagtgatgctaggactttataggatggcacttttcccacgattctttccttagggtgggctgcccgcacactcagtgcctcccttacccttgggaagtgagcacccgctgtgtgcttaggaagctgtgcacatgcccatttttaaaacttaaaccacaggctttattccgacttgacttttcccaccaacatttttccattccagaatttcatccaggacatcacattgcatttcgttttttgcctcctgagtcttctccagtctgtgacagtttctcatcttttgttgtttttcatgaccttgaaggcccctggtcaggtattttgtaggaggttcctcaatttgggtttgtctgaggtttaaacgcacaattacactgggtttctgggttttgaggagagcacactagcagtttttttttttttctcatcgtttcatatcatggagtatatggtataatatgattaatcactagggatctcaaccctgatctctttggtaagatggtatgtgccagtttctctactataaggttactctttttcccttttcatatgacattgtttggaaatgagtcactaagttcagcctacattcaaaggaagagaaattaagctccacctcctggaggggttactatctacatgtataatttgtaattcttttgcaaggaaaagctgttccttctcccaatttagttacttattttatcatgtatttctggaagtatggactcatggatatttatttaatactttgggttataatataatactgtattacttattttattgctcaaatgatcatatgtgacgtctctcagggtgactgttgtgttcctttgccatgctctccttttttgttggggaggagggccaagccattttactaaggagaatggaaagggagacaaagaagcgctgatgacagtgagatctgacatccttggctgggccagaatcttaaaggctttgcagttgcagaactattcctgttttttaaagtttcacgtatgtatgagtgctgtttatacatgatgtcttggaatatgtatcatttgtttcactgtttcagcacttcgttttttttggtagtctaaaatgctccaggttgcccttgatttttacctatcccagtgttaagaatgaaccatttctccagtaagtcacaattccttttatcagagaacccctgacaaccacttagctattttccatgcttatagttttgccttttccagactgtgtgatacaactggaattacacaacattgagctttttgggtcagacttatttcacttagtgaaatatatttaaggttaacccatgttgttgtgtgaattgatatctggttcctttttattgctcagtactattctgttgtatggatgtacagtggtttatttatccattcgtttattgagggaaatcttggttgcctccagtttatgacaattatgattaagctgctgtaaacatttgcatacatatttctgcatgaatataagtttttaatttacttggataaatacatcagagtgggatttttgggtcgtatgctaagtttttcttttaatttctaagaaactgtcaaactgttttctaaagtagctgtctcattttacattcccatgaacaaggaatgagagttcatggatttgtttttgagagacctttttgaagagttcagcattgttagagtttgctttggtgcagtccatgtctccagtccctgtgcatttaaacagtagattcaaaattaaaatgatagcatagaaattataaacaacacgaagaaatacaaatggagttactttagttctgttattgtgtgtgtgaccacttgaatttttcctcatgatgacttttgtttaaacatttggaaaacatttatttctttcagtctcacctcatagatgaaaaatgcttcagaatatagttataactgtgaaaagactgttcctgatgttatgatttgctcactgtgaagcttttcatgcactacagacaaatgttggaaagtctgtctcaacttcaagggcagtgaattctgaaagttaatgtggacacaagagtttcttctcagatttcctcctctgctgcattttttttttgagttatcttcttttctggtatgaaattgtaaatcaagtaagtcagatataaaaatatttgcaaacagtcaaaatcaactctaaaagtgatgtagtgaaactcaagctttaaaattgttccttgaagagcagcacacaaaaattgtgtagaaaattattaactatgtaacaacaacaaaaaggtcaatgacatttagacagaaaaaaaaaagaaatttctgggaagaatattagggaaaagaacaacaactgctggccttgcagcagcagaaggaattgcagggtgtgttgaatattttgattatttccaccaggaactagatacttgtaaagcggtggattaagcattctcaagttccttaatgtttagcccattttctcatattcttttagcagagaagaaaaactttagaagctttcacccagtgtaatagaaacttatgatgaattttctggtgaaaatatcttaggggaatttcttctattgcagagatgtttgaaaactattataatccatcctgaagaaagaaaaacatgaacagtatttcaatttctggagcttattgtaaaatgtgatttttatgaatctctgaaaaactcatcctcgtacttaagactttttccaagtcttcatacatctatgactccacgtgaaaaaaacttttcaaaattaaaatttaagaagtttttcaattcgagtgaagaaagctgataaattctcttaaatatccatagaatgtgaatatacaaaaattaatttttgtaaatatgcagaagttacagatcaaaagcagatactataatataattcgcagtggtttaagaccaatatgtaggtgtaagtttcccttgttttcccaaaaaacacattagtgcaattaaaaagaatttatcgctttttgtctttaaaattttttaaatttatcccaataaatataaattttgagggtatatctgctaatttaatacctttatataatttgtaaagataaaatcactgtaactagaatacccatcaccttaaatattggtcttttctttatgctagaaacattcaaattattcccttctgactattttgaaatatttaatagatgattgtaaactatgctaaccctactgatctatcaatcactaggttttatttattctaacaaattgtata

SEQ ID NO: 17758 - DNA, 51917 bp, Homo sapiens
gacgtgaggagggttctgggttaatcatgatcagccattactattgctgctgttgtgtgctgttgtactattgttgagctcagcaagggaccatggaagctgtcataatacctggtaaatgtccttgcatttactgagccacctcctacgaaccgcgggcaggggctgttttactggcagggaaacttaggtgcagaggaaagccggctgcccacgtctcttagtggagtgagaggcaggaaactgggtctcaggacaccctccctccacacacatcagggcggccacgttggggacacacgactatttttactttggtgggctccaggctgcccacgtcgtgatctgggtgttcgccatagcaaccagtgacgccatcggcccctacagccaattggagggggccggaagctgctgggctgccggatgacccagctgggagggcaaggtctcccgggagaggcggggaagggtcgcgggggtgtggcgttaccccaggcctgacttcagctgctctgcgctcagaaaaccaagctgtcacgatgggaggagaataatctacccctcgaaggtctctctgactgcttgaatatgtctgaggacagacaactcacggcgtttagttcaagcagtcatggtgatggaaccatcaccaccatcaccgtggccattagggtctccttcttccccttccaatagttgtgggaattttttttttttttttttttttttttttttttttgagacagcgtctggctatgtcgcccagactggaatgcagtggtgcaatcttggctcactgcaacctccgcctccagagtagctgggattgtgggcatgtgccaccacacccggctaatttttgtattttttatagagatgaggtttcaccatgttgcccaggctggtcttgaactcctggtctcaagtgatccacctgccttggcctcccaaagtgctgggattacaggcatgagccactgcacccagccagttgtgggatcttataccacttcctccactaccccacgtgaaacagggagggatttgaaccctggtggggggtcccacttgcaccccatccaggcatttccttccaaaactctgacagtcctaggttcccagtctggctcccccactcctgcactgtgtgacccgacaagtgacttaacccctctgtgcctcagttttctcatttggaaaatggcccagtgacatagggtccctggaggaatcaatgagtagcaagctcagagcctggtgctgggggagacttggatggatgggagtcaagacaatgatcaagacgtgaataataaccaccagttgaaagttgcttccaaaagacaaaaagatgtgaatattttgtttgtttgtttgttttcagatggagacttgctctgtcgcccaggctggagggcaatggtgcgatcttgtctcactgcaacctccacctcctgggttcaagcgattcttctgcctcagcctcccaagtaagctgggattacaggcgcccaccaccacgcttggctgattttgtatttttagtagagataggatttcaccatgttggtctggctggtcttgacctcctgacctcaagcagtcctcccatctcggcctcccaaaacgctggattacaggcatgagccactgtgcctggcctgaagatgtttttttaaagtggcagagagaggtgaggcaaaatcggcagctccctgcaaaggctcccggggaagctggaccacacagaactctcctggcaccactcccggacccttcggtccccgcaccatctgctttccacccacagctccctctgtgcctgctgttcccctgggagtggttcccacccagaggagtggaggttggggaggccccgaccccctgaaactgccctttaaaggtaatatttatggtatacccgtctgcgcttgcccaggctgggggatgctgcctccccaacaagctttagccccaccttgaggaaatcccattttggagaagacatagcacagcaggagcacccccatactggagggattaagagagacccgaagcagctgggtgctgtggctcatgcctgtaatcccagcactttgggaggctgaggcgggaggatcacttaagatcaagagtttgagccaggtgcggtggctcacgcctgtaatcccagcacgctgggaggccaaggtgggcggatcacaaggtcaggagttcaagatcagcctggccaacatagtgaaaccccgtctctacttaaaatacaaaaattagctggatgtggtggcaggcgcctgtagtcccagctactcggtaggccgaggcaggagaatcccttgaaccccggaggcggaggttgcagtgagccaagaccacaccattgtactccagcctgggtgacagaatgagactccgtctcaaaaaaaaaaaaaaaaaaggtggccgggcgcagtggctcatgcctgtaatcccaggactttgggaggctgaggcaggcagatcacctgaggtcaggagttcgagaccagcctgaccaacatggagaaaccccgtctctactaaaaatacaaaattagcaggatgtggtggcgcatgcctgtaatcccagctacctgggaggctgaggcaggagaatcgcttgaactcgggggcagaggttgcggtgagccgagatcgtgccattgcactccagcctgggcaagaagagcgaaagagtgaaactccgtttcaaaaaaaaaaggccaggcgcagtggctaacacctgtaatctcagcactttgagaggccgaggtgggaggatcacgaagtcagcagatggagaccatcctggctaacacggtgaaagcccgtctctgctaaaaatacaaaaaattagccgggtgtggtggcaggagcctgtagtcccagctactcgggaggctgaggcaggagaatggcatgaacctgggaggtggaatgagcggagatcacgccactgcactccagcctgggcgacagagcaagactccgtctcaaaaaaaaaaaaaaaaaaaaaaagagtttgaggccattctggccaacatggtgaaacaccatctctactaaaaaatataaaaattatattagtcgggtgtggtggcgctcgcctgtaatccagctactcaggaggctgaggctgtgagaatcgcttgtatccaggtgacggagcctgcagtgagccaagatggcgccactgcactccagcctgggccaccgcactccagcctgggcgacagggcaagatcctgtctaaaaaaagagagactcaaagggagaagaggggttggaggcacacagagaggagagctaaggggcttcctggagtagggggtgtcaaacaaagcctgcaggcacatggaaaacaccagtccatgcccagcaaacagcacgtgcaaagggaggtgagactcagcctgctgggcaccaagcccggttggaagttcgatgcccctggaattaaatgggagagaagtcagcatggaccacatggcaccagccccagggcttccaggaggaggaggaggaggaggagaaggagaaggaggaggaggaggaggaggaggaaaataagtggaagctgtccatgagaaagcaggatcaccttggagggctgaacctagaggagccaccccagtagcggcagagacaaaagtccagatacaggctctagcccttctctgccgggggatgctctgtttgtgggacctggtgttttgaaattcggtcatgtgtaaagcaaaggtccaagtaggagatgataaatgtaataagataatagtagtagtagtaataacagctcacgttacccggtgcctgcacacgttatgcgtgaggctgagtttaacccaaattgggaaggtctccacctcctccctggacccagggctgtcgcaaactggccgcccgcgggccaggccggatcctttttcagacctttcctgcacacagccaacagcacgcctcacattgtcaccaccggagaggacgccctgggctatgcgtctggattggccggtcagcacccgtttgtgaatggactctttggcctttggcctccaggaaatctgattggctcgcatcagcgatctaccccctgattggctggggtgctcctggaccattaacaaggtttccagtcaaaagagaccccaaactggggctgatgaagacaacaccttcacgtgccagattggttagaatttctctggcttcctggtgggtacttccctctttgggcctcagtttcttcctttgaaaagtggaactaataatagcactgaccactcgggctgttgggagaattgaatgcatgagagggcttagcctgttaatatgaacggttattcccactttactattattttattattattttaatcttcttccacttggacctttatttttatttttgagatagggtctcgtgatcatggctcactatagcctcaaactcctgggctcaagagatccttcttggctgggcgcggtggctcacgcctgtaattctagcactttgggaggccgaggtgggcggatcacctgagatcaggagtttgataccagcctggccaacatggcgaaaccccgtctctactaaaaatacaaaaattagccgggcgtggtgacatgtgcctgtaatcccagctactcgggaggctgaggcagggagaattacttgaacccgggaggtggaggttgcagtgagccgagattgcgccactggactccagcctgggtaacagagcatgattctttctcaaaaaaaaaaaaaagagagagagagagagatccttctgcctcagcctccttgagtagctgggactacagtcatgagccaccacacctggtacacttagactttcattccatgctccttcctggcttcctgccctttttgattcccccactcctgctcctagccctccagaggagtcttcccagcccctcaatatgggcatgtcctctcctgctccagcaccttccatagctccccatcaccctagggggaaagtctaacctcttcaaaatcagcactgaaggccctggaagcattaagtcctggccatcagcctctagtgctaagaaataggttcaagttcttgtttccccatataaacaggtaagaaaggctacatgcctctgggcctttgcacgtgctgtggcctctgcccggaatgccctcattcagtcggggaatccgtgctcatccctccaccttcgtggagggacgcctgtgctgggttggtttggagaggaagccggaactgcgtgggttcaaatcctgtctgactctgtcacctatactttgtgaaacccggacagtggctatgcttctctgaacctcagtttccccttttgtaacatagaacttaccatcaggaaatgtttgacccccccaccatggaacaggccccacttcttgacgtcagcagcacccccattcgcctacccggaggcggtttctctattttaagaggctgcgggcgggttggcatctaactggggctggaggcgggactgcccccccaccaacaccacgctgctcgccaatcccgccccgccccctcctttccgcccaagtcccccactcttgcctctggcctcagcgcctccagttctgccccacccccgcgcggccagagaccgggtgtctctgatctgcagctcagcccgtgccttccctgaccactcccgacctggcttcccatcacctgctgagttcgcagtcccgcagctaccggtgcggctccaggttggagacccgccggccccattcctctcaccccctcaacccgcccggagctaacctcagtccccgacccccaccccacctgctcagtcctccctaggttccagcttctgtcaacctctttcatttccctaaataccgccccccgctgcaatgcctcgccacccttggctgcctcctctaccccagggctcccagcaatgactgggtcaggcgcctccttcacttgctgtgagtcccttatcacaactgatcactccgtggggtcaccgctgctctggcgtctacctcccccaacaggttggggtttctaggagggcagctccagaggttgcagaacactccgctgcctctccagagccaggcacacagcaggcgctccataaatgttcgttgggtaagtgctgaatcccaggttccctacctgaaaacttggtggcttcttaagggtgtggtctaagtcccagaggaaaatggccaaatcttaattcctgtttttcttttcttataatggggacactgaggcccagagaagtcaaagggtggctgcccggggtcatgtagtccctgtgtggcttcaaacttaggcttctgctgtccccgacgcctgtgtccctacctcctgatgacacagcctcctaaacataaactcagtaaaaggaggaccctatggctcattggaaaactgaggcccagagaagcaagggtgccctccccccaggtcacactgctggttggcagcgccttgtgccgtaagagagctggttgagggcgcagatcgaatcccagctaggcgacctctggagagtggctttccgggactagagcctcagtttccttattctgacaaatgggcgcctgacagccccaacctccccaggtcgtcgtagggctgagctgagggtgtacagtggtgcagcgacgacccaaggaggtattaatacatatgaactcatattaatacatcgctagtaataggactaaaacaaccatgaacatatggtgagctctctggctgctgttgctagcattattattagaacagctggtggggaggggcagagccctcagcctcttcctcccacgccatcgcttggagcctcagtttccctagatgtccaagggggcaccttcccccttcccaccatgagaaaaagcactttgagaagcgggtggtcaaaaagaagcgatctgagcgttccccaccctctgcctcagtttccctacagcccgtgaaggccccgcccctcccggcacctttcaggccgcgtccacttggccgcgccctctgccttccgcccgcccgcgcaggggcctcacctggagcccgcggcgccgcaggaggctcgactcgtccatggcccgggagtccgcgccgccaggcccgcccccggccccgccccggcctgccaggccccgccgccaggtgccattggccaggccggtcagctgacacggcctggccccgcccctcccggggagcccgaccacagggccccgcccccactgggcgagctggccccgcccctccagcagagcgcagaagtaaatattttgcatgaatcctctcagaagtaaggcagcatcgttcagccccattttgcagatgaagaaactgaggctaagataggttaatcaatatgcccagcgcattggccgggcgcagtggctcacgcctgtatcccagcactttgggaggccgaggtgggcagatcacttgaggtcaggagttcgagatcaccctggccaacatggtgaaaccctgtctctactaaacaaaaaaaaccaaaacaaaacaaaaaaaaaattacttgggggtggtgacgcgcgcctgtaatcccagctactcagaagactgaggcaggagaatcgcttgaatccaagaggcggaggttacagtgagccgggatagcgccgctgcactccagactgggcgacagagcgagactctgtctcaaaaacaaaaacaaaacaacaacaaaaaatgtgcccagtacacacagcagaacgggttctagggtgaggcgagtgaggatctcacccctgtgcaaaatttaaggtggccccacaaaactcagccatcaagagaaataatattttaaaaacataaaattaatgaaaacatttatgatgaacaaaacatcaaaacttttattttttattttatttttagagacggggatctcactatgttgcccaggctsgtcttgaactcctggcctcaaaagatccttctgcctaggcctcccaaagtgttgggattacaggtgtcagccaccgcatatggccaaaacaccaaaactttttttttttttttttaatttatgagacgagtctctctgttgcccagactagaatgcagtggcatgatctcggcaacccctgcctcctgrgttcaagctattctcrtgcctcagcctccctagtagctgggactacaggtgcccaccaccacaccaggctgattttttgtatttttggtagagatgaggtctcaccatgttggccaggcttgtctygaactcctggcctcaggtgattcacccaccttagcctcccaaagttctgggattgcaggccaaagagttttggtgttttgcctggccaaaacactaaaactcttaagacatgatcagacccttgtccttgcaccactcagccttgtttgcctccctttaatcctggccctggtgccaataaaactttacttacaaaagcaggtagccgctgcagttgtcagtttcttttttgaggatgattgcctttttgccctaagtgtctcataaacaccatctctcacagatatttgaagataattgttctactccattttgcaggaggggaaactgaggctgagaaaagcccaaagtcccaaaatagcacccacatttaaaaaaaaattttttttttgagacagggtctctctctgtcacccaggctggagtgcagtggtgcaatcttgtctcattgcagcctctacctcccgggctcaagcgatcttcctgcctcagcccccataccccagctcccagagtaggtgggaccacaggcacatgccaccatgcctggctaatttttttgggttttttttgtagagatggagtaccgccatgtttcccgcgctggtctcgaactcctggcctcaagtgatgctcctgcatcagcctcccaaagcgctgggactacaggcatgagccactgtgcctggcttagcacctgcattttttctttccctgggactcgcactttctctgcagccgcagttgtcttcggctgccccrctgtacagtgtggacactggagtatgctttcaggctcgaggggaccctaggaagggtcactgggcctgactgtccatgaggtactgtagaattgcatcaagttatggtggccagattgagcaaataaaaatacaggatgccagggaaaacttgtttttctcatacaattttaaaaattgacatataattcacataccataaaattcacgcttttaaagtgtgcaataaattcagtgttttaagcatactcacagagttgtgtaaccatcaccacgatctgattccaggacatttgtatcatccccaaaagaaaccctgtacctattagcagccagtcctcattccccctctctcagcccctggcaactaccaatctgcttcctgttctatgaattttcctgtgctggatatttcataaaaatgaaaacataacatgtggccttatgtgtctggcttcgttcagcatcatgctttcaagatgcacccatgttgtggcaaatatcagtacttcattccgtttcatgaccaaataatattccattgtatatatgtacatgtacattttgttgatccactcatttgttggtggtcacttggattttttcacrttttggtagctattctgaatasagctgctataaacattggcatacaactttttgcatagatttatttctttatttatttattttgagatgaagtgttgctctgatgcccaggctggagtgcagtcgcgggatcttggctcactgcaacctctgcctcccaggttcaattgattctcctgcctcagcctcctgagtagctgggattacagacacccgccaccactcccagctaatttttgcatttttagtagagacgggggtttcaccatgttggccaggctggtctcraactcctgacctttaagtgatccatccaccttggcctcccgaaaggctgggattgcaggtgtgagctaccgccccctgcctttgtggatatattttggttctcttgggtacttacctaggaatggacttccggggtcatatggtgtaactctatgttttgggttgttttgttttgttttgggacagggtcttgctctttcgcccaggctggagggcggagtagctgagactacaggcacatgccgccatgcccagctaattttttgtattttttgtagagacaaggtttcgccatgttacccaggctgatctcaaaatcttgggctcaagcgatcctcctgccttggcttcccaacgtgctgggattacaggcatgagccactgcgcccagcaactctatrttttaaatttgtaaaagacaaccaggctgttttccaaagcaaacacccagttaaatttaaatttccataaacaatgaatgttttttcagtgtaagtatgcccccttcagtacttgggacatagttgcattaaacaacaatgtgttggccgtgtgtgctggctcatgtctgtaatcccagcactttgggaggctgaggtgggtggatcatctgaggtcaggagtttgagaccagcctgggcaacatggtgaaaccgcgtctctactaaaactacaaaaattaagggggcgtaatggggcacgcctgtaatccccgctactcggggggctgaggcaggagaatcacttgaacctgggaggcagaggttgcagtgagctgagatagtgccagtgcactccagcctgggtgacagagcgagactccatctcaaacaaaacaaaacaagacaaaacaaaacacaaaccaatatgttggttgtctgaaattccaatttaactgggaatttaatttaaatgttatttaatgaataatgactacgagtgagtttgttaaatgaatgaatagattttctcctggcaaactcctatgcatccttcaacaccctctttagatgacccctcaggggcatcagggtctcttggccacatggagggaagctccccactcttcgggctgaaggtccctgagaaggcagaagtcaatgggggtggggaagtcgtgtgttttatctggcagtcctacactaagtgaacttcaggctgtagcttgcacaccccaagtgatgagaagctcatgtcctgcaatggccaattgttctgactctgggcagctctgcctcaaagttctcccttagtccagcctggggtggacatgtgactcagactcgtttatccacctcagccactgtgattggttcaaggtgtacatgtgacccaagctcagcctatcagagccctccctggggctttgactggaatcctggggaaagagaggttccctgaaccagggttgggttgggcatgtgggaacatgctggagagagccaccagagaggtctcaaatccgctgctccatctggagaattcctacactgaactgcctcctgaacaacccctcagtgggcaagaaggagtgcttattgagtgactgactggactgactgaatgaatgaatgcagtttttctrtggttaacacacacacacacacacacacgcacacacacaagtatatawatatatatatttgtgtttttttgttttttgtttttgagacaaaagtccagctctgttgsccaggctgaagtgcagtggagcaatctcggctcactgcaacctccgcctcctggattcaagcaattctcctgcgctcagcctcccgagtagctggaattacaggcacctgccaccacacccggctaatctttgtatttttagtggagacagggtttcaccatgtttgccaggctggtctcaaactcctgacctcaggcgatccacccacctcagcctcccaaagtgctaggattacaggcatgagccactgygcccggcctaacatctatatattcttcaaaatccacttcaaattctctttgagaagtatcagaggaccttgtattgaatgaacaaatacattttattcttgtgagcttctatgtacccatcaaaactctcctcacatgtctctataagggacatcaggaagtgtggtggttgaatgaacttttttcttggtaacctcctgagtcttccttaaaacatcctctaatctgtttgggagcggtggctcatgcctgtaatcccagcactttgggaggctgaggtgggaggatcccttgagaccaggagtttgagaccagcctaggcaacatagtgagaccacatttctttttttttttttttcagacagagttttgctcttgtctcctaggctggggtgcagtggcacaatctcagctcactgcaacctccgcctaccaggttcaagcgattctcctgcctcagcctcctgagtagctaggattacaggcgcgtgccaccatgcctggctaattttgtatttttattttattttatttttttgagacagaatttcactcttgttgcccaggctggagtgcaatggcacgatcttggctcaccgcaaaccccgcttaccaggttcaagtgattctcttgcctcagcctcccaagtagctgggattacagacaggagccaccatgcccggctaattttgtatttttagtagagacggggtttctccatgttggtcaggctagtctcgaattcctgacctcaagtgatctgcccacctcggccttcccaaagtgctgggatacaggcatgagaccacatttctaccaaaaactgaaaaaaaaaaaaaaaaagctggatggtcgaggggcggtggcttacgccggtaatcccagccctttgggaggccgaggccagcagatcacttaaggtcaggcatttgagaccagcctggacaacatggtgaaaccccatctctactacaaatacaaaaattagctgggtgtggtggtgcatgtctgtaatcccagctactcaggaggctgaggcaggagaattgcttaaactcaggaggcggaggttatagtgagctgaaatcgcaccactgcactccagcctgggtgactgagcaagactctgtctcaaaagtaaaaaaaaaaaaaaaaaaaagaaaagccaggcatcatggtggcattggcctgtgtctcagctatatcagaggctgaggtagaaggatagcttgaaactgggaggttgaggctgcagtgagctatgattgtgtcactgcactccagcctgggtaacagagtgagaccctgtctcaaataaaaataataattaaacatcctcaaatgatccctcagaggcattagaaagtcctgattgaatgatgaaaattgttcttgttgatgagtgatgcctatgagtttgttaaattaacaaatgggttgtctcctggctaactcctatgcatccttcaacaccctctttagatgatcctcagcgacgttagggtctcttgccacatggagggaagctcggccctcctcctcgggctgaaggtctctctccctgagaaggcggaagctgaggaggtggggaagtgctgtggttcctcccgtcatgttttctggggccctcgtgactcgatccttcctgcttcacccgcccccgagtctgtggggcacctgaaagtggggcagccctgggaacttatctcagacgagcttctggggmagctgggtggggccataaggggcccacagggcctcttggcaggcctagagacggagggaaggaggtgggcttgccaagaygtggcaaggggaaggtgggatgtggggaacttcagagggagtgtcaggttgtgacttcaataaggggagaaataccacttcacctttgtctggggtacccctccagctcacacacctgccatggctccctaccgccctcggagaaagccaggccctttagcctggcgctcgaggccccagcccatcaccccacagaaacccagacccactgtgtccatcttggtggtccccaaagcacctcctctggacttttgcctctgctgtggcctctgccrgagatgccctgtaattctatacattctagctcaagtgtccctcctccaggcagtcctccctgctccacttcagggcacccggcctccatctgttcctgatcccaaggggctaggggcgtctgtgtccagcttttcacctccccagccctgtatctccctccctcgatgtttttccagcagctgccaggcagaggccactggggaacaacaacaatgactaatcacactggccagcgggtggacagcgctcactgcaagccaagccctccttcatactcacaaaagcccattttgcaggtgggaaagatgaggcctgagagggccaaccttggtgcgggtgggggaagccctgaggcacggtctccactctggaaggggcaaaactatactccacaaggggtggtttgaatccatctcttcatctccagctggggcctcaggtggtctgagtgcccctggactcagtttcccaatctgtgaaataaggcaartgagggactctccaggaattggtggagttgggagggtctcaggatggtcaggagggggccatgactttcctctgatctctacctatttcctccacctttcttgttattttttgagcagggtcttgctctgtggcccaggctggagtgcagtggcgcaattagagctcactgcagtctcgacctccctggcttaagcctcagcctcccaggtagctgggactacaggcacctgccaccatgcccagcaaattattttttgtagagatggagtctcaccatgttgcccaggctgctcttgaactcctagcctacagcaatcctcctgccttggcctcacaaagtgctggattacaggcataatccaccctgcctggcctcctccatctttatgtatctctctatctctgtccctttctctgtctctgcccctcccccaggcctcacacatccatcccccagctgaccctggcctgggccccggggccagagaaggctgtcctgtatggggtcacagggcccccgtccccactgtgccaggcccaggacactgagtctttgtccctaactcactgacctcatagcctgctgggcgcctgrccctggccagctcagctgcccctcggagccaggcttcttgaaggagggacctcctcccaggaagctgaacmgcattgcacaamcctggccacttgggcctcagtttccacagatgctcatccccaggagagaccctctccttctccctcctcagtgcccctggactctaagaatatttcttttttctgtagatgcatctcacgtaacctaaaattcatctttttttttttttttgagacatagtctcactctctcacccaggtgggagtgcagtggtgtgatctcggctcactgcaacctctgcctcccgggttcaagcgattctcctgcctcagcctcctgagtagctgggattacaggtgcatgccatcacgcccagctaatttttgtatttttagtagagactgggtttcactgtgttgtccaggctggtctcgaactcctgacctcaaatgatccacctggctcggcctcccaagtgctgggattgcaggagtgagccaccgcgcccgggccggaaattcatcattttaaagcaaacgattcagtgacatttagcacattcagtgttgtgcaaccaccacctctatctggttccagaacatttgcatcaccccaaaaggaaaccccgcatacatcagcagtcacttctcactcccgcctccccccagcccctgacaaccactcagctactgtctgcctctgtacatttgcctattttggatattttatataagtggaatcatacagtgtgtgcctttcctgtccatcttcgtccacccakcatgatgggtttttttttttgtgtatgtgtgtttttttttttttgagatggagtctcactctgtcacccaggctggagtgcagtggcacgatctcagctcactgcaacctctacctcccaggttcaagtaattctctctgcctcagcctcccgaatagctggaattacaggcacatgtcaccaggcctggcraatttttgtatttttagtagagacagggtttcgccttgttggccaggctggtctcraactcctgacctcaggtgatccgcccacctcggcctcccaaagtgttggaattacagatgtgaaccactgcacccagcccagcattatgtttttgagggttcatccacatggtagcttggatcagagcttctccactgacatttagaggctttgccgacagtggggagggaggggcaggaaacaaaatactcagaggctaagaaatggaacatgggggaaagactaagttgcatctcttaaatttttttttttttttttttaagagacaggatcttgctctgttacccagactggagtgcagtggcrcaatcacgattcactgcagcctcaacctcctgggttcaagccattctcccacctcagcctcctgagtagctgagaatacagatgtgtgccaccacgactggctaacttttaatttatatatatatatatattttgagatggagtgtcactctgttgcccaggctggagtgcagtggcgcgatctcggctcactgcaacctccacctcctgggttcaagcgattctcctgcctcagcctcctcagtagctgggattacaggtgcctgccaccacacccggttaatttttgtattttcagtagagacagggtttcaccattttggtcaggctggtctcaaactcctgacctcgtgatccacctgccttggcctcccaaagtactgggattacaggcgtgagccaccgcgcctggcctaattctttattttttatagagatggggtcttgctatgttgtttaggtagacccaaactcctggggtcaagtgatcctcccacctcgacctctcaaagtgctgggattagaggggtgagcccaggtgcacaaggctggagcttggcatgtggggaggtgggcattgtggagggccagcatgctgcaagctctttgtaacaatttgttggaaggatgaaattaggccatccaagaacactgccctccttcagctcttgagtctcagattcagaagctggcgagatggcccggtgcggtggctcacgcctgtgatcccagaattttggtaggccaaggcggacggatcatttgaacccgggagtttgagaccagcctgggcaacatggcaaaaccccctctcttaaaaaaaaaaaaatgcaaaaattagctgggcgtggtggtgcatgcctgtagtcccagttcctggggaggctgaggtaggaggatggcctgagcctggggaggttgatgttgcagtgagccgtgattgcaccactgcactacagctgggccacagatcaagaccctatctcaaaagaagaaaaaaagaatttggcagccaggcacggtagctcacgcctgtcatcccagcactttgggaggctgaggtgggtggatcacttagggttaggagttcgagaccagcctggccagcatggtgaaaccctgtctctactaaaaatacaaaaattagctcgatgttgtggcagttgcctgtaattccagctactcgggaggctgaggcaggagaattgcttgaacccgggaggcagaagttgcagtgagtggagatcatgccaccacactccagccygggcgacagagcagggctccatctcaaaaaaaaaaaaaaaaattggctagagagggccagagacctggccaagtgcatggaaccacaggtggcccatgggcccatggggctggcatctgggtgttcagttcaggtctggggccagcagggcagaaccccctagaaccctgacttgctccaaagtcagacttgctccagagtctgtggccgccaccatcaccaccaccacrgagctgacttcctgggtttctctttcactttgacttgccttagggatgggctgtgacactttactttttttcttttttcttttttttcwgtcttttctccttgctcagcttcaatgtgttccggagtggggacggggtggctgaacctcgcaggtggcagagaggctcccctggggctgtggggctctacgtggatcygatggagccgctggtgacctgggtggtccccctcctcttcctcttcctgctgtccaggcagggcggtgagtcccctgaccctggcatggcggctcctcttgctgggtggaggcacgtgtatgtgtggagagctgtgggcctgctgtgtgggttggtttcatctctctgtgcctcagtctttcctgctgtcaaatgggagatgggcagtcatggcttctgggatcgaacttagacatctttcctctggtctagattttctcttctgtgaaatgcactaaattttttccacctcccggagttcaatgagaaaaaaaactaaggaaggaataaaaagcaagtatgtatctaataggtatacatagtatagtatcttatgtatgtagtttacaatagatagacatacataatataatgtatacagtcatttccatatttacggggcaatggttccaggaccctctgcagataccaaaatccaaagatgctcaagttcctgatataaaatggtaaagtatttgcatataacctatgcacatccttccggatactttacttatttatttatttatttatttatttatttatttatttatttatttactgaggtagggtctcactctgtgtcccaggctggagtgcagtggcctaatcataactcattgcagccttgaccacctgggctcaagtgatcctcctgccttagccccttgagtagctgggactgcaggtgcacactaccatgcctggttaatttttttggtgtatactttttacagagacagcgtctcgctgtgttgcccaggctggtctcgaactcctgggctcaaatgatccactcaccttggcctcccaaagtgctcagattacaggcatgagccaccatgcccagccttcccatatacttttaataatctcaggccctgcacggtgactcactcctgaaaatccagcactatgggaggccaagatgggtggatcacttgaggtcaggagttcgagaccagcctggctaacatggtgaaaccccatctctactaaaaatgcaaaaattagccaggcttgatgatgggcacctgtactcccagctacttaggagctgaggtgggaggatcgcttgaacccaggaggcagaggttgcagtgagccgagattgcagcactgcattccagcctgtgtggcagagcaagactctatctcaataataataataataaataractttccttctctgtacactggggatcagcggggtgctgactttttcaatggctcttgagatgcactgagtgcctgtagaatgcccacagcagtgctggccacacctcaaggtcccagcgccttcaggggccaggcatggctggagaccagcagcagggagggggcgagaggcagcccacgaggtatcctggagatagtggcagtgagtggtcagtccagggaaagggaaggaggatgggctttaggctctcaggggtgggtgggtgggtgggggttctgtgtcatcacagagagagatggaaggatggagagccttgtgtgttaagcatctttcccccctcaaggttggacacttggggctgtttcctggggtgccgccttctcccccaaggcttccaatctgcctgcagggctcaggacaggtccttcttgtgggagtgagggcgccggggtcttcctgacccatccatggtggcatccccctccttctctcacccagttccacacctagcagactgtggcaatcccaaagggcacggggatcccagtggctgagggaggtcgctgcctcctggagaaatgttattaataattgccctgactgctagtgggccaagtgtgcttgcctgggccagccctggcaggcctctccctgccatgcaccctctactgtctttccccatgctggcttcagacactggtgccaccccaggcacacctccacttctctctgccctccagactgttggtcttactgttctttcctgcaggggtacctcccgagagtgtctcccaaatatgcatctcaacctctgaggactaaagggtggtggatgaatggatagacaggtggatgggtgggtaaatgaatggatggatgaattaataaatacatgtatgtatgtatgtatggatggatggatggatggatggatggatggctggatggatatatcggtaggtagataaatggatggatgggtgggtgtatggatgaatgaatacgtggatggatagatggatagattggtgactagatggatagatggatggttgggtgaatggataatggattaatgaatgcatggatgcatggataaatacatggatggatggatggatggatggactaatgaatacatggatggatgggtgaatgggtggatggtgggatggatggatggatggatggatggattaatacatggatggatggatgaatggacgaatggayggataaatgggtggatggtggggtggatgcatggattaatacatggattgatggatggatggatggatggatggatggatggatagatggatggggggtggatggatggatggatgaatacgtggatrgatggacggatggtggggtggatggatggatgtatgaatacgtggatggatggatggtggggcagatggatggatgagtagatggatgaatgaacacatggatggatagatggatgggtagatgcgtggatggatggatgaatacatggatggataaatacatggatggatgggtaaatgggtggatggtggggtggatggatggatggatggatgsatggatggatgggtagatgggtgcatggatggatgaatacatggatggatgaatacatggatggatgggtgaatgggtggatggtgaggtggatggatggatggatagatgggtggatggatgaatgaatacatggatggttggatagatggatgggtagatgagtggatggatggatgagtacatggatggatggatgggtagatgggtggatggtggggtggatggatgatggatgaatacatggatggatggatggatggatggatggatggatgggtgaatggatraattcatgggtggatggatgggtagatggtggacggatgaataaatacatggatggatgggtagatgggcagataaatacatgggcagatggatggatgggtggtggtaggagggtgcatagatgggaaagtgggtgggtgggagggctgatgatcacttgggtgtagaccccaaggctgagcccttctccccacacagtgcaaggccaggaatgtcattatgtcttcattgcctttgcagctgcctgcagaaccagtgagtgctgttttcaggacccgccatatccggatgcagactcaggttcggggcagttcctcattgttggctgaggattatgtakggctctgcctgaccccatccacagcggcccctcccatggcctccaccaccaggccaaagacccagccctgcctgtggtcttgggagtccccaccccaccacctgctggcccattcttaccaggttcaagttgccctggagtagccagccgcctctctgaacattatcacttccctagcatggtctcagggctggtgtctgtgtccgttcagattggtcggtacatgggagaaagtacctgttaagcattttgaagccccccccccaacctgataaattattagaacatttatttcatttatttatttttgagacggagtcttgttctgctgcccaggttggagtgcagtggcctgatcacagctcactgccacctccaccttccaggttcaagctattctccagcctcagccttccaagtagctgggattacaggtgyymgccaccacacscggctaatttttgtatttttagtagagaccaggtttcaccatgtcgcccaggctggtcttgaactcctgagctcaggtgatggtgagccacctgcctcagcctcccaaagtgctgggattccaggaatgagccaccgygcccggccatattgtcggaacatttatgctcctaatgcaccctgaaaagggtctgaacactaagcagacacgctgtccattcttttgtttgataacgatttactgagcatcttctatgtgcggacacagttctagacataggcaactggctatgagctcaactaacttcccaagaccacagcctagtggaagagatagacaacaggcaaacaaatgtctatcacaaatgtgatgatgtgttttgaagaaccagaggaggaaagytggggccctggggaccccccaaaaaaaaacaccagaggagggtgagggatagagagagaggtggcaggacatctggcctctgtgaggacaagttaggaggctgaggattcggaataggttgaggtgagagacggcaggggatgaggtaggaaggacgyggggagggtttaggctgaggtgacrctgaaagatgtaagcatcacaaagatttgtcttaggcacgaagacccctccagactctggtctgttcccaagcctacaggatctcttccaggctcggcctcgggccctagggacctgagatgctatcggatatccagtgatcgttacgagtgctcctggcagtatgagggtcccacagctggggtcagccacttcctgcggtgttggtgaggacccctctaccattcccaaaccctcacccaccatcccactcttgcttcaaccccctctggtgcccctactctcggatgcgtgatcttggctgggtcaacactccttcctgggcttcagtttctcatctaagaagagagagttggaggattgtggtggggggttggtcagtgaaggtaggcatcccagggtgggtggccatgagggtctctctagtccttttttcttcttcaccctttcacttatccacccatccaaccatccatccatccatccatccatccatccatccattttttcttttttctttttttctttttttgagatggagtcttgctctgttgcccaggctggagtgcagtggcatgatgtcagctcactgcaacctctgcctcctgagttagagtgattttcctgcctcagcctcctgagtagctgggactataggcacacgccaccacacctgctaatttttgtatttttagtagagacagagtctcaccatgttggccaggctggtcttgaactcctggcctcaggtgatccacccccccttggcctcccaaagtgctgggattacaagcgtgaggcactgcgcccagccctttcattcgtttcttcgctgtgtggtgcagtccttgctgggagatactggggtccctcaaacccctccagtcccagactgatctccaaggaacccccaggctgggggaggaggtgtacaagggacagaaaaggatgctgggggctgggcacggtggctcacgcttgtaatcccagcactttgggaggctgaggtgggcggatcacttgaggccagaagttggagaccagcctggccaacatggtgaaactccatctctactaaaaatacaaaacttagacgcatgtggtggcatgtgcctgtaatcccagctactagggaggctgaggtgggagaattgcttgaaccagggaggtggaggttgcagtgagccgagattgcgcgactgcactccagcctgggtgacagaatgaaactccatctccaaacaaacaaacaaacaccaaaaaaacgatgctgggatgtgatgcacaaagtcggctgtggggtccactaggaccccagactcggcactgacaccctccttcctgctgcagccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtsaccctgcagctctacaactcaggttagcaccttgttctccccmcgtccgttttttacccagagaggccatcaggctgcaaggctggagctagagaggattcctggcccttggcaagggacttgatactactagccattgtcacttcacgtagtgtcacgcaaacactattgtgacaaagcagtctttcatggtccccttaccaatcccctattcgtgggcacktagattgcttctggtttctctctgctagccataatgctgccaagacctggttgggttcttattatctgttctcatgactcgacatcatgtattttgccgggtgcggtggatcacrcctgtaatcccagcactttgggaggctgaggtgggtggatcacaaggtcaagagatcgagaccatcctggtcaacatggtgaaaccccatctctattaaaaatacaaaaattagccaggartggccacgcgcgcctgtagtcccagctactggggagactgaggcaggagaatcgcttgaacccgggaggtggaggttacagtgagctgagattgagccactgcactcctgcctggcgacagagcaggactccatctaaaaaacaacagcaacacacaaaaaagccaaaaaaatttgcctggtgtggtggtgcatgcctgcaatcccagctacccaggaggctgaggcgggagaatggcttgaatccaggaggcagatgttgcagtgagctaagatcaagtcactgcattccagcctgagtgacagagcaagacactgtctcaaaaaaaaagaaaaaaaagaaaaaagaaaagaaaagaatgaaggaaaacatgtcatttgccacaacatggacaaagctggaggacattacgctgagtgaagtaagccaggcacagaaacaaaaacatttcatgatctcacttacatgtataatctttttttcttttttcttttttttgagatggagtttcgctctgtcgcccaggctggagtgcagtggcgcgatctcggctcactgcaagctctgcctcctgggttcacaccattctcctgcctcagcctccccagtagctgggactacaggcgcccgccaccgcgcccggctaagtttttgtatttttagtagagacggggtttcaccgtggtctcgatctcctgacctcatgatccacccgcctcagcctcccaaagtgctgggattacaggcgtgagccaccgcgcccatcccacttacatgtataatcttaaaaaaaaaaagtcgaatatctaggcaccgaaagtagaactgtggttaccggggatggagagaaggaggaaatgggggagatgtaggtcaaaggaatacaatttgtagttacgcagcacaaataaatctagagttccaaggtacagtagagaactataattaaaaataatgtatattgaaaatttgctaaaagaatagatttaagggctgggtgcagtggttcacgcctgtaatcctagcacttcgagaggccgaggtgggaggatcacctgaggtcaggagttcgagaccagcctgaccaacatggtgaaaccccatctctactaaaaatacaaaaattagccgagtgtggtggcgggcgcctgtaattccagctactcgggatgctgaggcaggagaatcacgtgaacctgtggtatggaggttacagtgaaccgagatcacaccactgcactccagcctgggtgacagagcgagactccatctcaaaaaaaaaaaaaaaaattttaagtgttctcaccacacaccaaaaaagtaattatagaaggtgatggatatgtatatatatttttaagagatggggtcttgctgtgttggccagggtggtcttgaactcctgggctcaaatgatcctcctgtcttggcctcccaaagtgcttygagtacaggcgtgggcccctgtgcctggccatggatatgttaaattccttactgtagtaatcatttcactatggatatgtatatcaaaccatcatacctcttaaatttatacaatgatataaaaaaagaatcaggccgggtatgaccacggtgcagcaagactattttatgctaatttatgtctctccttrggtcaggttccttgaaatagatctaaaaactaagtacgatttccctgatagttctaaacaaacaaacaaacaaaaaaagaatkggctggacacagtggctcatgcctataatcccagcactttgggagcccgaggygggyggatcacccccaagagacaggcacttttgtaaattgcttaccagaattgattaccctctggcaagcaatttacaaaagtgcccgtctcttcacagccttgccagcaatgggtgttaatattttaaagttatcttcactaacaggatcctgtgtataaatctttattaaaaatkatttatttttaaattttaatttaattttaatttgttttgagacagagtcttgctctgtcacccaggccggagggcagtggtgggatcttgtctaactacaacctccgcctcctgggttcaagcgattctcctgcctcaggctcccaagtagctgggattacaggtgcccaccaccatgcctggctaatttttgtatttagtagagacggtgtttcaccgtgttggccaggttggtcttaaactcctgacctcagatgatccacccaccttggcttcccaaagtgctaggattacagctatgagccactgctcctggccatatttgttgtttttttagagacaagttctccctctctctcctagattggagagcagtggtgtgatcagggctcacttcagcctcagcctcctaggctcaagagatcctcccatctcactctcctaagtagctggaaccacagtcatgaactaccatgcctggctaatttttatgtagagatgagggggtctcactatgttgcccaggctggtctcgaactcctgggcttaagtgatcttcctgccttggcctccyaaaatactggaattacagggtgagccaccgtatgtggcttgtgtataaatcttgactttttgatcataatataccaggcttagctgggacctgcaagtgtcccctaattcatatttagggattcagttgcttaccctggacagggtggattttcagggcccattaactcacatacgtgtgggctgcccctcgccaatccctacctctgcttccagttaaatatgagcctcctctgggagacatcaaggtgtccaagttggccgggcagctgcrtatggagtgggagaccccggataaccaggttggtgctgaggtgcagttccggcaccggacacccagcagcccatggaagttggtgagtttgtttcccaagtccagggtggacacgggcctctccagggcaccttcacccccaaatcagtctcaccatctctgcatctgtccccgctcccaaccagcccccactctagcccctgaggtggtttttttctttttctttttttttttctgagacggagccttgctctgtcgcccaggctggagtgcagtggcatgatctcagctcactgcaacctctgcctcccgggttcaagcgattgtcctgcgtcagcctcccgagtagctgggattacaggcatgcgcccactaccacacgcagctaatttttgtatttttagtagagacggggtttcgccatgtgggccaggctggtctcaaactcctcaggtgatccgcccaccttggccttccaaagtgctgggaatacaggcatgaaccaccaygccttgctcccactaaaattttttaaaataaattttttcttttggaataaccttcgattttcagaaaagttactatataaactggtgcagagaacgcccatatatcctttacccaaactcctctaatgttaatgtcttacataaactccaggcattatttgaatgtcaccaatttttccaggaatgtcttttttctgctcccagattcaatccaggatcccacattgtgtttagtaaaataattattaatttttaaaatttagttataataattttttacygctttatatgttcctaaagaaggtttgaacctagagaaggttctctagtaattaaygatagaaataatccctggaagtatggtctttaatttaaaaaaatttagcgaggtgcggtggctcacgcctgtaatcccagtgctttgggaggccgagttggggtgggattgcttgaggccaggagtttgagaccagcctgggcaacatggtgaaatcccgtctctaccaaaaatgcaaaaattagctgagtgtgatggtgcatgcctgtagtcccaactactcaggagactgaggcgggaggatcacctgagccctgggaggttgaggcttcaataagccatgattgcaccactgcactccagcctagatgacagagtgagaccgtgtctcagataaataagtaaataaataactaattgtaaaacagcaaatatttttcagcaccaaaatgcaaaacaatatatgaatatgtttttattctagggcgactgcggacctcaggatgatgatactggtgagaataataatagtaatgacaacaacagctgcagcaaattggcattaattgagcacctactgtatgccaggtccaatgctgaatttttttgtatgcctcttaccctgccccatagttcagtattggattctttccaaattgcaggtggggaaacaaatcacgacttggagggggtgagaagcctttggccaaggtcacgaccgaagggatggccgcagccaggacttgaactgaggggcagggatggacgtgggtgatcctggaggccctaagaggacagggcctggcctgcttctgctgagcccccaggacccagcacgtggctctgtacacagttggagctcaataagcrcatgatggttaagtgactggtgccaagtcctggacaattcttacggcctgatgttcgacctgcctctccccagagtcctgcctctgccccctggagatgaatgtggcccaggaattccagctccgacgayggcrgctggggagccaaggaagttcctggagcaagtggagcagccccgtgtgcgttccccctggtaagatcactctgagtacaggaacaggggcaagcattagaaataaggcaacagccggaggtggtggtgcacacctgtagttccagctgctcagaaggctgaggcgggaggatcacttgaggccagtggtttgagaccagcccgggcaacatagtgagaccccatctctaaaaaataaaataaaatgggkctgggcgtggtggctgatgcctgtaatcccagcactttgggaggctgaggcgggcagatcacttgaggtcaggagttcgagaccagcctggccaacatggtgaaaccccttctctactaaaaatacgaaaattagctgggcgtggtggcgggagcctgtaatcccagctacttgggaggctgaggcaggagaatcccttgaacccgggaggtggaggttgcagggatccaagatcacaccactgcactccagcctgggtgacagggccagactctgtctcaaaaaaaagtaaaaaaaaaaaaaaaaagtaataataaaataaaatggaaaaagaaataaggcagcaggtattagaaacaaggtggtgagtgttagaaataaggcagagggagaaatgggtgctcaaaccctgacaatgtggcatccggtcttgctgcacccactttagggttttttgctgctgttttttttgtttgtttgtttgttgttttttgttgtttttttttttgagacggagtctcactctgtcacccaggctggagtgcagtggcgccatctcggctcactgcaagctccgcctcccgggttcacgccattgtcctgcctcagcctcccaagtagctgggactacaggtgtctgcaaccacgcccggttaattttttgtattttttagtagagacggggtttcaccatgttagccaggatggtctcaatckcctgacctcgtgatctgccctcctcggcctcccaaagtgctgggattacaggcgtgagccaccgcgcccggcctactgctattttttgttttgttttgagactgtcttgctctgtcaccctggctggagtgcagtggtgtgatcttggctcactgcaacctccgcctcacgggttcaagcgattctcctgcctcagcctccwgagtagctgggatttacaggcatgcaccaccacgcccagctaattttgtatttttagtagagatggggtttcgccatgtttgcccggctggtctcgaactcctggcctcaagtgatcctcccaccacggtctcccaaagtgctagaattccaggtatgagccactgcgctcagcccactacagggctttatcaagtgagaatcatcaggctgaacctcacggtgtctcaaggacaatgtcacctgcaggtggcagggtktactaaacagctgctgccctgagcctgggcaacaggaaaatgagtgagagggtttcaaaccatgcagaaaggcctggcgctgtggtttatgcctgtaatcccagcactttgggaggccgaggccagaggattgtttgaggccaggagtttgagacaagcctgggaatcaaaacgagactctgtctctagtctataaaacaacagcaacaacaacaaaaccatgcagagaaatacatttgcattcaaaaaggaacttagaggccaggcgcagtggctcacgcctataattccagcagtttgggaggccgaggcaagtggatcacaaggtcaggagttcaagaacagcctgaccaacatggtgaaaccccgtctctactaaaaatacaaaaattagccggacatggtggtgcatgcctgtaatcccagctacttggaaggctgaggcaggagaatcgcttgaacccagaaggcagagattgcagtgagccgagatcgcaccagtgcactccagcctaggtaatagagtgagacttcgtctcaaaaarcaaacgaacaaacaaacaaacaaaaaaccttaggcaacatgagattacaggtggcagttatccctggggatgcaaattgtgttaatttttcttccttcagttttttctcttttctgcaatttggggcagcaagggattttcactttgtaaatgtggagaatccatcatttacaaagaaaacatccatcagtctttctctccttccaattcgtctagttggtttggttctgattgcagaaaaccccccacagcctcaggtgagattctcggtggagcagctgggccaggatgggaggaggcggctgaccctgaaagagcaggtaacggggctgtcacagggctgtggggtggcctgggatggggagcaggaggcaaaagcctaggcgggggatgagcaagtggtagatggagggagatgagatgtagaggtggcaggaagtgggcaaattgtgggtttaactctgaaggtaatagggagccatggagtgtgtgtgtgagcaggagaggcacatgactggactcagatgttcacagactttccctggctcctgtgtgagaaacagagtgtgggggaattgcacagaagccagaaggccaggaaggagataatggtgactgcatttgcctgggtagcagattattgctttaagtcccaaaacaacccattaagtgcagtctgattagtttacagagagggaaactgaggcatagagggagtatctctgttgaracaaaactgacaaatactccactcgttgactttaccatagtcatcttagtcaggtccctaatgggctgttactataaggctgtagcaaaaatcctttatttcctatgttcctctaactcaaattcctcttcttttttttcctttttttttttttttttttgagatggagtcttgctctgtcgcccaggctggagtgcagtggcgccatctcggctcactacaagctccgcctcccgggttcacgccattctcctgcctcagcctcccgagtagctgggactacaggcgcccaccaccatgccgggctaattttttgtatttttagtagagacggggtttcaccgtgttagccaggatggtctcaatctcctgacctcatgatctaccygtctcggcctcccaaagtgctgggattagaggcgtgagmccccgtgcccggcctctcaaattccttttctaaggaaaaattttctgcttgaggtaactgggttaaaagatggaaacatttttgttttcctgaatgtcagtgggttttgtcaatttcccacctccctcaagctagatgtgtgcgggaggtgaatgcctgtctcacagcagctttgccagcattgaggtttattattcttttaatttttgatgcatgttattggctgtggcctttgtccaagtctgtcttcataggctgtgccctgctgtctgcctatgggatgatgagtgtgatcaggtacccacaagctgtctttcatactcctgacagccaacccagctggagcttccagaaggctgtcaagggctggcgcctggcacggaggtcacttaccgactacagctccacatgctgtcctgcccgtgtaaggccaaggccaccaggaccctgcacctggggwagatgccctatctctcgggtgctgcctacaacgtggctgtcatctcctcgaaccaatttggtcctggcctgaaccagacgtggcacattcctgccgacacccacacaggtgcctcctctgggtggggagggcggtatgagggcccctcagagctgagcacctactctgagcctcagctagaccagggtgagaggagcgaggcagaaaattttaaaggagtgcctgatttaggggtgtatcaaaaattcagtaatcagcyaggcacggtggctcacacctgtaatcccagcactttgggaggctaagacaggtgaatcacctgaggtcagcagttcgagaccagtctggccaacgtggtgaaacccagtctctactaaaaatacaaaaattagctgagtgtggtggctgtagtcccagctacttgggaggctgaggcaggagaatcgcttgaacccaggagccagaggttgcagtgagccaaaattgtgccattgcactccagcctgggcaacaaagagcragactgtgtcaaaaaaaaaaaattcaataatcaagatccataatgcagttttttgttgttgttggtttgttttttttaagagacagagttttgctaygttgcccaggctggacttgaacttctgggctcaagcaatctttctccctcagcctcccaaatagctgggaatataggcatgtgccatcatacctggctattatgcattattaaagaacaacaacaaaaactagctgagccactgcgytccaccctggttgatagagctacactctttttcaaaaaagaaaaaagagagaaagaaagaaaaaaggctagagttgaccctgtgtttatttaagatctaatttcttttttttcttgtgacagatggcatgatctcagctcactgcaacctccgccttccagattcaagagattctcctgcttcagcctcccgagtagctgggattacaggcatctgccaccatacccggctaattttgtatttttagtagagacggggtttcaccacgttggccaggctggtctcgaactcctgacctcaagtgatccacctgccwtggcctcccaaagtgttgggattataggcgtgagccaccatgcccagcctaatttttgtatttttagtagagatggagtttcaccatgttgcccaggctggtctcaaactcctgccctcaggtgatccacccacctcagcctctcaaagtgctgggattacaggtgtgagycactgtggccgacctactatttttattatttttgagctaggttctcagtctgttggcagactggagtgcaatcatggctcactgcagccttgaactcccagactcaagtgatccttccacctcagcctctggagtagctgggactacagacatgcaccaccacacctggttaattttttatttttattttttgtagagacaggtgtctcyctacgttgcccaggctggtctcgaactcctgggctcaagtgatccacccatctccacctcccaaagtgctaggattacaggcgtgagccaccgtacccagcctggtcccatatcatagtgaaatggtgcctgtaaagctctcagcattggcttggcacatgcagttggtactcaataaacggctgttgctatccccagaattgcaagcagtatccatctctctgacattcatgaagacgccctggcgggagggagtgggagagatttgcccagggactgagtgggtgtgtrctcgtgcttctgagtttggcatgagaccaccagtggcgccggtcaggccagggaggcctagtcttgcatcacactctccgcctaggctaggcaagtggtgggcagccaggtatctgccacagccggagacgcctacaaggctggaagtgggtgtaatggcagtacaggaagctctcatggtgaatatcctggcaaggagacagcagttaggctggaggaggactcagctcattcaaacaccacctgctgactggatgcggcggattaygcctgtaatcccagcactttgggaagccaaggcaggtggatcactggaggtcaggagttcgagaccagcctgggcaacacggtgaaaccccatctccaccaaaaaataataataaattagccaggaaatggtggcgcatgcctgtrgtcccagctactcaggaggctgaggcaggagactcatttgaacccgggaggctgaggttgcagggagccgagatcatgccactgcactccagcctgggcgacagagcaagaatccgtctccaaagaaaaaacaaaaaaaaacaaacgccatctgctacccactttgtgcctggccccaaggcagcctccagtgcagggaaacagccaaacacagacayccctggccctgtagggtcaggggtatagacgagagggtgggagagaggctgcaggagccagagaaggggactggggagagagatggcaactgtctcgatgcgtctctcccctctccttccagaaccagtggctctgaatatcagcgtcggaaccaaygggaccaccatgtattggccagcccgggctcagagcaygacrtattgcattgaatggcagcctgtgggcyaggacsggggccttgccacctgcagcctgactgcgccgcaagacccggatccggctggaatgggtaatggcctggaatggcctgcgcctacccctcctctgtgccctcccttttaggtcctggtgggttcaaacctgcagggaaggcacacagygggtgtctaagkcccagagaggtgttgcygcttactcaatgtcatacagaggtagggacagggtgaggttyggagcctctcacccatatgggtctggaacctcttgctggcatcctgagctcagttccaggcagatcacacacatacaggtaatgaatctcacatcccaaggtgtttgttaaatattcaaccrcgccagggaaggtggcagttcgcgagatgctggtggcaaattaatgagcagtctttarggaaaggggggccgtgaggctcaggtggcctctcactctcccgcttcctgctctgggccttgccagagccccagaaagcctcagcctcagcctgttccttgaagaatacacagcctgaggagacagaactggacacggaacccctgaccccattgtccgggcaaggtggctaacacctgtaatcccagcactttgggaggctgaggcaggtggatcaacagaggtcaggagttcgagaccagcctggccaacatggagaaaccctgtctctactaaaaatataaaaattagccaggcatgatggtgtgcacctgtaaatcccagctactcaggaggctgagacaggagaatcgcttgaacccgggaggcagggattgcagtgagtcaagattgcgctattgcactccagcctgggtgacacagcgagactccatctcaaaaaaaaaaaaaaaagaagccctggttccatggagtaagggctgggttagagggggatggggatggggttgggggtgttgcatagggaagagatcttggaggaggggatattggtgcaagggctttgaaacatgagtaggagttttctgggggttcctggcagatggcacagccagtgcaaaggtgcagaggtgggaacacaatctactgaatggcctggcctttgcttatccttccagcaacctacagctggagtcgagagtctggggcaatggggcaggaaaagtgttaytacattaccatctttgcctctgcgcaccccgagaagctcaccttgtggtctacggtcctgtccacctaccactttgggggcaatggtaagtgacccaaacctgcaggtttacattattttttctttttaaataatttaaaaaaatagaggctgggcacagtgactcacrcatgtaatcccagcactttgggaggccaaggtgggtggatcacctgaggtcaggagtttgaaaccagcctggccaatgtggcgaaaccctgtctctactaaaaatacaaaaattagccgggtgtggtggcgggtgcctgtaattccagatacttgggaggctgaggcaggagaatcgcttgaacccaggaggcggaggttgcagtgagctgagatcatgccactgtactccagtctgggtgacagagcaagactctgtctcaaaaaaaaaaaaaaaaaaaaaaaaaaggacaatgctgttaaggcagacagaatggctcacccctgtaatcccagcactttggcactttgggaggctgaggcttgtggatcacttgaacccaggagttcaagaacagcctgggcaacatagcaagaccccgtctctacagaaagaaaaaagtttgccagccatggtggcatgtgcctgtagtcccaactactcaggaggctgaggtggkmagatcacttgatcccaggagtttgaggctgcagtgagctatgattgcaccactgcaatcatacaacctctgcctcccgggttcaagccattctccttcctcagcctcctgagtagctgggattataggtgtgcactaccatgcctggataattttttgtatctttagtagagacagggttttagcatgttggccaggctggtctcaaatgcctaacctcgtgatccacctgccttggcctcccaaagtgccgggattacaggtgtgagccactgcgcccggccagcattgtccattttatagataagaaaactgaggcccagggaagggaaatgacagtgactgagtggcagaaccagaattaaaacccagctcacctgactctgtggccaatgttacctccgtctctggacagtgggaggctgggcattcaggaagtgctcaaccagcactccttttttttttttttttttttttttcttgagacagagtcactctctgtggcccaggctggagtgcagtggcacgatcttggctcactgaaacctctgcatcccgggttcaagcgattctcgtgcctcagcctgccgagtagctgggattacaggcgcccaccatcatgcctggctaatttttgtagttttagtagaaacagggtttccccatgttcctcaggctagtctcgaactcctgaccttaagtgatctrcccaccttggcctcccaatatgctgggattgcaggcatgagccatcgtggctgggctttttttttttttaaagacagggtcttgctctgttgcccaggctggagtgcagtggtgccatcttggctcactgcaacctctgcctcctgggctcaagtgattctcctgcctcagcctcctgagtagctgggattacaggtgtccgccaccatgcctggctaatttttgtatttttagtagagaaggggttttgccatgttggccaggctggtcttgaactcctggcctcaaatgacttacccacctcggcctcccaaagtgctgggattacaggtgcgagccactgtgccaggcctcgaccagcattcttggtgttgactatgacaatggtactggttgcagcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcaggtacgtgaggcagtgcagacctggcttggggaggaagggaggatcctggcctgtgatctctcttgctgtgtgaccctgggcaccttgccgtccttctctgggccttggttatcaaacccttaaaacaagagaattggctgggcgcagtggctcacgcctgtaatcccagcactttgggaggccaaggcgggcggatcacctgaggtcaggagttcaagaccagcctgacmaacttggagaaaccccgtctctcctaaaaatacaaaattagccgggcatggtggcacatgcctgtaattctagctacacgggaggctgaggcaggagaatcgcttgaacccaggaggcggagattgcagtgagccgagattgtaccagtgcactccagcctgggtgacagagtgagactctgtctcagaaaaaacaaaaacgaaaacaaacaaacaaaaaacaaaaacaagagaattagacttgagggtcttttttttttttttttwaattttatagacagggactcactctgtgcccaggctggagtgcagtggtgccatcatagctcacagcagcctcaacctcctgggctcaagcgatcctcccacctcagcctccctagtagctggaaacacaggtgcacaccaccatgcacagttaatattttattttttgtagaaatgaggccttgctatattgcccaggctgggattttttcttttttttctttttgagagggagtctgtctctgtcacccaggctggagtgcagtggcgccatctcagctcactgcaacctctgcctcccgggttcaggcaattctcttgcctcagcctcccaagtagctgggattacaggcacccaccaccatgcctggcaaatttttgtatttttagcagagacggagtttcaccatgttgaccaggctggtctcaaactcttgacctcaggtgaatcacccgccttggcctcccaaagggctgggattacaggtgtgagccaccgtgtccggcctcgctcaggctggtttcaaacttctggcctcaaactatcctcccaccttggcctcccaaagtgctgggattagtcatgagcacccagctgaacttgagggtctcgatcaccccttgcagaccctggagaaggctgggtgggcaccagccaagtgcttatggtgtattggattcatccatgggaagctgcccctcacatgtagcagcagctgaactctcatcaagcagggatgactgtctccattccacagatgaggaaacyaaggcctggaggggggatctgatgagggacaggaaagcccacaaaacagggtttagccaggagggtttttggctttccccaggaaagagttcaagtgcatgtcggtggtgttagacagaaacttttactgaagtggccgtgtagagcagcagcagaagtcctgctccttgcagagtggggacgccccacaggcagggcagctacgtctcatatttatacccgcttttaattatatgcaaatgaaggggcggtttatgcagaaatatctaggatgaaggtagtaacttccgggttgtgggatcattgccgtggacaggggcggtaatttccgggtgttgccatggtaatggtaaactgacatggcacactggtgggcgtgtcttatggaaagcccaggacctgctttagctagtcctcagtttggtcctgtgtccaagccctgcctccagagtccaatcctgcctccaacctcagatccacctgcccaaagatccaacaagtcagccggacgcggtggctcacgcctgtaatcccagcactttgggaggctgaggcgggcggatcacttgaggccaggagttcaagaccagcctggccaacatggtgaaacctcatgtgtattaaaaatacaaaaaattagctggctatggtggtgggcgcctgtaatcccggctactcaggaggctgaggcacaagaatcgcttgaacctgggaggtggaggttgcagtgagctgagattgtgccactgcactccagcctgggcaacagagtgagactccatctcaaaaaaaaaaaaaatcttgagatgaatgggcgcattaagagaagagattttaggttgggcttggtggctcacacctgtaatcccagcactttgggaggccgaggtgggcagatcacgaggtcaggagatcgagaccatcctggctaacacagtgaaaccccgtctctactacaaatacaaaaaattagctgggcgtggtggcgggcgcctgtagtctcagctactcgggaggctgaggcaggagaatggtgtgaacccaggaggcagagcttgcagtgagccgagatggcgccactacactccagcctgggcgacagagcaagactccgtctcaaaaaaaaaaaaaaaaaaagaaagaaagagtagagattttagcaaaatgcctatgaatccccaccccacccacaggctgtggtagcccagcctggcctctgaggagtaaagaggtcccaggactcagggttgcctctcccactgcagagcatcccgtgcagcccacagagacccaagttaccctcagtggcctgcgggctggtgtagcctacacggtgcaggtgcgagcagacacagcgtggctgaggggtgtctggagccagccccagcgcttcagcatcggtgagtggagggggtaggacccagttatttacccagcatgcactgcactgcgcttcccacaatgatcttagcagccctgccctcactctcactccctctatggctccctactgccctcaggagaaagtagcagctcaaactgctcccattgccttctctcgcagcttcctctcacactccaggagccttgcccatgcaggcccttccctgcctcctgcctggaatgtttgttttccacacggtccaactcctattcgtccttsaaaactcagctcaaaagttccctcctccagcaagacttctctgccyccttctggccatgcccttgtttacaactgtcccttctccctggtctgacactgcggggttggggtagatgtgtcaaggtatctgggggctcttggggaggaggaagatgcaggaatctgttcattgagcgacaaataaatgaatgcaaaaataaggaggacacaggcaaaacccggtgtggtggctcacacctgtaatcccagcactttgggaggctgaggctggaggattgcttgagccgaggagttcaagaccagcctgggcaacatggtgagacctcatctctacaaaaaatatttttaaaatagtggggtgtggtggtgcacacctgtagtctcagctgctcaggaggctgaggtgggaggatggcttgagaccaggagttcaaggttgcagtgagccgtgactgcaccactgcactctggcctgggcgacggagcaagaccctgtctcaaaaaaaaaaaaaaaaaaaaaaaaaaaaaaaaaaaatagaagaagaagaaggagaagaaagaagaagaagaggaagaggaatagaagaagagggaggaggaggaggaggaggaggaagagaacaacacaggctctgttgtcgggtgcatggttataagagattcagagatcaaatgatccctgttcatgccacggtgtcctttcagttccaagagaaccaactggaacccagagaacaaaagagtcagggttggtggggggcaggcaggcctgggtccaggggcagccacatgtgccctatgtgcaggctcctggaattacrgagtctttttttatctttttgagacagattttccctcttattgccgaggctggaatgcaatgatgcgatctcggctcactgcaacctccgcctcccgagttcaagcgattcttctgtctcaccctcccaagtagctgggattaccggcgcacaccaccacgcccagctaatttttgtgtttttagtagagacaggtttcatcatattggtcaggctggtctcgaactcctgacctcaggtgatcagcccacgttggcctcccaaagtgctgggataacagtcatgagtcactgtgcccggcctggaattacagagtcttgaacacttcctgcatgccaggcctttatttcttgacagctaccgggcaggtgggttctgtggtctcccagtgagaagcccgtggcatgtgcaccaggatcagcagcaagttcatggagaaaccaggccctcctagctccttccctgaggaagaggcaggaggtagccctctgccaacccacgctctcccacctcagaagtgcaggtttctgattggctcatcttcttcgcctccctggggagcttcctgagcatccttctcgtgggcgtccttggctaccttggcctgaacaggtaactgacacctcttaccgttaccatagcgatggtaatgatgctgggcaggggagccctaaagtggagcttagcccgcagattgggtccttggctttgcccaggaaataattcaagggcaagccagaggtagaagaaaacagctttattgaagcagcagttatagctccgtgactgcctctgcagagcagggcttccctgtaggcggagagtagccgctgagagcggttttgcagtcagatttatacttacttttaattgcatgcagattaaggggggcagtttatgcaaaatttctttcttttttttttcttttttgagatggagtcttactctgttacccaggctagagtgcagtggcacgatcttggcttattgcaacctccccctcccgggttcaagccattctcctgtctcagcctcccaagtagctgggactacaggtgcgtgccatcacacccagctatttattttgtattttcagtagagatagggtttcaccatgttggccaggctggtcttgaactcctgacctcaggtgatcctatgcagaaatttctagggaagggatagtaacttttgggtccttggtcattcccatggaaaggggcggtgacactggtgggcatgtctgattgaaagctgctttcaagccgggcacggtggctcactcctgtaatcccagcactttgggaggctgaggcaggcagatcgctttaggccaggagttggacaccagcctggccaacatggcgaaacctctctctaccaaaactacaaaaattagccgggtgtggtggcacacgtttgtaatctcagctactcaggaggctgagtcaggagaatcgattgaacccaggaggcagaggttgcagtgagccgagatcgcgccactgcactccagcctgggcaacagagcaagactccgtctccaaaaaaaaaaaaaaacctcagctcctctcactggtcccctttcctccccagggccgcacggcacctgtgcccgccgctgcccacaccctgtgccagctccgccattgagttccctggagggaaggaggtaaggatgccttttctaattccaagtctttttattgggtgcacaygctggacaagggttacgcattagctcattttattctctcccaattcatcaaggtaaggactccaaaaccagtgctccataccccttcccattttaaagacaggcaggcagaggtccatttcctggcactagaaacagaattcaaagtggctttattataaaggaaacctgatggaaaaaatcccaagggaatgggcttcagatatgcctgaatccagcgattggggtctatctcggagctgcccgttcagggttcttccgcaggcaggctgagccttctctgattggaagcagggtgtccattttccccattaactggggcaaaagtctcagggccatcactgattggtccagcttgggtcacatgcccttccctgagcctatggctagaaccagaggggtagggaagggtctgatgggtgggctggccagggtcacatgaccattgctagagctgaggtggggtcactgcactgtcaaccacaccatctgtgaaaagagggagggaaatttcccaaagacagatgggagtgytcttcctaagaggggctgaatgggagtcagtgcggcagactccatcctcaaatcggtctcaggatatatggagtctcgctctgtcacccagcctggagtgcagtggcgccatctcggctcactgcaacctctgattcccgggttcaaacgattctcctgcttcagcctcccaagtagctgggattacaggcgtgcgcaaccaagctcagctaatttttgtatttttagtagagatggggtttggccatgttctccaggctggtctcaaactgctgacctcaagtgatccacccgcctcagcctcccaaagtgctgggatgacaggtgtgagccactgcacccgtccaggtctcaggatgttagagaatttaaccagcagtgacctggtccrttccatcctgctgtggatgggaagtagagctctgctcacagctgtggccctaccctccctctgcagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacaggtgcaaggccaaggtcctggggcccagtgggccagacggtcaggggtgcaaccctgcccggggggtgggggggctagacatccatcgctcctgggatatcagggcctggaggcctgagggagaaacgaaaacatccactttgtcttacagacacgaagagcgactatctcaatcacaacggctggttattaagcacttatggcatacccagcccattccatccactcacatgattccctaccaaatccctacaaccaccccctgaaaggaaccatgactgttgtactttacagatgtgatcgttgaggctcagagagggtgagtgactcgccygaggctacgtagcacacacaggagtcacatttggacccaaataacccagagctcctccaggctccagtgcacctgcctcctytytgccccgtgcctgttgccacccatcctgcgggggaaccctagatgctgccatgaaatggaagctgctgcaccctgctgggcctggcatccgtggggcaggagcagaccctgccatttacctgttytggcgtagaatggactgggaatgggggcaaggggggctcagatggatccctggaccctgggctgggcatccacccccaggagcactggatggggagtytggactcaagggctccctgcagcattgcggggtcttgtagcttggaggatccaggcatatagggaagggggctgtaaacwttgtgggaaaaatgacggtcctcccatcccaccccccaccccaccctcacccccctataaaatgggggtggtgataatgaccttacacagctgttcaaaatcatcgtaaatgagcctcctcttgggtatttttttcctgtttgaagcttgaatgtcctgctcaaaatctcaaaacacgagccttggaattcattcattcattcattcattcattccacatatatttattaatctcttcctctaggtctcctccaggagcacctaatccgggggagacagagccggatgagagcttggaaccctactaagttaggactgagcaggggaagggacggcctagggggagtggagcagccgggcactccggtaacaggaaccgtggtttgcccccacgctccttcctcctcacgcccaccaactcgcagcaggacccttgccccccttacacaccctgaatcctccctctttctgcccacactgccccacctccctcgcgttctgcagccgcctccccctgatccccactgcggtctgagccgaggtgtgggggggsgctcctgaaatcccaccccagccctggcgattagcgggtagtccagattctccccatggccaccaggtggcaacagcggcgcgcgtttccccggccgggcccgccctgcctcctcccaccgcgtttgctaaacagacttttccggtttcagacagaggaggggagttaaaaagcccagaactactgaattttgtggcaaaaaaaggatgagacctctcggggagagacccctggcagccaatagggccaggaggcaagaggcccaggccccgcccctttggtctgggggcctccctttccccatcgatgcatctagatagggaaacagaggcctggatctcggtgccccagccacacggtggctggtcagagttctgcaaatgccccccgccccgctccggatctgccacatcccagcttctgctcaagccgttccctccaccaggcatgccctcccttgagcgtttatcctcctttcttttttctgagacggagtttggctcttgttgctggagtgcaatggcgcgatcttggctcacggcaacctcccgggttcaagcgattctcctgcctcagcctcccaagtagctgggattacaggcgcccgccaccctgaccagctaaaatgtgtttgtatttttagtagaaacagggtttcaccatgttggccaggctcgtcttgaactccagacctcaagtgatccacccgcctcggcctcccaaactgctgggattgcaggtgtgagccctggaggcccctggagttggccgcaaacccacccctatgcacagtcccttgggtgcgagaagtaggagacaggcaatgtttactggcagcagctgggacttttgccagagtgcatggggaagatgcacaccctgcttccactagcgggagactgagctggacagagggaagcctggagcttggagcctctttccttcctaccgtggggatgcctgtctgagagaggagcctgcagggaggacagcagcaccgagatgaagcattagttcctggatccagccatacctgaaacccaatattttccatctggttcctctttttaaaaaatattttaggccgggcatggtggctcacgcctgtaatcccagcactttgggaggcagaggcgggctgatcacctgaggtcaggagtttgagacaagcccggccaacatggtgaaaccccgtctctactaaaaatacaaaaattagctgggcgtggtggcaagcgcctataatcccagctacttggtaggctgaggcgggagaatcgcttgaacctggaagggggtggttgcagtgagccgagattgtgccactacactccagcctgggcgacagagcgagactccgtctcaaaaaataaataaataaataaataaataaataaatatttttttttattttttgtttcttttttgagacagggtctcactctgttgcccaggctggagtgcagtagcaccatcttggctcactgcaacctccacttcctaggatcgagtgatcctccagcctcagcctcaggctcaagccttgttgccaaggttttgccatgttgcccaggctggtctcgaactgctgagctcaaatgatccacctgacttggcctcccaaagtgctgggattacaggcatgagccactgcacccggcctcagttccctgtttgatgaagccactttgagtccttcttctgtccctagaaaatgaccaacaggaggttctttctgggcctctgcttacccgtctataaaataggaagggatttggagtccttttctcaatgggcccagcaagtttgcttagctgggccctggcctggtatttattgagcaactgctatgcaactattactccagggctcctcagagcagccattgcctcagcttctcccagcagctccaggagtcaggatggtgttagcccccatttcacagctcagtttcattcattcatttaagaaatcagggtccggcgcggtggctcacacctgtaatcccagcactttgggaggccaaggcgggccgatcgcttgagctcaggagttcgaggccagcctggccaacatggtgaaaccccgtctctactaaaaatacaaaaattagccaggtttggtggcacatgcctgtagtctcagctacttgggaggctgagggctgaggtgggagaatcacctgagcctggggaggtcaaggttgcagtgagctgagatcgcgccactgcactccagcctgggtgacaaggtgagaccctgtctcaaaaaaaaaaaaaaaaaagccagcattgagtgcctactgtataccaggccccatcttgcacaagtcaggatcttcctggtcataaggggctcttagctgggtggggaaggcagacactaatctaattatcactcagagagttatgagaaaccgtaagagtgatgagtggggatgtgaggagtagccagtgagggagggcttcctggaggaggcaatgctaggaccaaggtggtaaagaggggccagaagagggagtgcaaaggccctgaggttgctggtggggaatggacgggggatgggggaagaggttgtagcccacgtgaggctgggggcatatggaccagagctgttttttttcttttgagatggggtctcgttctgtcgcccaggctggagtgcagtggcgtgaccacagcgcactgcagcctcgacctctcgggctcaactgttcctccttcctcagcctcctgtgcagctagaaccacaggcacgtgccaccacgctcagcttagtttatttgattatttgtagagacagagtctcaccatattgcctgggctgatctcaaactcctaggctcaagtgatcctcctgtcttggcctctcaatgtgctgggattacaggcgtgagccactgtacccgtgggctaggtttttttttttttttgagatggagtctcgctctgttgcccaggctggagtgcagtggcgcgatctaggctcactgcaagctctgccttccgggttcacgccattctcctgcctcagcctcccgagtagctaggactacaggcgcccgccaccatgcccggctaatctttttctgtttttagtagagacggtgtttcaccatgttggccaggatggtctcgatctcctgacctcgtgatccgcctgccccgtcctcccaaagtgctgggattataggcgtgagccaccgcgcctggcgggctagggttttattcttgggttgtggggtcctggagctggagagtcaggtcctgacgggtgagaggttcagagtttattctggctgcagttcagctgggagttttctggctgcagttcagctgggagtaagtgattcatcttgtgggcctcagttttctggtccataaaatggatgtggtcaggcagcctctccagagcccctgcccctcttcccacctcccctcctctgtctctgtctttcctgatccatcttttcccttctccatggctcccacctactgggtgggaagcgtgtctccatcagagagataggctgcctcagtttaccttcccaggtaccttccttctctatctctccagtagcctctgggtttggtcagaaacagatgttgtctctgcctctgcccttcagccgggatgggactgaggtgtcaggtttctgggaaccatgagctgcaggagatgacccctggactcagggtagcccctggcctggcccctgatactttattatctgtgccccagatgccaggccctctgcccaggaaggcccttcttccaactctgccctctgcccatttctctctctctcttttttaactcatttctttcatttaaaaaaaaaatttaaagtagaaacagagtcttgctatgttgtccagaccaatcttgaactcctgggctcaagcaatcctcctgtctcagcctcccaaactgttgagattataggcacgagccactgagccccagccttattcctctttttttttttttttttagatggaatctcactctgtcgcccaggaggctggagtgcagtggcgtgatctcggctcactgcaaccccacctcctgggttcaagcaattcttctgcctcagcctctggagtagctgggactgcaggcacccaccaccaagcatgcatggctaatttttgtatttttgctagggacggagtttcaccatgttggccaggctggtctcaaactcctgacctcaggcgatctgcccaccttggcctcccaaagtgatgggattacaggcgtgagtcactgcgcccggccattcctccttttttaagatacattcacacaccatacaattcaccctcttaaagtgtacagttgacactgagcgtggtggctcatgcctgcaatcccagcattttgagaagccgaggcaggaggatcacttgagcccaagaggttgaggctgcagtgaaccgtaattgcaccactgcactccagcctgagtgacagagtgagaccctgtctcaaaaaaaaaaaaaaaaaaagtacaattcagtggtttttgtacaatcacaaggttgtgcagccatcactcatacctaattctagaacattttcatctccccaaaaagaaaaccttgtgccatcagtagccactccccgttcccctcccccagcccctggcagccactaatctgcttcctgtctctatggatttgcctgttctgggcatttcatatcaatgaaatcatacaatatgtggcctttctgtctgttcttttgtgaaagaaactcagatgtttttgaaacgcatcctcattatagtgtgtgtcagggtttcgttctttttgatggctgaatagcattccattgtgtggatgtgtcactatttatttatccactcagccatcaatggacatttcggtggtttccattttctggctattgtggatagcgcagctctgagagtttgtgtacaagttttggcgtaaacacctgttttcagttttctccgtatacatctaggagtggaatcacagagtcatatggtaattctgtgtttaacttctggaagatctgccaaagttttccacgtcagctgtaccatttcacattccctccagcaaggcatgggggttcaaatttctccacatcctcatcaacacttgctattttcctttttcttttctttttttttttttttttttgagacaggatctcactctgtcacccaggctgcagtgcagtggcgtgatctcggatcactgcaacctctgcctcccgggttcaagcgatcatcctcgtgcttcagcttcccaagtagctgggattacaggctcttgccaccatgcccggctaatttttgtatgtttactagagacagagtttcaccatgttggccaggctgttctggaactcctgagctcaagtaaccctcccacctcagcctcccaaagtgttgagattacagacgtgagccactgcgcctggcctcctttttcttcttatccttctccttctcctcctcctccttcttcttctttttgatgttctgatgccaaggctggagtacagtggcgttatcttggctcaccacaatctctgtctcccagattcaagcgattctcctgcctcagcctcccaagtagctgggattacaggcgttagcc

SEQ ID NO: 17759 - DNA, 106236 bp, Homo sapiens
atgttctgctgaggcaaagaatgagaagtctctcaatggttcctcttgggtctataaagctttagtttgttgttgctgctattctttttgagacagggtctttctctgtcatccaggctggagtgcagtggcgtgatctcagctcactgcaacctgcgccttctgggctcaagcaatcctctcacctcagcctcccaagtagctgtgaccacaggcacatgccaccacacccagctaatttttgtggggttttttttggtagagaaggggtttcatcatgttgcccaggctggtcttgaactcctggactcaagcaatctgcctgcttcagcctctcaaagtgctgggattacaggcatgagctactgcacctggcctaaactttaggtttttaatcatcaattgacaaatcaatggagatagtgcacaattttagctgacaaaacttggggccttcctgtcacaaagactttgaggaggcaaggttcacagcctatagtcccataaatataaataaatgataaactgaaaacaaaactgccattacaaagaaggtggcagatcctatgtgcaggctcatgcattcatgtaataaatgtatatgcaacacccactatatgccaggcatcgtcaagactggtagctctcaaaatgcagtccctggaccaggagcagtagcagcagttagaaacttattagaaatataaactctatttcagtaggcccaccccagatctactgaattagaaactctgaggttggagcccagcaatctgtgttttaacaaatcctccaggtgattccagtgcacactcgagcttgagaaccactggtctcggtactgagtatataacagtgagaagacaaagtcctgctctccttgtggaatttgtattccagtgtatgtggtaggggagacagaacaagtaagtaaatattttatttattttattttattttattttattttattttattttattttattttattttattttatttgagacagagtctcactctatcacccaggctggagtgcagtgacactatctcggctcactgcaacctccacctcccgggttcaagtgattctcctgcctcagcctcctgagtagctggggttacagacgccagccaacatgcctggctaatttttgtaatttttagtagagacggggtttcaccatgttggccaggctagtctcgaactcctaacctcaggtgatccacccgcgtcggcctcccaaagtgctgggattataggcatgagccaccacgcccagcctaagtaaacattttatgaatacaataattttgagaaagtagtaagtagtatgaggaaaaagaaagtgggagatgtaaaaagacagtgataaggggctgatttagaacgggtggtcaggctgcaggtggcctgagctgagacaagaataacaggaaagagccagccaggcaaataacctagaggcagaaaataaatgcataattctgggcagagggaatgggaagtacaaaggccctgagctaggaccaagcctggcccgttatgaggagcaggtgactggagcacggtgagcaatgagtatgttgggggagaacttgcagaggcaggtggtggtagtgagcttggcttttgttcctagtgcaagggaaaggccctggacaggtctgaacaaatacgtacatggtctgatttaccttttagcaggttccttctgaaatgaactgtagagggttagggtagagcagggaggccaattaggaagataccccaatactccaggcaagaaatttggtgcttggatgaactagaccaatgtgcaaacatctattattaagtgaaaaacaaacaattacgcaggacattgtgcacagtaatgtgtgtttttagcatacacatattcagggtacaaagacagttttctttcctgaaaggatccatacattcaaagtgaatagtggttatctttggagaaaagagggttaatgagtgtcgttttatacctcttagtgcagtgttatcatgtgcacagagtgttcgttttaagtaaaggtaaaatttttttttattttttattttttccccagacggagtctcactctgtcacccaggctggagcgcagtggcgcgatctcggctcactgcaagctccgcctcccgggttcgccgggttcaccgggttcacgccattctcctgcctcagcctcccgagtagctgggactacaggcgcccgccaccacgcccggctaattttttgtatttttagtagagacggggtttcaccgtgttagccaggatggtctcgatctcctgacctcttgatccgcccgcctcagcctcccaaagtgctgggattacaggcgtgagccaccgtgcccggccaaggtaaaatattttaaaattaaaaaactaggattgaggggccgggcgcggtggctcacgcctgtaatcccagcactttgggaggccgaggtgggcagatcacgagatcaggagatcgagaccattctggctaacacggtgaaaccctgtctctactgaacaaaatacaaaaaactggccaggcgtggtagcgggcgcctgtagtcccagctactccggaggctgaggcaggagaatggcgtgaactcgggaggcggagcttccatgagccgagatcgcgccactccactccagcctgggcgacagagcgagactcttgtctcagaaaaaaaaaaaaaaaaaaaaactaggatcgaggaaaacacagtagaataggcgacagacaatcaatattagaggagaggaaacccagctctcatgggtaggacccttcccaagcatcctcccctgaagttgctgaagaatcaggctaaccagcggcgggcaagcgcatatgattggatttcagtgggatcagggtgaggcaccttccttcttgagggtcattggactcagcttctgtcctgcagttctggtgatgtttgtggctggctggtctccttgagcaacgaatacaatttcccatgaatgtctgctgcatttcccattgccctckgtcatcgtggcgcttgcttcaccatgagaccaggacacccttcatctaactgcctcattgggcataaacagagggaaatgtgttgctggagggagagagtggcatgcagcatccaatttctcccgtcagctgattaagatttgttgtgcctgaacacggtcaaatgagattagaaagaaaatgcaatgtgtctggtgtgtgtttcacataactgtatcatttgtgtaaacaggatgaatgaaggggaatttttaaggcaaatattgaatgtcattctcaagaatcaaggacaagacaccagggcttatgttctgcctggagagaaaaaaaatgtatatattgggggcattttgaaccctgttgattcaataatgctctgcttctttcatgctggtacagttaaaatgtgatagttatatgtctgattttcagagacactgagcacaaaataagtaaaaccacagaaccaccacattctacctttgttgcccttctaaagctcttaggagaggtgtagagccactttctgtaatagcagctgcctaagtgctctgcattgagtccatctgttaggatgcgaaaggaaaaatctcacctctggcaagagccacaacattttagatgtggatgactccggggcaagcccacgtctctgtggataaacctactagaattttttttggtcctccaaacctgtaattttcttcctttctccagggacccctctgcagtactagcagcctctcctacaaggttttatcagggcagaaatggcttttaaagtggtgtaagagctttggaggaagacatgatttctgttacatgttctgcatacgatctagcatattgtggatgcttaataagcagcttcgacggctattatttccactgactatttccaggcacagagctggagggctattctgagaccagacttttcgactaggtcattgcaaagtcccttcctactctaaataacagtggggctgaaaagcattcacatgatcatgtctccagactgggaaaaatctcaatatatgttatttaaaaggtaaatctagatagtaacagaagttcaaataaatgtagaaattgaaggatattataatgaaattttaaaaaatttccacattggcgggaattatattacagtaaataccttaactgaggattatttcccagtatttggacagtaatattgccaaacacccaatatgcagtagataaattagcatatgtcagtagctagggattatatttgcctaaaagctgtgtgtgtatgtgtgtgtgagtgtgtgtgtttaaacagggtttcacaactggacataatggagaaataaaataaaataatgacttgcatttgcattccctgcgttcaaggtgctcgaacacacttggacacatttgattgtcatgataatcctgtgagtttgcagggaagatatgagtaggaaagtctcattaatttccactaggagggggggaatctggagcccttgggctgaattgcccaacaatggccaaccacacagtgcaggcaggttaacacggggttaacctaaagcagggagacctggttttagtcacaatgaggactttaactaagggtaccacctgagtgagtctctgagtctgcatctctgtccttaggatttttagggtattttctaactttcaagtctatcatttcacgtagttaaaaagggttaacatgcatactacatctagcataatgattctttaatacttggaaaaccattgtccaaaatattttctttaaggattcagaaggccctttggaaacttgcagatactcaggaagattattatgttttaaagcaaattatcagtatcctttgcaggtgtagaagtggtagttcatgagggttccaattaatagggtctcaagaaatcaacattttctgtatattcaagtcccttttgggagctgctgcttatccgtgattggagttctgtgatgattgagcctctagctctttagtacaggacacgagctccttctccaaggctcatcccttcagaaggcacatggatggcttccccacacccccatgctctgtggggagtgtggggaacaaactgcaactccatcctctctacacctaagcaactacccagaggaggtagagactggagagcatatttctagttctgacaggtcgatctgtacctctctacctgaatcatcaggtgagcaggcttgtgtacatacatgggagtgcatgcgtgcacacacacacacacacacactcatgccttctgggctcaaacgcctgcataagcaggagcgactcttcaattattggaaactattaatcatgttttcatttggtttcttcaaagacagctcttgatccatatcctttcagtccaccttattccccaccttctagccaaagagttatttgtccagacagctccctcccttccttaccctgtcctggccagaagtctaaagaggatgtccatggcccattgaagaatttcccacccctgaagttgagctcacctgaggattcacctcatccaacggggacaggcttgaacagtggagagggaggacagagctgccacctctgcagcccctcgccagtcccaacctggatggcttttgcctcgattgacttcgtaaaatgccatttgtagggcttggctctggggatggcacagacagacacacacacgcacacatacacgttgccacacacagacacctacaccccatgcagggatgccagatgacagaacagaaaaggcctccctttcatccagcagccttctgactccagaggagagtctccgagccacgacctgctgtttccctggcaactcaggcctcaaaataaacaggattctgctcagacgggccagaagtccattcggctcacacatttgccccaagacaaaccacgttaaaataacacccagggtagctgctgccaccgtcttctgtctctacctccctcctggctggccaatggctctgtgttcctgggcctgctgctggctgtccagagtaggggttgcttagagctgtgtgcatccctgcgggtggtgtgggagtgggcggttgtctaaaggcaggtcccctctactgataaacaaggaccggagatagacctagaggctgacattcttggctcccccagcctacaccccccccacctcgatttcccacagagccctagggacgggtagccagctctgtggcatggtatctggaggcaggccagcaacctgatgtgcatgccacggcccgtccctctccccactcagagctgcagtagcctggaggttcagagagccgggctactctgagaagaagacaccaagtggattctgcttcccctgggacagcactgagcgagtgtggagagaggtacagccctcggcctacaagctctttaggtaagaatcagggcatctgatctgggaaacagagcaggttatagctgaggttktgtgtgtgtgtgtgtgtgtgtgtgtgtgttttgtgtgtgtgtccaagtgcaaatgtaatgctacttggagaagaaagaaaatgtttcaagcagatagcactggaaccaggactcctgcaagtgaatctcaagaagctcacctttggctgggtttaaaccatggtgcagactgctctgggggaagggcatgctgatgtcacagacatgtaaaaatagtacttctagtttagagactgcaaaaatatgaatgcaccatgccgccacattatctccattcctccagtgcccgcctgacactggccctgaatcagggctggagggggcaggcatttctcatttactaaagtgctggatgcagcccttgaggttcggcagaagcagaaagctgcggtgagtctggctgtggtgagtgtggctagcattatcgtgctgtgtcacactagctctctcttgggaagcctggatattcagctgccttggaaaagctgtccacatggtgggcagcttagattttattaaccttttgatatagaagtcaggctgaagtttaggattatctgggtgtgtcagctcagggttttggtagggtggtattcccatggccccatggtcactcggattacttctttccttcctttctgatcttggaatatcacatcctcgtttcagtacccctccgatgggcactaggaaagaaggagtcagaatggacagagtctctggcacatacactatccacacccacatcacaattacatgccaaaggtatgcaaggctgctgcagaggagcacttcagaaatgcagccctccagatactgagatggaaatttcaggcatttaatcaagtacgcacttttcagagacccaagggaggcccaagggctcactctgcctcagcagaattcaaacactccattattctctagctatgttacatccacccaccaccccaccacccccrcttgcctccctcctttctgcactggtgactggcacttttcctttcattctctacagggatgcgattgtttacgagttagctccccgacccagtgggaggacwygagcatcccggctgagggcgagccaggctgcccctccaccagctctgtgtaacagtgagccagcagcagtggcatcagggctgaaagragtgggcctcgctttgggaagtgatgtctagtgaagggtggccagcagtttactggagctgtttgtcagtgtggatgactgaggattttggtggagactctgattcacagtcrcaaattcccttttcctttgttttctttgtgttggtctttgagggcttccgaggaaagtcccctcttgagatgttgatctgaaggcaagatcaacaatttgctgttggcagagggactcagagagactttcttctgttgcccctgcctttgttagtgtgaataaatgggtttgcaaatgaagtatgtaatccaaagcaaacttagtatgcaaaactttaagagaaaacacaatgagtttcttttaaattctctctcaaatctgctgtttacatatgacttgactagttctgcaaaggatcaaggaagccatatctggttaagtggtttgactttacaggtgagtagcaccagccatgatgataacattcagtggagatggtgggcggacatccatatgccgtatctacattgaagggacatctcatcttgggacagtgcagccactcacttaggtgacatgcattctgtgaactacacataaactattaggatcttgggactgctgttacaggaaagagatccagaccccaagagagggttcttggatctcaagcaagaaagaagtcagggcgagtccgcagtgcaaagcaaaagcactttctttttattaagaaagtaaagtggtgaaagcacagctgctccactgacagagtagggtgttcccaaaagtaagaggaggaacacatccatcctaggtaccatgctcgtatatataggattttaaaaagatcatggggagatgtgctctgctacaagggtttgtgataaaggatwaakkatthmttttcytttycttttttttttttttttttttttgagacagagtttcactcttgttgctcaggctggaatgcaatggcacaatctcggctcactgcaacctccgcctcccgggttcaagcaattctcctgcctcagcctcccaagtagctgggattacaggtgtgcggcaccatgcccggctaattttgtatttttattagagacggggtttctccatgttgctaaggctggtctctaactcccaatgtcaggtgatccaaccggcctcccaaagtgctaggattacaggtgtgagccactgcacctggcctaattttcttaattactatattttgcaagaatccatattatctttaaagcaaaattaggaatgcatttgttctcaaaatatcgggctacctggagactcccaagtctgagtctgtgtagtaaacattatcaatctattcccttaaccataaatatctggagtctaggaatgcctaattttctgggaatgcagcccagcaggtcccagcctcattttcccagccctcactcaagatggagttgctctggttcgaacgcctctgacactgtcagcctgtatgctagctcccaggggttaggtattgtgcagagtggacacacccatttccacctcattaaataagcagtgcatggctaatgcagtatcccttgatttaggttgctggaaaaataatctgaagttgtttgtgccacaggcataccatgctttaggtaaatctaacatctatacatgtgggtgagagtactttttctgaagaaagggttcactaatcaacaaatgttcaagtaccagcaaggcgtccccatcttgagatatgactggatccagcccaaacaaccacagagaaggaaggggactgattgggtgggcaggtaacagagaatgggcctgggctagcgtgtccaactcagcggaaagataagcaaaggagtccaaggtacaggaacaagaacaagcatctgggccagtggcctacagggagagaaaaggggagggaaggaatagcaattattttgattattaaatacaccatggtttaaacccagccagaagtgagcttcttgagttcacttgcaagaatcctggtgccaatgctaactgcttaaaacatttctctgtctttaactttttcgttgttttcccctttcctttttaataattaaattatactacttacgagagggagcayaacacattagctaagtacatagattctgtagctgggctgcctgggatccaaattctgccacttattagtcctgtgactttggcccttggtttcctcatctgtaaagtgggggtaataaagtaccagccttgttatggaaggaatcaaatgagtaatgcccttatcagcacagggtctagctcatagtgagtaccatgtatttgctattattattattattattcaaaggtgaattctaaaaaggctgctttggccaggtgcgatggctcatgcctgtaatcccagcactttgggaggccaaggcgggtggatcacctgaggtcaggagttcaagaccagcctggccaacacggtgaaaccccatgtctactaaaaatacaaaattacctggcataatggcacacaccagtaatcccatctacttgggaggctgaggcaggagaatcacttgaacctgggaggcagagtttgcagcgagccgagatcgcgccattgcgctccagcctgggtgacaaaagtgaaactctgtctcaaaaaaaaaaaaaaaaatagaggagaaaaggctgcttacaaktccatttgttccaaagcccaaagtgacactctataagtgacccctggtgccactgctagggtagcttggagacacatttgctttggcatggagctttgttcacatgtacgcgcactcagacatggaacagcttttggaccggtccccaacatttattgagcccttgctgtgcccaagcactgtgcttggctgtaagtgtatcacctcactcaatactcatgacaacgctgcatataatagtaggggctgttatagatgcaggaattgaggcttgttgggtggggtgtttggctaaggtcacacagccaccaagtggcagagccaagcttcatacctaggctgtccagcgagcctgtgctcctcactgataggctgtatatggtttggggggattatgagaggtgtcctgagaggcacatggagcttggtgataggaattcagcaccagatgatattggaagaccctagaaagtaggccaggatttggaaattctgctaagagatggcaggaccttagcttgggccataggtagaatctcaaccttgaggacccatagcctctgggattgggtctttggggcaagacatgaacacaggcactggggaacagtggggctaaggtttttctgaccaggtagtggacggtgcccaagaacaaaataaacagagtgctaacaacagagccccaagcacagcaagcgtgctgggccagggggccttacaatcctcaagcctaaggccagaggtcatgttgagctaaatttgaagtcaagattgggtaagtatctgagcacagtacaatttacaataatgaaaacaatttgatttgccaatgcaatccctctaaatattatatttaaaatgtgacttacagagatttgttttataccaaattgctcaagaccgtctcctgaccttgtccaaggaatgttggtgatgagaacaggtgtgaggggcgtgcctaccttgcaccagggctgtgtcaacatggggtattactcatggacatgactcatctctgctcctccaggaactgtggctttgtccaggggttttcaaattttaatgtgcataagaatcacaggggaacttgtttaaaaatcaggttcctggttgctccccacaattttgattyggtggcttcataagggacccaggattctgcattttctgggtggggcctaggtaattctgttgcctttggtccacagagcacaattaaagaagatcaggtctggctgttgctcggcttcctttctcgttgtgactatgagagggaacacagagttgtgtggactcagtcatggcaattaccctcttctttgtcatcacttcttcctgaaatacctggtgagaccacccctattatgataacaataacagcacatttggtacatattgagttattatgtgctgggtacactgtgaagccctatgcttgggctagtctctcatttaatcttcacaacaatcccataagtgaggtattactattttacccacattttatgagcaagggaaaaacctcactggtagtaagtgactgagtggggatttgaactcagaactagcagcttaccagagcctagatgtgtaactaactgctaggccattcaatgagagtagttttagctcctgtcagtaccacgctcctttctcattcttcagtggggtgtctttctccagttgccattcctgtcatgcccatcccattcccagactcctgtgtcctttcttcagaagacgtgtctggtgtttccttatttttatttcattcaatgagtcgaagacagttgtggcaatggacatgtggtggtaggtgttagggttgagttgtgtccacccccaaattcataagatgaaattcaccccctatcccctattgcccgagaatgcaaccttattttggagatagggtctttacagagataatcaagttacaatgaaatcattagggtgggtcctactccactataactggtgtcatgcatagagagaagacaaagtgagtggacataggaagaagatggccatctactagccaaggagagaggcttggaacaagtccttctttcatagcctcagaaggaaccaaccctgctgacaccttgatcttggacttccagccttcaacactgtaagagaataagtttcttgtttctgttgtttcagccacccagcctatggtgcttgttatggcaaccataacagactaaccccgtagaaagccagattcctaggttcccccgctaggccatggctctggggtgatctggttgaaggcctacacatgctgcaaaggtttggcaaattgggagcaacaagtaggcccaaggcccaagagggaagaaggaatgaacagaaagagtgaagagggaggaaggaagcaaatgtaaataagagaagggaggctggaggaaaagaggaaagggagaggggattgggatgggcctactgagggccatgtcaggttcattcagctcagcatggatgcctcctgtgtgccagagggcatgtgagacactgggctacagcagtgcctgaggacaagagcccccaccttcatgaaagttagaggctagatgggggtatagacatcaatcaagcagcaattctaccgagtggtcctgaaaaaccacatggcaggggaacttgaccccaacagggggtcctggaaagcttccatgaggaggtgaggcttgggttgaggtctgacggatcrgcagatttcaactggtgagggcagaatatttcaggtggcagggagaggagcatgcacaaaggttgcctggtgtgaggaagcctggcatcaccaaggagcgggaggaaggccagtgtggctgagtgcagggatgaaggggagagccagaacccaagaagcaggcggggtcagactgtgcggccatactgaggatttagttccttaagctgtgagccctagaaagccaggggagaaagtgatcctatgtagggcagtctctcatttcaacgaagggaacgatgggctagaagggcagatggcaagttttagcagtgggtcagccctggagagagacgtcaggctttctgagctcacacacccaaggttgggtgcctggccattagggagtgaagttccaggccactcctcaaagtgttttagccatagtccttcctcaacagagtatgctctaggaatttgcaatggctccactgggaagggtctgaatagggactctcctgtcagtacagctaattagtaagctaggcagccgggccaggctcagactgcagtggactaggcagccccttctttggcatcatttgaaggacacagaaaggtcttataaatctagcctctcttttgcctgcctgtactttgcctgaagttgcaggagcaggcgtgcattcagaaggtgatttattcatcagggactgtggcgaatggcagagattagtccaggcagagcccatgagagcactgggggagagaatgggtggagacaagcctggaaaggggcagagggcgctgaaaggaggagtgcagagtacccgaagcccaatttgcctttttcatgatgtcaccaagaagcagcaaggtgggtgctgcgggtgagggagagtcccaggttggtgtttgcagccttgcaggtgcctgaatgactccattccgaggcaaacacatccatcactggggagcttctcagctgttgttggcatgatccgtatgtaaaaagtctgcatataaaaccgaatgccatgcctttaccacataccccgtctgccacaaaaataattcccttctcttcagtttgagcagagggactggatttggcttagcaatgatgagttcctgaagcatactgtaagggagagtggtgattttcaggaaggtgagaaagtagacaggaggcctcttggggggtaagatccatctgactcttacccatccgacatcacaccaacccatccagccctggcctcctgtctgctcctctgctgttctaggccctttcctgactctcagactttgcaactgctgtttcatctgcctgggatgctttccccccagttcttcaggtagcaggcctctttccatccttcaggccctgcctctcttgtcagttcctccaaaagttttccctgtttctcccctctgacttatttttccttcatgccgcttacctcaattcgtaattttcttgtcaatttttaaaaaaactttctattacccattctctcccttagaatgtaagccttatgaaggcaggaataagaccttgtctgttttgctccctgctatatccccagtgaataggacagagccgtgccacagggtaggtgctcaaatatcagtctaatgaatgactgagtgaatcactaaatgttgggagtgttaaagccaagactcaggacagcaatgggaccttctaccctctgttgtcccttatagctctggaaaggggcctggaaagtaaagctgagacttttgcatcaagagcctctcaccctaactcaggtgggctggcctcttgcagttcccaggaccctatgctatgtgtcagctgctctggcttagtcggcttagtgtcatctctgcagagaactcacttcggaagcctggaaaaatccaccctagtggtattattcatgcttagagatgaataacttcttttggctgatgggcatcaaagacaaacaagtgatgtcaggcacccagaagggagacatggatccagcatgttccagcccttgcacccatggagacagacaatgtagctcatctctgccttccccatcagtctgatgggaatagtggaagcagtttgcattgattaatcaatgtgtgcaaagtgctgaaccaatacctttaaggacataaagagcttctagaaaatgagactcttcttatccttcgtcagaatatctatcagaattaagaaacagcaactaaaggaaagttgagaatgaatgctccagagtcgctccctggagtctacgcagagcaagttcgcagcccagaggagaagagagctgctgcccgggccagtccaggctttttgcagttggctgcattgcctttggtgataaggtggtatttaagttataggagtaaaacattcctccttgagccttgatttgttgttgttgttgttgttgttttgttttttgtttttgttttgaagtaaaaatggggatctttctaaatggcagagatgcagggtgacttcagaatggtttctttcaattgagagttatttccaaggatgaaatcttcactcagttggccacacaaagctcactgccattctcccaggctggtcctgggatgtcttagctgaaggcatgtgaagcagagccctaagctccttggaaagctagctcacacagaagaagacaggaatacttctgacagttctgacccatctctcattaacctttccctatttcagagccacagcctgtggcactytggtagggtagcatgttggtcaaagcatgaaccctggaatgggactgtctgggtgtgaattctggatctgacgttcaatagctgcgtgaccctggtcaagttacacaacctctttgattccataaaatagagataatagcagcggttctgtcctagggttgttgacaggaagatgtgagttaatatatctaaagtctatastacatgccagcactgcatcagtgtaacttgttcctatytcataggattggtgtaagaatgtagggagagaatccacgtagagtgcctaaaatgttttagcacgcaatgcacagcacctagtatttgctcaataagatatgaatgattgttgcggctggcaaattttytggcaaaggttttttggaagtcttcatgagaatgtacttgaattcaaaaaatggtactaggacatgcaggtcacctgtttccctgctgttcctttgtcggccttttttcttccaggggaagattattatcctgtgccttttaagcacttgaaatcctcatgtcaggagcctagaactagccgagaaagaaatagcctccttaaagaggttacgcccagggcagacacaggctacttgttccgaagttttaagctgtagatgttcccaaaaaatgattaaagaagagttgacttcaatagatccctttcgctcaatgcacaaaaaggctttggggttcccaaccagccagggggtgttcagttcctcaatatatgtacgttttgaaaattctgctcaatgtcccctggcactgagctttgagttcaaatcatttggacagtgactgcagagataaaaggacaggctattataggtggtaaattgcacagccattttgcattttggctgcccgatgctccaccctcccttgttgggtgaccttgggtggggaacaggtcctgtttacattttagttgccttatctgtaagagctcctgtctcagcggacggacggtggtggaggttaaattcaaggtggcatgtaaagctctcagcatagctgtctctcttgattcttgctaattctcttccccttcttttgtggtcctcctgactgcctcatagctgtggatatggaaaaacccagtggtgatcaatgttttcgaggtctgagaatattcccttgcaccaggtgaccatgagcacatcacttggcttccgcaccagcacagagagatggattctgggaaggggtccaggtcgcagtctggaggaggggatgctggcagcccccacactcccctcagcccatcctttcaccaagggaggccagaatatggattttcacttgctgctcccctgggtcgttaggcctctcattaaggcctgaagattttctcctgtacagaaggtggacctcttcctgtcccactatgaccctccctaaggcttccccacctcccactgaggtctgagggtttaatacacagctggttcagggtggatccagatgcatgcggcrcaggggggagcgtttccaaggcgatggccgggttgtttctaacgacccattgacctgaccctccccacctcacgccgcccctgaaccaagccaagcctttggagggcggcttcaccttgggatccctggctgcagccctactgtggtgggaggttcggctcccacgctggatgggccctaggggaggtcagagggagggtgagccaaggaaggccttatggcttctcgttccctccaggcctctccctcttattctgacccgtggcaggcagaggaggggtgtggagtcccttgttctaagaattayaaagaatatctctttagaaacctctaaccacgtcttgctctaggatggaagcatatcctgaattggccactttaaagtcttttcatacactgcagatccagagagaggcttctggtgactaatygggagtcgtgcattggtcagactattgcagccccaaagtcagtgtttttccggagccaagatcccattgcttcctggccggtcccacatcctgctggacctgcgttggctggctcatgtttctcattatctctcccccagcctctttaaaggcttctcactcyacccaagggttttatttttaacttgcacagtaacactagggttgagcagggataccacctacattcacaggaaatggggctgccttggaaaggtgtccycctctccagggactttctccctccctgcctcccttcctttcatatttagggagcacctaccccaggtgggccctccccagaggtagaacaacacaagagcagatacgatccatgctcttgagccactgacattctgatggggcagaggagtgggtgacagatagagcataacacacgaaaaagtaggccaacaaagaaataaaccaagtcaacagggattgtgataagatgtcttctccaaagagaacaaacaaggcaccaggacagggaaagctattatacattgggaggggaggggagcctctctgagcaggtgacatagaagtggtggccagtagaacaaggggcaccaggcacacatgaagcagggtgaggactgttcctcagggagggagaacaggtgggagggcctgtggtgggcatgagcttggtgtgtgctaaaatgccacagaggccagggttctggaggaaagtagtcaaaatgaggctggtgaggcatgcaaagacctcatgcagggccctggagccatgcaaaaagtttggggctttgttctgagtgcagtggaaagtcactgggcgtgttggatgtagcaggggtcaggcaatgattgacattttaagaccctcgctgaagattgatattctcctataaagaaggtggacccctgagtggagaactgaccctaatcaccctaagtggggtgaaggaaaggcagggacatgatttagggggctaccgagtcatgtagaaaagagataatggtggctgaggctggagtggagcaggaccacaaaagagtcaggctggttcttccagaaattagcttgataccaaacatcttccttctaaagagctcatagaaccatatcccacaatcatcaggcagaacagaacaccaaggcctgaagtcatagaattgtataagcaatagagtttagatagcctattgcttgtaactggtcatatttattacgtttccaaacacaaggaagatctttgtccaacatctgcctctttgattttctgaatggtgtgtaaatactcctctctctttataccatggtagctatctctgttctttgtatcattggctgagataggagaccaaatggaccaactccactattcctgaggaatttttggatcaactaagaataaaagatgagaaaaggcccaaattctcaactctgatagaatttgccttgactgagtgatgccactcacctgcaaaactcaaaggtgactttagatgcctgaatagcctgaacagttttccgtgctctccaagaaaaacactattgtgttactgctcttcagaagaaaggagatggaaaacaacagtaccacaatgcagagattctgcatcgaataataataacaatagctattatctgttgtttgcttcaaggcactttacttacattaactcacttaatcactgatgaggtaagtccccctcttaatccttttcactgatgatggaactgaagcttagagagaagtgatgtgaagtctcacggtaggagcagagggtcaggtccggaagctggtcaaactcctaactataaaccagggcttgactatctgccttggttgctagttaatttaaaaactgcatagaaggcagggggcggtggctcacatctgtaatcccagcacattgggaggccgaggcaggaagaccacctgagatcaggagttcgagacragcctggccaacagggtgaaaccccatctctactaaaaatacaaaaattagccaggcatggtggtgcgtgcctgtaatcccagctacttgggaggttgaggcaggagaatggcttgaaccygggaagcggaagttgcagtgagccgagatcacrccattgcattccagcctgggcgacagagtgagacttggtttcaaaaaaaaaaaaaaaaaaaaaactgtacagaaaaagacctgaaggagagcatccaaaacgttagcagagcagggatgtgagtaatttgctgtgtatttcatgtagttttttttattgttttgaatatacagtgcctggtacttggtggagtggatgctcaacatctatttgtttaattaaattgttcagttaatgagtatatgttactctaacattatttttgaatagctaaagtaatagatctcattataggaaatagaaaatttcaggaattttaagattaaaatttattcatcatccagtggtaatcactgttaaaatattggtaacattgatttatgccttttcagttttttcctgtttatgtctgtgtctgtctctttatctacctatctatttatgcacatatatgtgtgtgcatagcaaaaaaggtatcatactgcatagtcttttaacttgtatgtaatggaatgatgacattactcacctctcaagtatgttttttgtgcaattccaccacaatggggttaggttaggaaaaacctcagttgtggctgaaatgtgggccctgaagttagacaactgggtttaaattccattcctaccccttaccagctgtgtgaccacagacaaggtcatttttctgagcctcagtttccccaggtataaatggcacatacctcagaggatgtaatcaggtaaaacaggtaaaggtctcccgagcactctgcctggaatgaaacaaatgtgcagaacgtgttcattgctatcgttatgaagctagaagaagcgtttcttcacaagtccagtggtttcgaaaactccctcccatcctactctgcaggatccaagaaaaatgaatttagaaatcactcaaaataccctctgaccatatttccctttcccctaattttttgaaggaggggagtgttaaagtcttaagtgttaaagacaattagctctttttctcttccttacgaagaaccaggtttattggattagaaaacatttgaataattctgttgctcacagctgcaagaggaatgtagccttcctttctatgtagcagctgtgttttacgattgtctgtcttaaagcaaaaacaaagcaggcaaaagaaaaagaaataaagcaggactgtttagatcaatcctaagttgctctcagttttatataacaatacagaagacgtcttacccctaaaacacagaccaaagaagaactaacctgattcatatactggacatcatttgttaacacagacactccactgacacatacatagaaggttctcctgaaccatgttgaatatatttcttgaatatatgttttccttacaaacagcaagctattgaggaataaaacagtatgttcatgtaatctaaatactgtcagagcctgttcaaagggtcaaaagaagatgatagatggttaaatgaacagctgctttttgagtttgtgttgcatgttgagaaactttttcctcttaattcatagctcaggaaatgtgtttatgatcctggtggaattgtgtagagatttccctaaaccactgtcataggcagcacatgtgataaagcgcttctgamggctgggccaagtttttccatttttgtctaactatgggaaatactcagaaacatcttagtgtatgtgcaatagtgtgctctcaaaaccgaaatggccctagagatcacagataacacatgtgattgtaaggcaacccaacatcgggccgagacattaattgcagggcaaaacccctgaagtccaaataactgtgaggcacatcgtaatttccaaataaatgattggaagtggtagcatctactgctgtcaggtttttgtggggtttttttcctaatttcttcatatgctttgctggcgttggttgagtgccttctgcatgtaagaatctataccatgggagattcaaagataaaacatgttctctgctctcatgctgtcatgtgtgagtggatgggggccaacaactcaattgtagaaagaatgaagtaatgactaggcaaagcaccacaccgtgggtccttgaaggaaggaccctactgactggagagaccaaggaaggctttgcagtggaggtagcatttgacataggccttgaaggatgaggagagttttaattagcagaacattgagcaaaatggccttcctagctgagggaacagcaagaaccaacataggaaggcatggaagttcttggtgtgcaacaggggagagggagcagctcagattgctgggatgtggaaggacgtagtggaaggtgaggcttttcacaccagatttgaggtcacttggccaarractttggccttcctagctgggaagtaggaaacaagggaaggtttctgagccaatggttggcacatgcagatctttcttgagaagcatgacctcagtgccagtgtgcagaagtgacgggaacagcaaagctgtggggcaggagatcaatcccgaggctccggcacccactttccactctggttaacctctttgtagcttcgggcagtgcagaccagctgacttctcccttgaaggctgtgatcctgtacttcttggctctcctcctgactgtgcctcttctccccaggatcctggggttgctcctctgtggtaaccggctgcactggggatctcagagtgtggagtgacccccagggtggctgccgctgtctgcttcgctcttcaggctccaggctgttcttccttgcagatctcatctttcccctctgctctgcttctcctgtgcctgcctcatattctgggttctctccagagctcgcgtccactgcctgccagtcagcagatggatgactctgttcacctcagccgcgacacgccccacagcgagtgcagcagtcgtcctgccagatgggctgctcctggctgcgtccattctctcagtaaatagcctctccattcatccttccggtccctctatgcccgagtcacctctgattactcctttgcagaatcctcttcattcttctcctggagtgtctttggagccatctctcccttccactctcatggctcaagtttaggatcttttgtctatttcaattcaacagccatttattgagccccaggggctgtgctggggacataatcgtgagaaggaagctcatgcttctgtcctcgactggcttgtagtctagtcaagaagrcttgagggctgatgagcttttcagagatggaaatagaggatactgtgccccrtggcctctgctctgcccagccccctaccagtaaccaacaattttccagaagaatttccaaattcccttctccaaagtctccactggctccactttcatttgcttgcagaaaaaagtctaaatgctttggaacrgcatcattcaaggtcctctatgatctgactccaagctagcttgcactaaccctgtgtgtccctgaaaaccccccgctcagcggcatcagccatgcatgctgggcgaagatgccctctacttgcccacccctgggcctctgttcaagtgattcctttattccatgcccacatatgtaaaacctgtttgtccttcctgctgagatgccacatcttccagaaagtcctcctgaccccttcctcttcagccctccatccatccccccagcccttggcacaaccttcacagcacttatcatagcttgtcatggtatttatgacttagcttctcaccttctttcaaggacaggaagcttatctcattcatcctgaataatcacaacaaaaataatagctaaaattatgagatgytagaatgcatattttatttatatgaggcaatgtgctargtgcttcccttgcactatcttgttgcaaccttttgacaaacacgtgaggtaggtatatcactggcctccttttataaaggaagctcagagagatgaattgactttctggacttaagttcaggaagcttcacttcaaaacccatgcccttgaccatgacttcacctttattacctaactgtgtctgggtgagttccttgtatataagtccttactggggccggggcagggaggggtgtcaagaggatgggacagtgaagacaagagcagcctccccaaggtcatgtgacaagtcacggtcacataaacatcacgaatgcgggagctttagcgaccacattttctcctacaccttttacctrggaaatggaagtcacagttttcaaagggaaactaaacgtttttgactgtgcaaaggattagatgacagtatgttgaaygcaaattgattgagtctgatttaatttggatggtgatgtgccaagtcacacagccctgttggaccaggtgcctgaagcaaagaactttccttgcacccagctaccatggcctctgcctgagcctgggaggagacatttaacaagggaaattccttctccctccctcactggactgaacctgtcccttttcttaaagaaagggagtggcgtggagcccaggccctcccccaggggcctgcctgctcagctccagacaggtctgcctttgtgagcaggggtgggctggcgggcaggaaggctcttggactgcaagaccgctgtggcatcccaagtcagtgggagcgaggccagaggggacagtcaggatgggaaggttgagaaagggaagacagtcaccgtcaggctagccagggcgcttcctccattcctttccagggcatgaacaagacagcatgtggatgaggctggaagtagccccagggagcctggaggaacagagtccagagttcggaattttcagagcccgccgaggccttcagcatatttagcatgggacatttggtagtgggaggacagccgctcctgtcatcttccctttctctctccccatcagcctgcgagggactaaaagccggcgatytttccttgctgtatttctttctttttttttttttttttttgagacggagtctcgctctgtcccccaggctggagtgcagtggcccgatctcagctcactgcaagctccgcctcccaggttcacacctttctcctgcctcagcctcccaagtagctgggactacaggcgcccgccaccgcgcccagctaattttttgtatttttagtagagacggggtttcaccgagttagccaggatggtctcgatctcctgacctcatgacccgcccacctcggcctcccaaagtgctgggattacaggcgtgagccaccgcgcccggcctgtttctttctcttttttcttgagaccgagtctcgctctgttgcccaggctggagtacagtggcatgatctcagctcactgcaacctctgtctcccaggttcaagcaattctcctgcctcagccttccgagtagctgggactaaaggctcccgtcaccaccgttgcccagctaatttttgtatttttagtagagacggggttttaccatattggccaggctgatctcgaactcctgaacttgtgatgcgcctgccttggcctcccaaagtgctgggattacaggtgtgagccactgtgcccggcttcttttctgtttttctttctttcttttttttttctgtctctttctttcttcatttttgtttttgtttttgtttttgttttttgagacaaggcctcactgcagtggcactatcacagctcactgcagcctcaaacttctgggctcaagagatcttcccacctcagcctcctgagtagctgagactataagcactcaccaacacacctgcctaattaaaaaaaaaatgtagagataaagtgttgccgtgttgcccaggctgctctcaaaatcctggctttcagtgatcctcctgccttggcctcccaaagtactgggattgtaggcgtgaactggtataccaggcctcttgctccatttctttacttggcttgagtttggcttctcttgttataatgtagacatctttatatgccactttgtcctccatatcctggctgaaatgctacggttttttttgtggggaacatgtcagaggatacacagactggtgaatggacagactgatgaataagtaaatgttgggattcttgtctaacacactgtgctttctagactctgactcaacgacaccacactgctgctggatttcatgaaatcttacaccccatcctatccagtacattgtatcatgtctttaagaaatttaaaggagcagaaacaagttttgagaagctaggattgtgtgtgtgtgtgtgtgtgtgtgtgtgtgtgtgtgtgtgtatgacatgctccttagaccattagagtcatcctgttgtgttatgaaaccagtgaaaagtcctatttcgcagggcccatgatgctgatacagattcaaccccaatataacaagaccttaaggttgagcactggttaagtttcattcaagtctgagactttcagcagttgccatactagagtagcttgtgttatgatgcaattccactggcagtcaaagtggcaggcaaaagtctgggttttcctgaccctgggtggtggagcaggccagttatcaaaggcaggctgtaggagcagggggtctcaccttgaaaaaagaagggtttgccagagagccaacctagggggaagtcattagctccatcttgagtgctcatgagatgatgagaaagactggggatcgagaaaagaacaggcaacgcttgactacctgtgggcctctccagcctccccaaaggaaaagcttattggttgtgcttgaagaggagagctacgtacctgtgatcctcttaggatcactgtagaaccttcagtgggaaggaccatgggtttctgaagatatggggaggctctaagtgtgtgagctattaacgttaaaagcatgaagctttattggtagacaggactcaatgggtagagatgagaggctttgaggagaacatattgaggtcactgagtgttgagggaattccgggaggacagaggcagctagctggatgcagtgagccagggtgggagaggagacaggaagatgaagagacagagaagccttgttggggggaggtcctgggtcattcattgcttgagaaaatcccagccagaacctgtggcgaccttttccaaggaggagtgagccagtactttttccaaggtaaacagctctaaagtaatgtttccagaaggggccaaagtcctgaggaggggagtgggacagggggagatggaaagccccacccagaacggaggatggaagggcaagggggtggacgaggggcaggggtgaggggtgtgaggtgagatagagcacttgtgttgtcttgaggttcccaaggtatctcaggaatatttttctaaagtaaagtttgtgagttttgttttttattttttgagatgaagtcttgctatgttgcccaggctgatctcaaactcctgggctcaagcaatcctccacttcagccttcagagcagctgagattgcagcacaaataacactttttataaaatgtaatactgttacataaggcaatgttactgtttttcaatgttactgyttaataatttgtttttatcatcctcattaacatttatacaatgcagcactgtgttaagcaccttacgtaactttacctcattttatcctcaaaataaccctatgagtttaggtaatactgtaatctccattatagaaaagaggaaactgaggttcagagaggtgacgtcacctcgcccacatcttactgctgttagcagcggagtcaagacttgtcctcagctgggctgactccagagcccaggctcccatccaccaggaaaaagactcaaccagcttagaagaggaaatccctggacatcgacggtgtcatgaatgaaacacaagcagagcaatcacaaaacaccccactgccacttactggatggctacttccatattttatcagatctaagatacagtaaattggaagttagaccgtcacttcatgtaccatgaagaaaaagaatgttgcacggcctgattttagagacgttcaaatactgaaaatatgtgcatctgaggcttgataaaatattacaagcgccataccatgctaggagcgttgcctccacgatctaattcgtcccaaagacagcccttttgtatcaccactacatttgcagagaatacagggcttagagcagtggcgtccgtgcccatagccagtgacacggcgctagggagccgcagagcctagatctgtccttggcaacttcctgggcccaaatccctgccttgcctgacccatcagtgcacgctgcctgggaggtggggggcgcctttgttatttgttccttcaggtgggcagccagcttggcaaacagaaaacacaatggagcayctaactgcaggaaaaaagaacactttgcctccttcctccccctggggctcatctgtgcttgggctcacttggaactgctcactccccctggactttaggggtgctggttgtgaggccaggtgaccccttcagcaggaccctagcagcagctctggccattgatttcctagttcataagcctccatggtataggctctttcttgggcccatctctttcttttcccgagctccacttgtgatttgcgccagatttggaagcatcatccctgacgctgaactttattcttcccacatcttccttgccttctctcatctctccaagtgtcttaactcttcagcctcaccctgcctcttcgaaagccttattcatgtcttaaccacttcctagctctgttcacatcaaatcgytaatggttttctagaattcctgcatgttaagatggaaatctggggcgagagaggtggaacgaagaggttgtctgtgtggaaaaaaaagtcaactggacaagtttccttgctttgatttttgaccccaagacctccctcctccgctgtgggctgtgtacgtataagctggcttctcttggtttctcaactcgggtcatcacggagtatcttcttgccttctgtctcgacctcttggctatctttccaataagtttccatagtgaagaaggcagttgtacttaaattagatcttccccatctctttaaaacacccttgttctctctcctccaagccactgagtcatactttcccatcttctcaaagacttccctgtcactggagatgagggctaggacttggcactttctccttttctgattttacttcctacttcaacaagaaattaatatcacaacttgaaaagccttcctaactggtaaaatcgttctgctggaaaagctcattatcttttttcttttttytttttttctttcctgattaacctgcttctcacctatcctctgtccttcggaatctttttctttgtatggctgtctcaactcagcctaactttctttcaaagccctgctgagaagaactttaaaacattttgtatgccaggcacagttgtgcacgcctgtaatcccagcactttgggagactgaggcaggtggattgtttaagcccaggagttccagaccagcctgggcaacacggcaagaccccatctctacaactacaaaaaaatgtatctgggcctagtggcacgtgcctgtgcttccagctgcttgggaggctgaggtgggagggttgcttgagtgcaggaggtcgaggctataatgagctgagattgtgccactgcactccagcctggtgagggagtgagatgctgtctcaaaaaaaaaattacaattttaatactctaaacctttactggatgttagatttatttattttcagtatttaatcaaagtatgaaaagtgctacctacaggtttcctttgttctaagttcccccagggcaaagagatgtctgtttcattcacgcactccatacacagaggaggctgcagaaaatatgtgctgaatgaatgaatgaatgaccagcagtcatcactgggcttttgtgtccatttacaaagtaagctcatgtaggtatccattcattcaacaaatatttattgagacccgactgtgtgtcaagccttgtgttaagcatggtgggtataatagtgacaacatcaacaaaaatccttcccctcttgaagtttatcttctaatggaaaatgaccattcaaaaatcattgaattggtgtccacctaatattgaactctaataagcatgttggagaaagtctcaaaattacagaaagttgaattcacatttgctccaagagagctaagaaattgggaaaaaagagacactattagtgaacgaggtgagaacatttttaacggcttgagatataattcacaattatacagttcgtccgttcaaagtgtatagttcaatggcttttcgtatattcacagtgtcatgcaactactgccactatctaatctcaggacacatatgaatcagcagtcattccccrcttccccctccctcagccccgggcacaccactaatctacgttctgtctctagatatttgcttattccagacatttcatgtaaatggaatcgtacaatatgtgggtttttttttgtctgtgtgttttttgttttttgttttttttgagacgcagtcttgctctgtcgcccaggctggagtgcagtgtaatctcggctcactgcaacctccaccccctaggttcacgccattctcctgcctcagcctcccaagtagctgagactacaggcaaccgccaccatgccctgctaattttttgtatttttagtagagacggggtttcatcgtgttagccaggatggtctcaatctcctgacctcgtgatctgcccgccttggcctcccaaagtgctgggatagtgagccaccgcgcccggccaatatgtggtcttttgtgactggctttttaaacttaatataatgtgttcaaggttcatccacattgtagcatgtatcagtactgcattcctttttatggttgaatgttttgcatggatatgcwaccttttgcttatccactcatcatttgttgctttccatttttggctttatgagtaactctgctatgaaaattaatgtactcttttttgcatgaatatgttttcatttctcttagttgcatacttaggtgctggattgttgggtcatatggtaacgctatgcttaattacttgagggactgttttccaaagtggctgcaccattttacattcccaccagcagtgtatgagggttccaatttccccatatcctcaccaacacttgttattgggtgcctttttgatgaaagccagcctagtgggtgtgaagtgatattgcgcttttgatttgcatttccctggtggcaaatggggttgagcatcttttcaggtggagatgagaacatctgcatcatgtttgtgaggcagctattgatctggtgtccagcacaatgcctgcatgtcacaggtgctcaataatatttgttgaatgaatgtaagagtggagcaaagaaaagtaccttgaaggacaaggcttctattagctatggcaagcctgcaagaggaatggtgtatgatggataatattttgcagatatgaagcaatgcattttccccctcttaccacatatcctgcctttaaaccatgttccatttggagcctctcttctcagagcctgggccaggagtcctgttgcctggagccagagaaggaaggaggaacacagaataaagaagacagctggctcaaccaccaagatttgtggaaagatttgcaaaatggctttcactccattgtaacatagcaggggctaggcctggcagatagactgtgggatttcttttaccatggtaggggatgcctgtctgtcactgggctatggggtatggggttagaaaagaagatatggagtgtgtgtctttggcattaaaaacttgctgatgagctgaggagaacacggaaggcagggcagccctgcagcatggggaggcctgcagagtttgagaggctgaatgggtgtgatcagaaggcgagtgggtgtgcgttacactccagatttctgctgctcctgcgtgatatagatgctgagacgagagccagaggccattgtggggtgaccctgcagcagagcgggggcagacctcctgggcagggaaggagaaacccacagccaacaagagctggccagccaaggagccgccctgggccctgacccagccaagagagaccagcggccccaacttgagtcatgaaggccaaagggtgggcagccacagggcaggctgaaggctccatgctggagaccctgtgccgggggccaactcttcccttccagtcagaggctgagtggctcccactcctcctaaaaccatgccgcagggagggcggctaaagacagaggagctgaaggacagagctttactaacaggactgtttaattctcaccccggatgagcgtgaagatggttttcagctgccgcacagttgaggcctcgggaagaagcccagagaagagacaaattaagagaaaccacagtcatgttgtgtgagaaaacgtgtgacactgcccatggcctgtttatggaccggtcagctcagcagtgaaatcgcctgacgcagggcctgcaagaccagagatgcagtcccattagtgttgctgtggcagtggccactttcagaggcctgctctggagtcaaagagcttctgatctgagcaagagaatttctccccttcgactagagaaacagaccaaagggcatgttccctgtcatctttggccgtgactctctcagaagcatttggagacatttggatgggccaggctgagaaacatcactcccacaacaatggcacccctcagctgtgttccaggctctgggctaactcttcacatgtgtcactgaatcctcccgccagcaactctctgaaagattttgttattcacattttatagataaagctatgaagcctgagtggtttcctgggatctgctgtcaggcagcatttgaattcagtgatgtaactgcctgtgctgggcacttaaccaccgctgacactgcctttcatcattctgcttcaaagttcccccttaaaactgatgcaagggctgggcgcagtggctcacacctgtaatactttgggaggctgaagtgggtggaatacgaggtcaagagattgagaccatcctggccaacatggtgaaaccctgtctctactaaaaatacaaaaattagctgggtgtggtggtgggtgcctgtaatcccagctactcsggaggctgaggcaggagaatcgcttgaacccgggaggcagaggttgtagtgagctgagatcacgccactgcactccagcctggcgacagagcgagaccctgtctcaaaaaaaaaaaaaaaactgacgcaagatctggtgaagcattttatcaaagaaaaatacaaaaaaaattattatcttttatttgtaaaaaaaaaaatacatgcctgtttcactataacaaggatggcgaccatggaaccaaagtgataaagaacctgaatgagagctcatttcagacattcttcccccaacacacgccaacaccagcaaatgcaaggcttcagcattgttggttatgtaattgttctccaaagacattatacccagctcatctcagagtgcatgcttccgcttgcctatccatccaggttttcttctcacaattactgagcctaccacatgccaggcactggggactcaagtgacctggcagttcctcccctggaagagttcatgatcacggcagaagcatccccagagcaccatgcacacaggtaccaggacggcaactctccgcagcctatactttctcttccttcaaatctcaacttaaatgtcacctcttcaaggagtcttgctagtcggtcttactctatttttctacctcagttccttgataccgaaggaaatatcctccaaaacacaactgacaatttttctttctttgtcctttaactcgtgagtgtgtgcgtgtgtgtgtctgctgcctgtgaagccccactacaatgtggtcccataagggcatgagccacactctcttattcacaaaggtatctccaaggcatgacacatcctgggtgcttagtttgttgattgaatgaaaaaaagttgcaaccagatagtcaagagccttgaatgccatgctaagaagtttggcctttggcctttaggcagtgagaaataacaggaaatgtgatcaggggcaaggcatgaacagatctgtgaatgggaagccaaggatggccatgttgtgaatgaggtaaggggaataagctacagagagaaaaactagaagcaattgccatggataaggcttgagaatttgctggcctgacctgagacactgatggaaggaatatttaagaaatatttaggtagaatcatttggagatgcctgtgggagtgagggaaagggaatatgactagggcatattaagtggcttgggctattttgtaaccactgcactgtcattaattaagcaaaggcaatggaagaaggagaatgcaagacgtccaccgtgggctgttatctgcagaatgtcctggaagatttcttggaggtgatgggagctttgaatgcaaagaccagggtggaggcacagggcaggatttgggagtcctgggtagaatgtgaggcagaccagcactcccagagagcatatatgcatttaagacagaaccacctaggacaggcccctgaggacaccacactccaaaaggtggtgaaaggcagagaagccagggcaagatactaagcaagagaaggagaaagaagacccagacaccagcgttattattgaaaccagaggggcaagaattgtccagagtgggttggaaagttccgctgcccactgggctgagagtccagcagagaatgtggtagagacccagtcttgggcagacactcggccgcagccgcagccagcagccagcagcatggcgagtgtggtggaccaggtctcctgggggttaaagggaacccagatagcaggaatctctgaatcagtaaaagtcaagtcaaaaaagaacaacattcacagctgaccacacggcctcaggccaccgcaatcaggtgtgggaggagaccatggacaagcttttccaaggttgttttggtggaggggtgggctagatggggtactgcagagggctggggatgcctgagaggtgttgggggggtgctgacatccttcagaaagctgggctgtgcagagaagcagagaacggggcgggagcaggtggatgggcaagattctccagggagagagaacttagcaagtttgggggctgaagggaaagattcagtggacagcatccttgccctcttgaaaagttgttgttttttcctttacattagaaaatacctgcagtaggcctgggtgcggtggctcacacctgtaatcccaacactttgggaggctgagacaggtggatcacctgaggtcaggagttcaagaccagcctggccaatatggtgaaaccccatctctactaaaaatacaaaattagctgggcgtggtggcacatgcctataatcccagctactcaggaggctgaggcaggagaatcgcttgaacctgggaggtggaggttgcagtgagccaagatctcgccattgcactccagcctgggcaacaaaagcgaaactctgtcccaaaaaagataaaaataaaaataaaaaaaaatacctgcagtaacaaaataaaatgtgagttcctcctcagccaccccatcccactccccaggggtaatcattttttcagttttctatctatgtgtctacacatagatatatgatttttaaattaagccatgggataattctggatatattgtcctgaggcttccttttccccactcatatgtgtacatgtgtgtctagtgctctttttcttatggctgcctgctatttgcttagacccataacttattttatcactccattctgaagcaacattgtttccaaattttcactattacaaacagcactgcagtgaatttcatgcattgatgtttgggcacttgtgtgagtccttctataggwcaaattcttaatgctggagttgtcagtcacggggtctacacataagtatgctgttttccttgaagggcttcttggattggtctgctcttcccttatggactgggaatgaaaaatgtggggaagaagatagatttccaaggaggcatgtaaatggaaaacaaggctttaaagtatcccaactgaataacagctttttttttaatcaagatattgtgggttactatatttatacatagtaacacttattaacctgataagatggaccaggtagaaataactctcagagaggtaacagtctgctcttctcggtttaaccatccattttctatggctagagtcaatattggaagaagatactggttcctgagggcacatttagatgtgttaaaagagttatgatgtgggaaatttgttcacagatttcagggagatcaaagacttaagtccattagaaattttaaaaacaattatattcctaggacttggtatttaatatgtgaagtcatcagtttaattatattttcagatcattctttggcacagagtgaggaaaaccctccctcactcttgcagagaacgcaaaaacactcaggaaaaacaaagctgaagtgtaaacagtctctttgcaagggtcctctgatctcaccagcgcggccagcacactgagctcggagcgccctcttctggctgcgggctcccctgcaccagcctggctcccgcccacaggataagtcgggttttcagtgtttggaaagctgctctggctctcccgttccaatatcagcacatccttcagcttcttctgctgtggccactgaaaccccaagatgttctttctcaatatttgtgcaatattttcaagttactctgggctctgcctcctctgtaagaaggatttcttgatgactagtttttaaaaacacccttcttagatctgagttaagctattgggattgcagttacgtttgttaactgtcgggaattagtaattttggataagcaagaactagatctagaagccaaaggagaacagcaagcaggtctatgtgtcattacccaatgcctgtgagcaaagtatggctgagattgacgttttctgtccactctggaaagctgtcagaaccttaggtcagcctcatagttcttgtattcatttaacaactatttgctgagtacctatggtgtggtggggagtgtgctgggagcaggtctcaatggtggacgagatgagggaagggccgcttcacttattatgtgtgatacctaggcagtgttaatattgcaaaatgcttggaattttacaagcgtcataaagggttaccgaagcctccatcatgttctttcaaattcccagttaatctatcctgtgctgctattaccacgttgaaccaagttaatcctctcaactcagcaatggctccttcctaacttcttgaaaggcaccattcggtcctccagggaacatgcttgtaatctgttatgataggaaggaggaagcagcataaacgaaaacagtttttccaaagaactgactgttttccttggagctggggtgggccagagctgaggcccggccctgtttggatgtgggagcctgcggttacctggctctatcttcatcaaccctgctgggtgagccacaggcctgcagccctctgctctcccctgcctgctcctcctgcaggtagaagagaagccccttctccctctttctctctctcagtcccgtgtgaatgcctggggcccactcgccaggcaaagggagattggcccctggaaggagccaaccctaaagagggagtgtttccttccaacgaggccacaacattcatggagtcgaagacagcagatggcagccctggtggaagagccaggcaatgtcatccaagacagataaggaaaggacacaaggccaagggctggaaggtatcaaatcgcaacacaatgtccaagattccactagttatttatgccccacttttgctaaaacttcagatgaacctcgaaggggcagacatcctttcttcctcacttatcttggctttataaccacagcttgatatttctttgggaaaagtaagaatctttctactatccaaagttcaatgaactatcgagcagttcattataagtgaacttgccttcttaaagctaacgttctctctaaaatcattgagttccaagaaggtggtacaaaaggattgtattttgtgagcttgctgcatcaaaagtccccaaatttcatgtgccctttcccaaattatgctgttcacttaaatgcattttaactctccagatatttattgagctgagcactgtgttagaaaaagacctggatgctgccctcaggaaattcacagaccaaaagatgagatagatgaataaacagatcatgtcagtccagcatggtaaatgmgatgttagaattacatacaaggtggaacttttcttttttgagacagagtctcgctctgttgccaggctagagtgcagtggcatgatcttggctcactgcaacctctgcctcccaggttcaagcaattatccagcctcagcctcccgagtagccgggactacaggtgcacgccaccacgcccagctaatttttgtatttttagtagagatgaggtttcaccatgttggccaggctggtcttgatcttttgaacttgtgatccacccacctcagcctcccaaagtgctgagattacaggcgtgagccacggcaccaggcccaaggtggaactttcaagcctctgccctcatggtctggagggagagcctgacttaatcagaaaatacamaaataaaagtagaatttaagccccaaccggtgtcgtagaagacaggcaggcagcacaatgagagctgaggggtagaggaggacatccctgaagaagtcacagctgagatctgaaagatgggtcagggttaattcgctgtagggggcagtgaacagtggtccaggcagtgaggagagtgtgtgcaaaggaactgtggcaggaaggcacgtgacgtatcccaggggccaaatcaaggctggtatggcgaatgcacaaagctagaaggggagactgggaggccgggctggagaggtcagcagggctggaccccatgtagcatctggtggaccacagccttcacttctatgtgctcctttcctcttctgcctgaaggaatcagaacagcacctacctcataggaataagtgagtccatttttgtaaggcacttagaggagggtgccgcaactaccggctgccgtgactgttgtaattatccccctcgtcatcctcgccaggttgagctggtggaggaggaccctgctggctcaggtcggatgtgtctttttaacaattcacactcgatatgtgggcacagctccacagaggtctcagaggccacagaaatgagcataaactcctgtaaaggtaaccgctggctttctggagacgctctgcatgaatgactggctgggctgccgaccacagggctcaaaacagccaccaagagtttatccccaaatacccagggaagaaaacgagacagaggaaggaggatggagcctcccaagagaaggctgtctataaatggaaagtgacactgaaagaaaacaaatcttatttgatgtgaacccatttttgactctgtctggaaatccagggcagaaggaagtggaggggacagggagtgagtgagcagatgtgcccagcatgagcctgcccgcccggggcctggcgtggacacacgtgtgcactatgaygaggtgatgaggaagggctgcggccaccgccgaggcacccactcctccagccagacccagacagacgcaagcactactgggctgcttctgtgctgtgatgtgtgccaggctgcacgtgtgggcccagggctgagatggagagtagtggcctggggtgggcacaggcaatgtggggagaagattcaaggggactgcaaagaacaccatggggctcctgggcccttctgtttcctaaagggggtcttcagggtaattagctcacagggtccttgtgaggggccttgaatgggatgacctacacaggaagggcctagtaagtaatgaatcagcgctctcttcagagcagtgcagagcctccatcacccaaggcttctaggtccagttctaaaactcacctgccccatagcactaggtgacttctgaatgtcccagcgcctcttgtgtttcttcatcctcagccattagagaagaactacgaccttacaatttaaatggctctacttcaaaaacgttaacaagaagaagcaccatttggcaacatgtttttactatgtgcaaacactgttaagaaccttcccaggaggttatagcccaaataataagacctggcttcagaatgtctgggttcaaatcccagacccattccttcctggacatgtggccctgagcaattatttaacttctctgggtctgagtctctttgtctggaaaatggaagtgctaataattcctccattgcagcgttcagaaaggactatgtgaggcagtgcagaaagaggcatttaatagagcgcatggtacgaagcacttaataaacgttcatgtttatcgttattacaaattctctcagattaggccacctattacccctgtactacagcccagaaatttgaggctggaaagaggttaagtgtccacatggtggaatattattcagcacaaaaaaaaaaaaaaatgagctaccaagacacaaaaaatatatggaggaattttaaaggcatattactaaatgaaagaagacaatctgaaaagactatgttctgcatgatgtccactataagacattctggaaaaggcaaaactatggaggcagtaaaaatatcagtggttttcaggagttaggagggagggaaggatggattggtagaacatgaaggatttttaagacagtgaaactacactgtaggaaacgataatggtagatatacgtcactatacacttgtcaaaacccatagaaggtataacacaagagtgaaccctaaaataaactatggaccctgggtgataatgatgtgtcacatagcttcattgattgtaacaaatggaccagtgtggttggtggggagtgctgtttaggggtgggactggggaagaggaattytctgtcctttctgctcggttttgctggaacctgaaactactcaaacaataaagactatgaatttcaaataaaaaggtaaaaaggttaagcaacccagctcctaagaggcagagatgagattcaaatctgaactcagagccaggggtcttgcccactttcctaggcaagtcgtggtgggttcaggctcccgtgggtgatgaaggttacccaaaagaaggaggtggagacccagggaggaaagataccaggtgcccctgggttatcactgcacccttctcggtactcaggcaggatccccagccctcgcagccgccttccttcacctctctctgagcaaaagcacgaatagggaggagacattgaagctgcgtttgcaccaccctcccattaacacacttggctctcagtgggtgttgatttgggctgtgtgcacgctaggaatgagtatgagtgttaaactatatatttttacttaaattttaaaatgttcacccttctgacttgctccccaccccaccataggaaatctccatgtccctcctgaatgcatttctggaaccagctgcttaagactgttgctcgtattttcctgtgagaataatagagtaatggggactgcatgtttcggatttctatcaattaatactacagcaatatccagctactttaactactgctatagtttcaaataatgagaccacagtatacatagtgtgtgtgtgtgtgtatatatacacacacacacatataaagtgtatatgcattgattataaaggggtcaaacaataacagtcatgagcatcattctccctgccatcatcatttattggccacttaagaagtttaggttctgggttaagcaggttactgaagccttaaatcatttgatcttcttaaaattcctaggaggtaagtactgtaattactacccttctgccgatgaggaaactgaagctcagagaggctacataacttcccaagggcacacagccactaagtgagtggtgaggccaggttatcagaattcacagacctcgttttaaactaccatgttcaccttgactgtctttctgaaccttttgcaatgttatcttgataaatgtcatggattccctctctcttctttaaaggagaatgagtaacacaaatgtcacgccctagcatggtgcctggcatagaagagcagtcagtcaatgtcatctccatccctccccctgcacrcccttactccactttccccttctccttctcagaggaaacatctgtctatccagtgcctcccaaactggaagatgcctaaaaatcacctggggatgtttattgcaatgtagattcccaggcctgacccatgaagattctgattcactagagctgaggtggggcccaggaatctgcattttaaaaacaaatgtcccatggactacacttgatcttagccaaaaggccaagatgtgatcaaatgtctcatgtaattctgattttgttgttccttgggtcatactttggcaaacaccaatctgtgggtttttaaagaaaattgtttttttcttacttaagagaactgttaaaagtgtatacggtaaaacaaaagtcagaaagtttaaaagagtagacagtaaaaagcatctctccccatggataaagatgatcatggcagcagttttggtaatagtgaaaaattaaaaacaaaatgtccggccgggcgtggtggctcacacctgtaatcccagcactttgggaggctgaggtgggcggatcatgaggtcaggagattgagaccatcctggctaacatggagaaaccccatctctactaaaaatacaaaaaaattagccgggcgtggtggcaggcacctgtagtcccagctactcaggaggctgaggcaggagaatggcgtgaacccgggaggcagagcttgcagtgagcagagatcgcgccactgcactccagcctgggcgacaaagcgagactccgtctcaaaaaaaaaaaacaatgtccacccctagagattatacataaatgcaaggtaggctatttgcaagatgagaatgtacttatagtagtgataataaatataaataatgtatgaaagtgaataatcccagaaataatattgaacaaatgaaggcaaattgcagaaccatccatctggagcaagctgttgatgtgtgtcacacacacacaattcatcagagcagttgcctcaaggaagggggatagaaatgttatgaaaaagggaatcaagagcgatcacaactttctaacattttatttcttttatataaataaagatctgaggtaaattccagaaaacatgaacatttgttaaatcagagtaaagtgcacacaggtgtttcttattttcctttttgtttttcttaaattaaaaataaaagtagtcccttcgcccctggtcgccttgtttcctctctcggccgtcctgctattgttttcctggatctgtctaggtctaggcctgcccatgcattaataagcacatacatctcatccatattcttcatctgattctctccgacctcttccagggcctggtcctatcgattaaattctctccccatcttcaaaccgttcagtccctttccctgcaggcttattctccagtgacaaacattctcaggtctctcatttgagaaaagcttctctccattcctcctcaagacacttgttcttttttttttttttttttttttttggktggkgggggacaaatcactttttttttattattatactttaagttctgggatacatgtacagaacatgcaggtttgttacataggtatacacatgccatggtggtttgctgcacccatcaacctgtcatctacattaggtatttctcctaatgctatccctcccctagccccccaacccccgacaggccccagtgtgtgatgatcccctccctgtgtccatgtgttctcattgttcaactcccacttatgagtgagaacatgcagtgtttggttttctgttcttgtgctagtttgctgagaatgatggtttccagcttcatccatgtccctgcaaaggacatgaactcatccttttttatggctgcatagtattccatggtgtatatgtgccacatttttttttatccagtctatcactggtggatattgggttggttccaagtctttgctattgtgaacagtgctgcaataaacatacgtgtgtgtgaagacacttgttctcttggtgtgaacacagtacaagctgagaatctttgatccaaaaaatcgttaagtccaaaatgctccaaaatccaagttttgttgttgttgttgttgttttgagatagagtctcactctgtcacccagactggaatgcagtggcacgatctaggctcactgcaacctccacctcctgggttcaagtgattctcctgcttcagcctcgcaagtagctgggattacaggygcgcaccaccacgcccagctaatcttttgtacttttagtatagatggagtttcaccatgttggccaggctagtctcgaactcctgacctcaagtgatctgcccacctcagtctcccaaagtgctgggattacaggcttgatcccacccaccgtgcccaacccaaaatccaaaatttttaagcactgacatgatgccacatgtggaatattctacacctgacctcatgtgacaggtcaaagtcaaaatgcagtcaaaactttgtttcatgcataaaattattataagtattgtataaaactaccttcagactaggtatataaagtgtatatgaaacataaatgaatttagtatttagatttgggtcccatctaaacagrtaggagtggagtggtctaccatcttaggcccattggtgaggccctttaaattagactgacaaaagacaaattaagaggagaactacaagtttatgaacatgtgcattgtgtgtgcacatgggagcacgcagtactgactacctcaacgcggtggtgagaacttgggtttatatagcagctyaacagaagggcgaaagatttttagagaagtgacaagacaaaggaaaaggacttcaagtttctagagcagcaaattttgaaagtaaacatatgggagaaatgaacagagaggagggctagttggtaaggtttgttccagtggttaacttcagtctttcctggtggtgagggggcaacttcacaaatttatgctctgcttttaagcaaatgagaaatggcagagagccttatctgcttcttctcaattgtcttcaactaaaaataatcgatatgccaaattggcttatttggaggttgcatactctgccacccttcccctccctctcttcaccacttttctttctgtgggtgcgtgtacattatactggggccctggaaactggtattgggtgctgaaaactggtgttgagccctgatcgttttatgaccttatgcccaatctgtccatgaggcttccttcaactccgattgatttatcctaatacattttgcttcacagtgggccaggtcccagattctgaagtggggaagaaacgatgacagggtcagacatcaggtggtgaggtcttagcacacaggttcacagacacatagaaaaggagagaaaaggccgggcgcagtggctcacacctgtaatcctagcactttgggaggccaaggcaggtagatcacgaggtcaggagttcaagaccagccaggccaagatggtgaaacctcgtctctactaaaaactataaaaaattagccggggccaggcgcagtggctcacgcctgtaatcccagcactttgggaggccaaggcgggcagagcatgaggtcaggcgtttgagactagcctgaccaacatggcgaaaccccgcctctactaaaaacacaaaaagtagccgggcgtggtggcacaggcctgtaatcccagctactcgggaggctgaggcaggaaaattgcttgaacctaggaggtggaatttgcagtgagccgagattgcgcgccactgcactccagtctgggggacagagcaagtctcctctcaaaaaaaaattagctgggcacggtggcaggcacctgtaatcccagctacttcggaggctgaggcagcagaggttgcagtgagctgaaattgcaccactgcactccagcctgggtgacagagtgaaactctgtctccaaaaaaaaaaaaaaaaaaaaaaaaaggccaggtgcggtggctcacgcctgtaatcccagcactttgggaggccgaggcaggcggatcacgaggtcaggagatcgagaccatcctggctaacacactgaaaccccatctctactacaaatacaaaaaaattagccgggtgtggtggcaggcgcctgtagtcccagctacttgggaagctgaggcaggagaatgacttgaacgcgggaggcagagcttgcaatgagccaagatcgcaccactgcgcttcagcctaggcgacaaagcaagactccgtctaaaacaaacaaacaaaaaaaacaaaaaaacaaagtaagggagagaaagacaagatagaaatgagcagtgactgtggagggaggttgggctgtggcctgagctcaggagaatatcagaggtaaaggatgacttctggaggaagtaagggtgtggaagctgagtgagattaacacagaaataaaacagaaaggatggaggagtaatggaggccgttggaggaaggtggtaaaagaacaactctgtcaatgacagcagctgtcaccctactgaatgttgattacatgccaggcattgtgataaggatttgtagggatagtctttcttacttatcccaatgcctctgtagtaggtactattattttactcattttacagatgaggaacttgaggatcagagaggttagagggcttgcttggagtcacagagctagtaactagaagagctgggattggaacccaggtcagttggaygccaaagcccaggttctcatccactccttctaccaccttccaatattgactcaggggcatttcttcccaccacgcctgctgtaggctgaggaatgcgatgtctcccagcaccccaaagagtgaggtgccgtgtgatgagctaactcggaggtgtagctcaaaagccctgctatgactgagccgtctgccagggctgtgagtgctcagagtggagacgttctcatccgccatcagggaatactcactccattgtgctggccccacctaaatgtttttttattgcctgcccttcaccatgagtaatgccactttccattttaagctgggagcttcaggagatgactgcattacaagccagggttttaaagctaagagctgcctgggggattactcacccatttcaagacgctgcccacaatgcaccctcccactcaggatgctgctggaagatcttcttccttgccaaagcctaaaagaaatctgatttcccctggaatccgactaggagtggtgccagaatatcagaaagctggcgagttaactggttctccaagtggagctaccgtgcttgtttctggtcctctcatgtgtgctaaggttttgttgcttgttcattcatttggcatttgctgagggtctactatgtgccatgcactctgcccatgatggagagactatcacaagctaaacagctttagtccttgtcctcagggagctaacagtctgggggtgtggggataaacagacaattatagtaaaatatcatracagaatatgctaaatcatatgacatgcatgctcagggagttttggaaaccaacagccagaggatttatactaaggtaggtatgaaggatgaggaggagctggcttggtttcttaattgtaagcaaccaaaattgactctagaaggagagttcagagaacctggggttgctcccagagtcactgggaaggtgtggtggccccaaatcacactgcaggaatggtccagccagaccaagatgtacgtgtgtatgtgtgtggtggggaatgagggggcgggtgtaactttcaaatacatggggtggggattcagatgccgggccgtcaaaaatgatgacaaatttccagaacagcaggtagaattagggaaggtgtggaggagaaggctgtctcaaaatgacctaagatattctgagtcagagaaaacaaaaggaacagcttaaagagagcaccaactcagtgaggcaaccaggcagtggggccggctggccagactcttgggggattccttagtgagtgagttcactgctcaaagaagggctttgccacttctgcagggaagccagccacgggccagcaggtaagcatgttttaaggctttccttttttgttttagggctcctggggacattctggaaggccacagttctcactacaagccttgagattacagagcctagctaagtcgggaaaatgttctctgcatgagaattggaaaagatgtttgggggaagccaataggataatgataatagccaacttttattgcttgcgctaacatgagcttacatgcattatttcatttcatactcataataaacctatcagtttagatgaacagactgaggcacaaggattttaaatgacttggctaagatcccatggttagcaaattgtggagctggtatgcaaatgtagatctgttttactataactaagagtctgttgacagaaaacatgaaaaagtgagggccagatgaagaagaatgttctgtgcataataagcgatcggaaggaagcctgattccttagcggtcacctctctcatgggtacaattttgaaacttaaggtcagctgttggtccctactgagaaattttcaaatagaatccaaaatggaaaagccctattttcctagagggagacttgagtgaggaactttagccagtaactcagggtattgcctcctaggttgcagcaagaggtatatatagcattttaaaattgattttgtcagaataataatttctctgattatacaaataatacatgctccttgtagaaaattaggaaaaaatagaaaaacataaagaagaaaacaaaaatcatctttactgttagcacccaggaatggcttttgtcatattttggggtatgtgtgtgtgtgtgtgtgtgtaatttgtagtctctttttctgatgcatatatggtgatactgtcttttaaattacagttctttatatcttcgataattgttatgaccttgatttagccctttcctcaagggagaattatatcacaacattcaattttgcaaatctgttgataggcagtacaagctggtttcttcaaatgaggaggcagaagccatggagcctcctggggtgcgttggatatagtgtatgtgaaagtgcctagttctttaagaaaaacttggtttttccttatttgttaatatttctagctggtaagcattgcctaaacaaatgtttagcataatgactaacctaatcaggcaaccatatatttattaggagagatttattccatactctaggctatgcatggcattcattgatgttgtgtacacaaaaaaaacagaagagcagtttctaggactcagctccaagtggagtctgtcctgatcccacctccccttcactggtctacaggatcccaggtcttcccatctcccagccaaacatatttcaaaaagccacagtccaacacacacagctctttggctctctcaggcaggtgtgcagcaaggccttcacagacctcagtgagcgtctcctctgggagcccacgtggctcaagccagcacaaagccagatctatttggtggctgctgttgttcactcttggcataccgtatgccacccattcttgtcctttacccagatcatcaagacaaagccctaccagttcagaagccctgtgtgttccctcttcatatcttgatatctgctttgtgttgggagtcagtggccagtcaagtgcttgcatgatgcaggtgggtttgctgatgcaaacaaagttgctggcatgtgagttttctgaccctgaaaaggccccacagaactatcccctcaggccttgatcaggacattacccccaggccaaggggacaaggaaaatgaacttgagtgtacttcataagtgacagccaagagggaaccaaagctcctagttcttctcttcccttcctgtctccatgtaaccttttcttcctgggccattcctggtcctggaggtaaggtcactgctgacagcacccatctggtgaccsaggaagccaagggtcagctggcttctctgacagtggtggatgccctattgtgctcctcctagaagagggttctcttaactcttgcttttctgctttgttttcccatgcttcatttgattttctttttacttacaaaagtaaccagttaatttatgtgtctatttgagaggttaatcatctccagtgccaccttcagatccatttttcagctccatgaaattcataagattctctttacatattccatttgtaaaccgaaactgaataataattcagatgcctgaaatacctcttagccctgggagtgacctaatttctcaagatctcagttttatcatctgtaaaaatggaatcataagattctctttacgtattccatttgtaaaccgaaattgaataattattcggatgcctaaaatacctcttagccctgggagttaatttctcaagatctcagttttatcatctgtaaaaatggaaataacactgtttatacggtggtgctgctataataaatcatgagataacaaagtactcaataatatagtacaaataaattagattcaattcattacaatatgtttttacaacaaatttacctttacaatgaccatctgtggcaagtgatactggtttttcattttcattattgatgtcaagttccatttaaaatgaatttcagcttaaagtgaaaatacttcaaaaatactaattaaataaaaaatacattctagctgtatatatttagattattcaagacaaaaacattctgaatatatagaaaattaacccccacagaaaaaggaaatgacaaacacaagaagaaaagaaaccctaagtgaaccctaaatcaaccagctaaccagacagcagaaatctcagatcaaacaaggaccaagagttggaggaagcacgcaaaataattctcaatggctttttaaccactaagaccaaaacagcaaaataggcagttagtcctcattgcccgatcttctttttgtggccctcacaacttcttttgttatcctggccaatctccactggaaagtctcaaagcattcaacattctccattagaagaaccacctaagtgtgggatctctatacgcccaaattatctttcccttccctgcaatcaaaactcttctccttttgtaatatgtatgtctccaaagtgttatccagaaatcctagtattcaactgaataaacaccaacagatattcaccgagcatctactcagtatatggagagagtctatgtctgtgggggaagggagtgcacaagatccaatccctgccttcgaggagttgaagattcccaagggaggccaaacggaggatgcaaatagctctaattgcagggtaggatacagtgactgccacaaacagccacagccaatatgcacaggatgtcacaggaggaaatgacttttggtttggtggggatgaggacaggttcagatggaggcagcattggttctctgagaagcatttgactttaaaaagattgtattaactcttgtgccctacccctcaattggtggattatttcgagtctcttgcctattcttggataacagctggaagaaggtaccgcatcctgctgtttcttctctgagacaggccatctccctgctcatgcgcatcacaagcccacaagacaggcttaggtgcatgtggctctgtgcacaaccctgaccccacctggcaaaggcctcagctccaatgccgcttctcagagagacccccccccccaccatactccacctcctggtgcactctccccttccagcccccrtgggctcctttctaccaggagatacgggaattagcaccattttagattttcttagctgttcacttttaaaaatttaatacctccccctataggaataaaaattgacaaggaaagcagggtctttgcttttcttgtttacccctgtgttcccagtgcctgataaatcacagtatttaatacatatttgttgaacgaattaatgaataatagtctaattcagtctcttcttctcgagtttcttcctctctctggtttgtttttgtgaagaggggtccagggttttagaaaatacatatgattcattccaaagtgacttaatcaaaaatactcatacttgggttcagtatggcaactgacaaattagcagagtttaacagactttggtttgtgaagagacttgagccagcatgcatcttttcaggtaaactgatatgcaacactggatgggacagatcatcatttatccctcccaccatcctttctctcaacaactatttttttccagctttattaaggtattattgacaaataaaagttgcacatatttagggaatatgatgtgatgttttgatctatgtgtmcattgtgaaatgattactatgatcaagctggttaacatatccatcacctcgcaacattatcgttttgtgtgtgtgtggtgaaaacatgtcagatctaccctcttggcaatcttcaagtataccacacattactgactatagtcaccatgctgtacgatagatctctagaacctattcatttygtctaactgaaaccttgtaccctttaaccaacatctcatttccagtcacctctccccagctcctggcaaccaccattctactctctacttcaatgagtttgactttttttagattccacatataagtgagatcatgtggtatttgtctttctgtgtctggtttatttcacttagcataatgtcctctaggttcatccatgttgtcataaatgacaggattttcctctttttatggattaatagtattccattgtctgtatataccacattttctttagaagaaatgtgttacagatttcatgtgtgatacagatgaaatgaagtgtccatttcatctgtaaatggacacttaggttgattccatatcttggctattgtgaataatgtagcaatgcacacaggagtgcagatatctatttgagatactgattgcaattcctttgaatatatacccaatagtaggattgctggatcatgtggtagtgctatttttatttttttgaggracctctatactgttttccataatggctgtaccaatttttatttccacaatagtgtattagggtttccctttctccacatcctcaccaatacttgttatcttttgtctttttgatattagctattctaacatgcatgaggtggtatctcattgtggttttaatttgtgtttccctaatgattagcaatgttgagcatttttacctgtacctgctggccatttgtatgtcttcttttgagaattatctgttcaggtcctttacccatttttaatgggattgctttcttactgttgagttgtttgggttccttatatattctggatattaacaccttatcagatgtgtttgcaaatattttctcccattgcatgggttttctcttcactctgttttctttgctgcccagaaacgttttagtttgatgcaattccattgaactatttttgcttttgttgtctgtgcttttggaatcatatccaaaaaatgattacccagacctgcatcaagaagctttcccctatgttttcttctagcagatttacaaactctggtcttacatgtgagacttcaattcattttgagttgatctttgtactttgtgtgagtcaacacatatttattaagcacatattatgtgccaggcttatgctagacatgggataaaaagctgagcaagataggggttctgccctatggagcaaagtcagaggaaacactcaaataactagtgcgaggcctccggggtgaagtctgagggagaagaaggaatatcctgggggtcgtagcaggtggaggtggtggcattgttggcaaagagagrtccatgccaacggaaaagcaagttcaaaggctcaaggtgagagtaagcatggcacatgtgagaactaaaaggagttcactcttgtttgaggccactgatggttcaaagctggggaactctcaggccatctgtctttactcagtacaaagaccaggagagcttgggggcagagtgggtcaccagctgtcctcaggaaatgactggaatgaaagctctgccggctttgttcactgccatgctttgttcgctgtctgaggatgcagccagaacatagtagattcttaatgaccatttgctgagtaggtgaatgaagcccccacagatggtctcagctttctcctctagcatcaccaagccccacagagtcataagaccagaaggcaacttgagagccagctggtccaccctttcccctccaggctctgtcctgcccttaaacctccctcacaaatggcactgttttgtagatgttataaactacagtagcatgacttgtcaattgggttcttgagatcatactcacaccaagggagagacaatgtgtccagtcatctggtgagtccaaggcagggtgcagaagagcagggacgacagtcctggatgcccaggctgcatggcaggcaatgagggagctctggctccyagcactgtttgtcaactattaagatgccatggtggctgggcatggtggctcacacctgtaatcccagcactctgggaggccraggcaggcagatcacgaagtcaggagattgagaccatcgtggctaacatggtgaaaccctgtctctacaaaaatacaaaaaaattagctgagtgtggtggcaggcacctgtagtcccagctactcgggaggctgaggcaggagaatggtgtgaatccaggaggcggagcttgcagtgagctgagatcgagccactgcactccagcctggghgacagagcaagactctgtctcaaaaaaaaaaaaacaaaaacgccgtggttcttcacttccaaatctgcctctggaggtcaatgacctccacattctcaaagcagcacatcttgtttggaaattatattccttgtatctttggtgttgggattttaaaattcgagtttagttcatctgccagtaccgtgcgctggctaaatgccactgtctctcccagagagggccgctgggctgacatactcaaggtgtcctggctggaaagctgtgagcagtggacacagcatttagcccatacccacatataccacttgatctgaggtcccaagacctcttacttgggcaattgcagctgatttccttgcctttcctccaattagtcactcagcagccagaatgwcattttaaaaatgcaaatctgataacatcacatcccagcctgagtattccatagtttcccacagttcttcagacaggtgcctacaggaccctgtgtagcctggccctgccagcttccccagccacagccttctcccctcatccataatggactctgttcagttcccccaagtaaaacttgctctttctggactcatgacctctgcacatttacctgcaacctccctctctctactcactagtaatagaaataccccttcctctaagaagtcttccgaagtctcccaggtcctatagattgcttattacctggctctcagggcaacctggactttgccactataatactcagttcattcaaaatcrcttgcatggggaaaggtcttccccaccagaattcaaacttcaagagagcctctctgtgcctgccttgttattcacaatattccttatgtctggcacatagtaggtactcactgaatatgtgacaagtgaatgaatgagtcctccgattgttaaacagctgggaacaattttaccaaataaaataagaggcagagacaaactgaaatgtaacaggacctcatggtaatcctgagccacctcccttcctcaccctaaaggcctgatgtcatcatattatgggcttgtgtgttgtgattaggtcccagtttttgagatccggtttctggctcagttcagagaaagctgggcctttccaccaggcaccatcatggtcagcaaagcagaactgtggagcaaatcagataaggtgcagatgcattggtgtacctgctagtggcccgtgcctcycgtctcactgcagaagcagaaawtccggctccagcctcacacagcaaaacagagcaagaaggagggggagtcttcacttatgttgcctcaccctctgttttattttcttcccaccagcagcaacaaacagtaattcaataaaggaaatacaagtaatggaaagaaatagaaaaaaataaacatatcaaaatgggcagtgtccccagggccaccgcttttaaataaaacaagagtagatttggacatatttcagtggctttgctaaaaagagaaaaataatcaagccttcccttcctttctaggctgcactgctttcttctatcttratgtagaaaaaatatcacccagactagggagtctcacatcagamtcctctgtggaatcttgttgaacatgtgggtgccagccccgactcagcccagcaagtcagaaccctttgttgggggaacctatgtgattcccaggcaggtgggccctactttggggaagaaagctcagggtgggagtgccatggtatgtcctgtgccttgtaacacaagatgcagcttgggtaagaagctcaggtctgtaactgggaattccagcgtcaggcgctgcaaacctcatttaaaataaagcaccataagcttgacttcggacatgcagaaaaatgaagattgttgatttcaccttctgtggaaggggcgggggggcatattctattcattttattcacttaagtcgacactgactgagctgctcccatagggaagggcctgtgccaggtacaatagaaaggtgatgatggcggtggatttgagcaagatgaagatgacggtaactcacatttactgagaccttagtatgtgccaggtgttttacatgcattatctcatttaatcctccccaacaccctacgaggtactgttatcatccccattctgtggacaagaaaactgaagaaaattgaggcacaagggagtggagtgacttacccaaagtcacccagcaagttagtgcagagccacagggggagccaggtctcccggactctggagtctagtatcaaccattatagtgtaagtctcccttaagacattcagcccctgcctttccgatacttaaattaagtggaaaaggtacaagaaaatcaaaagaagtactccaaattatacagctttgtgcaacaacgagcaatcgacctggggacatctggtgagacttatcctgttctggctaattactcagcctgactgtttgttactttgttacaaggagtcgtggaaaaaaaaaaaagaaaaaaaaagcaataaccaaagcaactattttctcttctccatggaaaggcacagtcagcagatttttagagaaagtcaaacagtaccattatccacaaaagtgtaggagccaggagctctgcagtccaaactgaggagggaggcttcattattttgtgaactcccaaaggatgaaagacattaataatactatttgtggtaagcttatcatatgctgcgtactggactattccctctacacgttattatcaaatttgatctttgcaactctatgagtaagtactattcagatgaggaaccagactcagagcggctagcaactggcctatagtcacacatctgcttagtggcaaggggtctgaattccagccatggttcttaccctgaatctaggctgtctcttattttaaatacaaggataccgtttggaatgctaagtgagcaagaattcacaaccgtctgccatttttaacttggctgtgccaagcctcacttcaatctgggagactggctggattcttatttcagcaagtattacttcaatacactatgctctgtgccaggcacaaaagccctgcatttaataagtgggagatgtggtcacagtggataaaaggagcacacataaaactttagagaggtgatttcactagagggagttttttttttttttttttyttgagatggagtctcgctctgtcacccaggctggagtgcagtggcacgatctcggctcactgcaagctccgcctcccggattcacgccattctcctgcctcagcctcccgagtagctgggactacaggcgcccgccaccacgtccagctacttttttttttttttkgtatttttagtagagacagggtttcaccgtgttagccaggatgatctcgatctcctgacctcgtgatccgcccgtctcggcctcccaaagtacgtggattacaggcgtgagccaccacgcccagccgagggaggtcttgattcaacagagtcattagtgcctggagattcatggaggagctgagctttgaacagatgccaggagtggaggagaggtcagaagtcaggggatgagcttcgaacagaggtcggagctgagacacctctaatggtggtatagcaaagcagtaaattgggccccaaagagtcaaaggcaaaaggcaagtccaaagctgctttcagccaatgctgcagtgggcattctgctccccgtgagcctggggcacactggactccggcaagagtcacaggcccacactgctggaagagcatccctcaggtagggcacgtgcacaaaaatgggtgcagggaaattccatgaatgctactgtatgtcttcagaggaagtttaggcaaaggaagcaagcctcttttttacaaggagattttgacaccaaagtcagcagatctaaaactttcacattaatttctcttctaccttaaagagcagacatatacatcagaaaggaagtagagagaagtcaaggaataaaaatggaactcaagcctgtaaaaggtacacacattcggaaatgtctgagtaaaagccttaataaaatgcatgtgctttcccccagtaattccatttccataaattcttcccaaggaagtaatgggatagttggcaaagatgactacagcagttttgcttataatagtgataaagagtaaacaacctatcccagtactttgggaggccgaagcaggtggatcacgaggtcaagagattgagaccttcttggccaagatggtgaaaccccgtctctactaaaaatcaaaaaaattagccgggtgtggtggcgggcgcctgtggtcccagctactcaggaggctgaggcaggagaattacttgaatttgggaggtggaggttgcagtgagccgagattgtgccactgtactccagcctggcgacacagcaagactccgtctaaaaaaaaaaaaaaaagtaaacaacctaaatgtccaacaataaaaggttagttgacacagttttgcatgttcctattgtggactcctgtgcaaccattacaaccattacaaccattacaagtgaaggtgcaaccattacaaatgaaccatctgtatgcaaccattacaaatgaaggtgtaggtttctgtttattaatgagggggaaattcctaatgtattgagtaaagtcagatcataaaagagcaggttataaaacagttcactatatatgattctgctttgtaagatgcttacatctctatgaacagaaaagttaacagaaggcatctctggcagatatgatcatggacaatctcttaaaactttttattgtttatctgtattttctaatttttatatcatccccttatggttaagggtttgtaagtggactgatgtcccctgctttgttgaattgataaaacaccaaagcaacagaccttaaatattatttctttgtttcccaaaagtatggtacatgtgcccctgttgataagagaaattctgagtggtactgagaagtatctttgaacaacactgcagagagaaaagaagcccccatctttaagtctccttagtcattttggttactcaaggagaaaaccttggcttgggacaattatgttttcaacttccctagaagaactgctcttctctctttataaccaaaagagcccagcagacaggaggcagcatctaagcagaagtcaatgccattgctgtgcttcattgtattgatctttatcactgccttctatttataggaaatttttgcagttacaccagggagataaagcttgctttaaataagaaaattaggccgggcgtggtggctcgtgcttgtaatcacagcactttgggaggccaaggcgggtggatcacctgaggtcaggagttcaagaccagccaacatggcgaaactccatctctactaaaaatacaagaaaattagctgggcatggtggcacacgcctgtagtcccagctaatggggaggctgaggcaggagaatcgcttgaacccaggaggcggagcttgcagtgagccgagattgcgccactgcactccagcctgggcaacacagcaagactccgtctcaaaaaaaaaaaaaaaaaaaaaagctaatttaaataaaatttaaaagtaaggaatgagttgagaggataatgatcaaagtaaggaaggcagtgcacctgtattgaagtctgaggcaacgggtgttaacccctggtgaggataaagctacccctactgtgaaatatcccaatagttcccccaggtcttgatttctatcttatcactttaatataaaaacaatagcatggaaataataaataagcaatttgctcaagtgatgacccagccagtggggaaataatttcagaacaggattctgagaacgtccagataaatcctgctgggaaagtgattggaaagagaggttcctaagaagagacaaaatttctttgcaatgtttgccctgaggaaaaaggcccttccacaggaagaaggtcaagtccggtctatttttataagtgtttttcaagtggttagtggacgtatttcctgtggttcccaggaattctgcagcaggctctcaggaggatgttggtgatagggaacagggacttgatgagcaagaatcaataattatctctatatttgcttcacttttttctataaaaataatctaggggaaaaacacttsctttagaagagcaaagttcatcacaacaaagagcagaatgggacactgaagtcccttagtgcgtagcagagtccttaggtcaagattctacaagctgaaatttatctgttcatttgttccctccctccctcatttactcaataaatatctgagcaattcctctgtgctggccatcgtttgagggctgcgcagaaggtgttgaataaacatggcttctgtcctccagcagcttacagtccagcgtgggaaaaagatgtcaaacaagaaaacgcatggatggatatataattaattacagatgatggtgaatgttggaagaaagagaacaagaggctgcaaaagagaatcatggaggtagagaaggaacttaccttagytggggagaccagggaagacctctgaggtggtggtactttagctgccctctgaaaggggcatgggaggcagcccatgggaaactgttagggaagggcactgctgcagagggaccaatttgtaggaaggcagccatatggaggagatcatagtgggctcaaggacccaagggtacatgcagtggctggaatagaggggcaaagggagggaggagccgtaggtgaggccagaccatacagggtctcataggccatggtaagggtttggattttactttatggaaatggaaagccatgacaggttttaagctagggagtagccaatctgatataaactttaaaagatctctctggctctatgtgtaaaagtgatgggagggggccaagagcaaaagatggggctatttcagaaggtaagataggagctgctcgtgaattggacctgctgtggacagtggggttggtaataagtacttaacgtgataacccctcatggcagtccaagggctcgattagcagacctcagagaagtcagccagctaacacagctgggactagggtgaggtgtgggaggcacttgctttgggtaaaaatgtactcaagcactcaagataaatcatattttaagccaggcatggtggctcacgcctgtaatcccagcactttgggaggccgaggtgggcagatcacgagatcaggagatcgagaccatcctggctaacatggtgagaccccgtctctactaaaaatacaaaaattagctgggagtggtggcggacgcctgtaatctcagctactcagaaagctgaggcaggagaatcacttgaacccggcaggcggggcttacagtgagccgagatcatgccactgcactccagcctggccaacagagcgagactcyatctcaaagaaaaaaaaaaaatatatatatatatatatataatatatatgtatatataatatcatattttaatgcagtatttttcaaaaatccaatttaatgcaaaaatatctgtgattaacaaaatattaaatatagcaaaatattaaataataataataaagrcaggatgagtaacagtgataatgtgagcaaaacaaatttgaaatgggcccctacgaggtttacattagtgtgcatatacagttgtgtggagtgagacagacaataacaagtaaacaaaaaagtaawcacaatcctaaattatcataattgtcatgaaagaaacatgtttcagtctgagatagaggacaaggaagtcaggagggcttccttagataggctgggcctaacgcaattagatttggaggcaaatgctctgcctggaaatgttatgkgttaatgaaaatttttgcagcccagcgcagtggctcatgcctataatccctgaaatttggaaggccarggtggaaggactgcttaagcccaggagttgaagaccagccggggcaacatagcgagaccttgtctctactaaaaatatatatatttttaaattagctggtsgtggtggtgcgtgcctgtagtctgagctactcaggaggctgaggcaagaggatcgattgagcccaggagtttgaggctacagtgagctgtattcgtgccactgcactaaagcctggggaacagagcaagaacctgttacacacagaaaaataatttttgcaaatcaagcctatcaaacttcctacattgtataaaattttacaatctagtaactggaaaggttggaacagatctgtagaaaagttgctctcaccactgagggttcaagagtacaatatcgtgaaacactaggaaaagttctgccttctgtcttccccaccccaggggcctatctaaacatctagatttatcaracttcataagagcccactgaacctgacaatgccaagaaggagccaaggaatgcaggatcttgaatgtgaagaggaattatgtgcgaaaagatggcagctccgagaagcaagaagtcactctgacgttcctccttacytcttgttgcctaatctgctttcaaaggccaataaattcaaaattctccatttttcaaacaaccccgcccaacatagtgattctttaatctctaaacatgacagggggcagtggacatgaaggatataaatggctttgaaaggtcagttagaaaaaaagaaacaaggagaaaaaccatgaggagttgaagggataaaagcaaaccatgttttgagctacctgccaaagttaaagaaaactcccttgagaggccatgtttgacggatgagtttactgacatagttattggcaactatctctagcctcatgattttgagacggagtcttgctctttcacccaggctggagtacaatggtgcgatctcggctcactgcaacctctgcctcctgggttcaagtgattctcttacctcaacctcctgagtagctgggattacaggcatgtgccatcacgcccggctaattttttgtatttttagtagagacggggtttcatcatgttggtcaggctggtctcaaactcccaacctcgtgatctgcctgcctcggcctctcaacatgctgggattacaggtgtgagccaccacgcccagccctgataaatgacatcttgactgcaatgtgcaccttcctgaagatgctagataccaaggcagacttatctcttagtatagcttcttggattcaagattttaactcacctccaagccttttcctcccttatcagacaccagtcatgtcctggggcctttggtgatgttctcttgcatcatctccttcccataaaggaggactcctttgcctgccaacagctgggttgtgagtggagccaggtgtagaatactaatgatgtggtcacaggaccatgagagccatcggtggtgctgaaacagggagcaaacagtgcaaatgggagaatggttccttttggactgtttatgtgggatcaaagggagctggcaagtacatggaacctctagaaatagaccacatccttaaaaagaaaaaatgcaaaaagaaacaagttttacattgtcctagtgtaggctctgcaaaaacttggcccttgaaggctagcactggggcaagtgactgttttcttcctgccctttggctgtgataccaactgggtcgctttgcatatcctgggccctgctcccctgcctgcttcctgcgtggtgcttggggcatgctggggcctccatggccccctttcaagatccagaatggagtctgacatatgaaatgagctccacagggttgacattccttcttcatatccaagcaccttaatacacaaacccgcatgctgggattgctaactgttcttccagagatgccgggatattgtctgtctagtagaaatgtgagttttgtcctttttattttttaatgttttragggaggctgggccccttggaaatggggatgacattataaactggtatttcgggactgagggttttattattgactaagccacagatttgctttggtaagctgtccattctctctgcatcacacttctcttggctggagaagaaggagaggtgttcatctagcccatatgatagaggaacagcaaatacaaaatgattatgaagtacctcatatagtgtctacacaacagctatccagagatgcttgtttattcatcccaaatgctccgtgaaaccccaactgctatcaaagttcagaaaatcaacccactaaacacaggttcatattaacaaggataatgatagctgacatttcctagcactcattatatgcaagctccctcctggaccttgtcctattcctttctcatggcaacgtgatgagatcagagctcttaacagcttcattttacagagaagacaactggggaccagaaaggttacatgacttgcctggtttgcaagaacttaatgacacagcagaaacccaaatccaggtctatgactctcaggttgtgagaatttccattttcatgacatttccaacacagtctgaaggagtctctggcctctcccccacccttcatctgcaatggcaaatggctgccctgacaagggccaagatggtctcacaggctgcagggtcacctaaaggaggcacaggagtgacaatcaggaaagtgctgatggtgggacgctgcaccccggtgaagaggacaggccatcaggggaggaacttgcaaagttccattcaataaaaacagatatctcctttagaacatgaacgaatgggctgtacacgttccgggggctggtagagtaaaaagaatagagaagctcaagggtcactcagttcaaggggcattttattctcttatccacatttattcagcaatgaaaatagtggactctggagtcagcaaaccctaccttcagatctcagctccaacacgttttaggttggtgcaaaagtaattgcgcttttgccattacttttaatatttagtggtatgatcttagaaaagtgacataaactttctgagcctcacttccttagctgccaaatgggggaactcagacaatgccttgagttcagtcgaggacagcttcccttttctgttaattaaactttggaatgttggggcattaaaacaggctagggtaggtgattgcacagagaatactattctattcatttccttcctagccaaaaacaaaaacaaaaacaaaaatactttcctaacagaatttgaggattaattaatgtaatgtgcttagaaccatatctggcatacagtaaatgttcaagaagggtcattatattattatttgtggacatattttattatttacggataggtccagagtcggctattgagtaacaaatggtagggcaagccctcagcatttctaaagagataacaaacacatacttcaaaagactgcatctggagaagctaaattttctaggtcaaggggaaagaaaaaaaagatgcagccaacagaccatcttcctataagctggaatgttggctgatttcgagaaaggaatgtccttgccaggctggttctggaaattgtaacttgcacaacaacagattcaaaagatttttggagacacatcagtaagagaaggctaaaggaggtggcgaagggctgccagagcccctgcagaatcactttgcatttggcgtgaagccctggggctttaatgtgtccgtctgcaggaaggatatttccatttaagatgtgtgcaggtcttcaggatggcccagggccggccggatggtttggaccgtggtgtaccattaaagttcagacagaatgggggcyggcagagcacaccattgcaccagggagcactctgtttttccttctggagtggatactgttttctctaagcacttaaaagaattcctgacctccaactgaatgatgctctatgagggggagtgttttgtggatgaataagccagactgcagggaaaaaacatacagaatcaagggaagaaataaaggatactacaggacacgtgtgtgtgtgtgtgtgtgtgtgtgtgtgtccgcttgtagttctctctcttcgttatgaagtgtgcaagctggggctgggactgagctgtttggtgacacagctggattagataacagccccacttcctgccagttacactagatgcaagcatctatgtccctcttatctgaaacatggcttgatgagtctggtgtggctagactgtaaactccttaaaggcagcaactgatttctactaccaacccataatcccttatttgaaaagccttgggctagatatgtttcagaatctagaatttgggtaattttagcgaggtagtatggtgcatatgttgtatattatggaacaactccagtggtgtctgggacactaccctagaatcaaacacattagtaactgtaccagattatataagtattattaacacaatgcagaacaaatagactttaagtctcaggacagtttgggctaggttttgccacagtctgttatgaaagaacttctagctttcagagctttttgaatttcagaattgtggattagggatctcaggtctttctttttctttcttttcttttttaaatttccaggatgtctrcagcattctgcccatggcaggcactgagtagaagttgttgacttctagagtatgtgacatcttgatctccctcaaataatatttgattctagaaaccaggggacagtttattctcagtgacttggggagtctttagaattaaaagtatcctaaattaaagagcagaagagaaagactattaagcacattctctgtcatcctgaacagtaacacatgtagacccatgaaatatactgaaaattcatcactagcacgtcatgttgagcacctaagcaaatgagagcagtgcatcagtgcttataaatgacaatggaaagttctaacctatcacttagaacatggtatttttcgaatactcctaaaatattactaaatgggccaggcgtgatggcttatgcctgtaatcccagcactttgtgaagccaaggtgggaggattgcttgagcctagaagtttaagaccagcctgggtaacacagtgagaccccatctctacaaaaaagaattttaaaagttagccagacagccgggcatggtggctcacgcctgtaatcccagccctttgggaggctgaggcaggtggatcacctgaggtccagagttcgagaccagcctggccaacgtggtgaaaccccgtctctactaaaaatacaaaaattagccaggtatggtagcgggtgcctgtattcccagctactcgggaggctgaggcaggagaattgcttgaaaccaggaggcggaggttgcagtgagccaagattgtgccattgcactccagcctgggcaacaagagcgaaactctgtctcaaacaatcaaacaaaaaaaagttaaccaggcatggtggcctatgcctgtagtctcagctacttgggaggctgaggtgggaggatcgcttgagcccaggaatttgaggctacagtgagcatgagtgtacactgcactctgcactccagcctgggtgacagagcaagaccctatctcaaaaaaaaaaaaaaaatttttttaatgaaatgacacaaaatatttctaaatatgaaaaatcaagcttgttcaatcctaaatcaataccagatgatttgtaaaagtgacaaaaggggccaggcactgtggctcatgcctgtaatcccagcactctgggaggctgaggcaggtggatcacctgaggtcaggagtttgagaccagcctggccaacatggtagaaaccccgtctctactaaaagaatgcaaaaattagttggacgtggtggtatgtgcctataatcccagctacttgggaggctgaggctggagaaatcacttgaacccgggaggtggaggttgcagtgagcagagatcgcaccactgcacttcagcctgggcgacagaacgagactctgtctcaaaaaaaaaaaaaaagtgtcaaaagggtacacagctggtgatagtcaagctaatatctatcgaatgcttacaagttctcaagtgctgagattacagtgactctgttcagtagctactgttatgcagccccattttgcagatgaggaaactggggcactgtgagaatgagtcatttactagtgagtgtccaaccaggattcaaacccaagtttagcagtatgctgggtaaaccagctatcagaggggaaaaaaaaggagaattttaaaagccctggcatttgccaatttctatgatataaatactctcaccagggttgatttcaagatattaatggtttaataatagtaaaattcctgaatatttaataattggctttcatgagcttctgggagctgtctcctgcacaccattgtcaagtccatcccatagtcaagtccacagtttactgtcaaccacggaagatgagatttcagctcatggaacagaactggtttgggggcagcatgctgagatgctagcccaggccaatcagccatggctacactcctacctcagacccagtacagaccatggaacatggagcaraagaaayagaaagcaaagaacacactgcctccctttcttcggcaaactttccttcaccagggagtggaaggtggggccctgccagcctaacacgctgtggcagaaataawaaaagcctggatgttttttccaggccctacaaatatttttcttggttagataagttcagacttgagactaaaggagctgatcacttcctttctgagatccttagtttccatagtattttctttaaagaaataaggaagtatttattacaagatgaggacagggtttgagcctgcctttaaccaaaggtagggtattctggcctaatttgaacccaattaaaatacatttagactcttggcttagcttctttgtcaatacctataggacatcacctgctaattaggtagtctgataagatgttccacaagaggctcctgagaaaggactggcccttcaatcaacaagaattcacaggacactaataatgcataggtatttgctcaatgctagatacagaaagaaaaggcatagtttctgtcccagggtctcagagactaatgaaggagtcagtgaagtaaacgtagttaaattacattcatttgcccattcaacagatgtttatcaaatgcccatcaggtgycaggcattttgctaggcactgggataccattgtgagcaagaccaattggtttgtactatcatggagctgacagtccagtcatgaaaagagacattaaataatcacaagagtgaatgtgtaattaaacactggtagtaagagccatgaagaaatgttaaatggtcctatgagaactggaggaacctgactcagttcagggaagacaggaaaggctttcatgaggaattgagagttgaactaaaatttgaagaaaaattaggagttaaccaggggagtagggtagagagaaagagaggaacatcactccagagggaacagcatgggcaaaggtcctagggtggggggaatcagaaaatggaaggcaagtttggagggagacgtgatgggaaatgaggcagagggggagtaagggctgaacctcccagagtcctgcaggccacagcaaggcttttgtttttgtcccagagcaatgggaaatcactgaagagtttaggcagggggatatagatgggaattacacccagcgctgcagtgaagtaaaggaaatgctgtctgctgttgggagagcacaggggaatgaacccacctaaactggtatatgtgaattttaagaaagagtagggaggttagggttgggggatgtgtccaaataaggcttgctcgaggaggaaatatccgaaatatccagctaaatttttgaagggtgagtgtgacttagtcagaccatggtgaaagggtggaggaaaggagggaaggagggaggaagggagggagggagaaagagaaaragaaaaagagagagagaaaaaatactgttggcagcagcacaatgtttgggctaagacctgggtgagtatgagggtgtagggggactataaaaagaggccaataagagaaaaagtcacagggttaagaaggggtcaaatgatgagagcctcacaggtcatggcaggagtctgggttttatctggaaagacaacgggaaatcaatgacccagtcaaagatctacagcaggggagtgatgagttagaatggtcactagcagcagaattgacagtggattgaaagaaggcagtgctggaaaggtgggacctgctgcagcagcccaggtgagacaggtgctgggtctgtgctaaggcaacagaagtgaggctggagaaaagargatggctttrggagacactaaaaaggtaaaactgaaagggcattttcaccaactgaacaggtgggagtgatttctattctgcccaaagaatagtctgaatgaaacaaatttttctatttgggttgtcttgccttatgacctggtacatggtcaattttcgtaaatgctccatgtatctttgataagaatgatgttcacttcattgttgggtacaaggttcttttatacactcatcaattaagtttactagttgtgtatttcaatcttctacatattaatatttggtgtctgtttgctctatcatttatgacagaaatgtattataaaatctcccaccataattgcggagttgtcactttctctttacatatttgtcaatttttgttttatgtattttgaggctatgtcattagatatatacatgtttggaatttgtatatctttctgttgaattaatccacttattatgtggcaatcccttttatctttagtcattctttttgccttagacctactttatctgatattaatatagccacacgagttttcaatttttttttttgagacggagtcttgctctgtcacccaggctggagtgcagtggcgcgatctcmgctcactgcaagctccgcctcctgggttcacaccattttcctccctcagcctccccagcagctgggactacaggcgcccaccaccatgcccagctaatttttttgtatttttagtagagacagggtttcactgtgttagccaggatggtctcgatctccttacctcgtgatccgcccacctcggcctcccaaagtggtgggattacaggcgtgagccaccgygcccagccgagttttcaatttttttgttaacatttgtctggtatctatttttcattcttttgcttttaacctctctatgtcattatgttttaaatgtgtctcttgtaatcagagtgcagatggagttaaaaaaaaaacagtagctagtaaatttagcacatttacatttattgtgattatacatatatttggatttattttggccacctaattctgascaatttttttactttattttctttttttctttttctagattattttggaatagcacagggttttgtttttttttcgttttttggtttttcttgagacggagtttcgctgttgttgctcaggctggagtgcaatgccacaatctcagctcatcacaacctccgcctcccgggttcaagcgattctcctgcctcagcctcctgagtagctgggattacaggcaygcrccaccatgcccggytaattttgtatttttagtagagacggggtttctccatgttcgtcaggctggtcacgaagataagcacagttttatttattccaccttatcccccttacgcctaccagttgccgcttggactaaatacattctatttcttttcttttagtagttacctttaacatttaacatgtatatttgacttaacaaaatttagttaatatctctaaggaagaattaagattttgggtgatgccattcatagccacaggcagcaaggacttagagcatatttggaaccaaagcyaaggcctgttttgtatatgctgggtttgaggatacatccaattatcaccttagcaggtgtctgtctacacatctaccttcagtggctttatatactctgcaaaatatcctccttcatgggtattccacattgcttacacagtgacagggattaaaaacaaaactaaagsctgggcgtggtggctcacgcctgtaatcccagcactttgggaggctgaggcggacggatcacraggtcaggagatsgagaccatcttggctaacacggtgaaaccccgtctctactaaaaatacaaaaaattagccgggcgcggtggcaggcgcctgtagtcccagctactcaggaggctgaggcaggagaatggcgtgaacctgggaggcggagcttgcagtgagccgagattgtgccactgcaatccrgcctgggctaaagagcgggactccgtctcaaaaaaaaaaaaaaaaaaaaaaacaaaacaactaaaaaataaatgtcagtgtttgccttcctttgattcttaacacatcacagtctttccttccagcttagtttccagggccaagctgggcacaaatgtctcctagawataatgggcctcgcaaataactgtaataactatatagtaactgtcactatattaactgttgataagctgagaactgagtctgaaatgcagaccaggattttttcttacataaccatggcttacctttgtgcctttcatcttctctgctatgtttgtggcttacagcacagggggaggagcttagctaatttctgccaaatatgggaatgaaaaacttctattttcaaaccaattaaaaaattattttaaattaagcatttaatcacagctgacttagatcacaccaggctccaacgagttcaacataaccagttactattatctcctataggtcaggtccaatttttcaagcgctgtatcaatattgtacccatttaatcctttagacaactgtgtgagaggcaggatgagaattattagaggaaacatctcagaaggagtgaatgactcgcccgggttcccagagccaaagtggttgcttactatccacatcctgttcatgtgtcagagttcaggttcccttccagaggccacagctgacaaagtatgtcagccttaacacagatgttccaataggcttggtgttcctctaacctgggtgtcactgataaatcaaaaaaatcatctggatttcctaaaatctcacccgtaccccaaatctcaaagggctaggcttcgtgcacaatggtgacacggagttcgctgggcttgatcttctccatttcccagcacaacacagacaatcccctcctctgacagccactaaaaagaaaatagtaacaagaagcagagcttataaatttccttacacttaatgcctgatttcacttagttaatggattcatttattaaagcaatttgtgtaaatctccaaggacctgctaacgttgctgccttatggttttatcacgccatatacttcctttatttctaccctttaacaaatagtggattggcaaggaactttggaccaactaccgctcaaactataggtaaattacaaataaagtttaaaataaggscttttcatgcccctggggtttcctttagcaacaaaaagggatttcattttttatatgtttcagctgagtcatcaatctcagttaccatggtctgtcagttycatgttgactccaggcttattttcagaagcctacatgtctccttcaggttttcagttgtggatstgaagggtttggggagccatctgacatcagtataggcaccctcatgatgctccctctcactgaggggatcaggcagagagcagagttgtggccttgtatgactgcaggtacactgtggtcaggagggaggggcccctgaggacctgctgggctctggctgaggttatttagccagtgaaaactccacagtgatgaagtctgggctgcatggctcatacacacatggtctagaatctagaagaaaagccattctttttttttttgagacagagtctcgctctgtcgcccaggctggggtgcaacggcgcaatcttggctcactgcaactgtcgtctcccaggttcatgccattctcctgcctcagcctcccgagtagctgggactacaggcatgcaccaccagacctggctaatttttgtatttttagtagagatgggtttttgccatgttggccagactggtcttgaacgcttgacctcaggtgatccacccacctcggcctcccaaagtgctaggattgcaggcatgagccaccacacctggcctgaaaggccattcttaaaatgaaattgccccacaatcagaggcaaatgggacctacactggaggaagtccagagacaaggagaaacaaaattcggcccacctaagattgacaatacaaatgactatttgtgcagttaagtggcaaccactggtatataattattgtctcctgtaccaaatgaaktacataacttaggaagtgcttggaaaaaataaatgaaagaaaaaaatcattacctcttagttgtattttaaggaaggggaatctggtgatggttgagtgctaatagagaggtgagggataaagatatccacactgggaagagctaaattgctttacattagaagtggatccagaagggagtggagtgaggagttagagtgagaggctgggtggagagaggagtgagtggagagacaggaagagacagagggacagagagtaagagagccagaggtggacacagaaggacttagaggcttatggataagaaagtaaggtttggaagagacagtgaggatggagagagattgtactatgcaaggtaaactctgcaatcctctctgtgaaattgacataaataaaattacatatatgtggtattatatttattttctgtctgttgctgtattatgtgaaaagaattaatcgaagtttcaccatatgggatggaggggacatttgggatgatctgactttaaatatagtttatatggtatttgcgaaattctctttgggattcttggaggcacctccaacactagttgaaaccagggacaatggctggcccatgtggtggcagagtgggaaaaatgtaccagaaacattaaaatgccaggagcagagaaaacagatggaggcttccaacaygagccctcattttaaagtcataaggacaaattattgtaattggtgtcttgatttatgatggaaccatctcctatgagagcagctccgcacagctgctacaggcactgatggatggttagtgcagggaaggcagggtagctgctggtcttccatgatgctcacgaagctgctggggtgggcttctcctggagaaggtggagatgcatggagtcctgtttcacagatggcatgggggcaaaaggagaggctgttggtggagactagccaacctttgggtcacaaataaatatatgaatgacaagttaatggtggcagatgtacatgtcaggcaatgggtaaaaaccccactcctcataaaaagactagtgtggataaagtcactaaaccttttcatggtgatcaagggcaaattggggctttctgttcccagactccttttgcgattcagctccatcgcttactagctgttgcccttgggcaggtcactgaacatctgtaagctttggttttattaaaaatgatgataatattagtgtcyacttcaagggattatggtgagattacttgagataacctgtagcccaaaatacgttaatgatgagggtgatgatttttattctragaccacttgataatcaatatgtattgatgatcacattcactactcacacttacaaagtacagctcccaggccgggcgyggtggcttacgcctgtaatcccagcactttgggaggccgaggcaggcggatcacgaggtcatgagttcaagaccagcctggccaacatggtgaaaccccatctctactaaaaatataaaaattagcctggtgtggtggcgcattcctgtaatctcagctacttgggaggctaaggcaggagaattgcttgaactgggacccgggaggccaaggttgcagtgagctgagatcgtgctactgcactccatcctgggctacagagactccgtctcaggagaaaaaaaaaaaagtgcagttcacacgttagtttcctggtctctttttggcctctttcttttcagtttttagagtcaccagcacttccttctcctaaatggtggggcaagtatatgttttaaccaattctaatgctcattggttttgttttttaatcctttgaggtgtaagtgatgcattttcacattaataatataagtttgtatgtagtggctacatataatgttaaaggtatattatatataatatggtggtttctgtgttctatctcacattagaaaatagctaggatgaaaacagcctgcgtgcaagggacagacccaccttytctgtgccacatgaagctatgtggaaagctgcagaatgggcaggaaccaggcatagccttcataatgatctgtctcataacatttcctttgatatggtatttgccctttaaaaaccccacttactcccactctgtgcctttttccctggttccagttctgtttcccccagcaaatccagaagcttcccttaacatactaaccctttactttccctgttgtgtccctgaaaggcctcctgtgcctttggctgcaggtcccgaacgtccaggccatctgtgctatctgcttcgcggtacctcaccaacgcaacgtgagggtggagggcagaaccttggtcctggcctctcagcttttgtgggtttyagccagaccctaggtgttattttagtgcaactttggtgtttaatttgaggatgtgtgtggaccagaaggagggaccaaaacatgattcttttccccatggtcagatgattaaatttgaagttctaaaaaatgcagtttggtccaaagctgtgtccaattgggaagagagaaaaatgccctggaaacccctcccaggcctgggaccatccttccttaaccaccagccacctcacaggcccgcrgactgcgggcatcacctgggcaggctgtgcttactcactacccgggaaccctgtgccctggagctgtccttcctctcttcaaagtgcattttgtgcctttgctggaagaacsgactacaggtttgttcaatttcttacagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacagtaagcccatctctatggcaccccccttccctttctgacatcttctgtagtcaaggtgggaggaaggtgcacatttaagtacaggtacttgcttctccaaggttctattcaggcatgacacattcagaggtggagtcacataaatgcgtaaaatgtctgggtttagaaaatagggacttgtgggggccaccacttacccaaacgtgtcctatttcaagttttttaaagcactctctgctgacccaacagaacgggctgccggtgctcaattgctgtatgttttcccaggtttctgtaactagtgaaagatctggccccgaaggctagtcaggggcctgcacgcttcatgatgggatgaaccagacaggcatggtggtaaatcctgcacagagatgtgggctccgtttcaagtcaactgactctcctggttatgtttccactgggcttgatttgtgaaatcccagttcataatcgtagtcttacacatcataaattatgcagctttccctctgcgtatcacgcagatgtggctgtggtaaccagcagtggtaaagtcattctccagaccttatagaaactggagagtaggagcgactagcgccaaatgctgaatatctcttccaggacttcctggcagcccggttctcagaggtgttgacaaatgaaggtatgactctagagaaaagaatcttcttgactatctaagtataaaaaaatctcttccttctgctttggtacttctggcattggtgtgtatgtttgatattaggtgtccaggtcctatcgtgatgttatctgagattccctgagtcccactgcagcatcagaggttacaaagaagcctaaagtcagatccagtccctgcttagagggtcagcaatctcaagagtcaaacttgccacaaatcaagagaaggaaaatcaggagacatagaagaagacaggcaggaaggaagtttctgtaggactggcttcaaaatgcaatgcaaaacactcactttgacatgatggtttatacatcaggtggtcttaattattcatggaccatgcaccagaggttgcaggctctaagaacaaatgaccacttcgctggtgctcacgctgtaccctcagatgcacaggtaatggggatggaygctggcgtttacacgaggtgacgttgttccttcctccccacccactgcacagaccctggagatgaggagcaggaaggctgaggctggggcttgcagctgcagaattagctcttttgggctttgttttgatggcttatcttcaaatgggcttgctgaatgtcttatactcagtgaaaaacaggtgtcagaatgaggcaaaaaaaaaagactctagtttgttaaatagcatacataagcaatattcactgcaaattagcaaacttagattgtagtccattgtgtcaggcatgatacacaactcacgtgatctgccccacacaacacgaacaagctttaattcctctgggttttaagtgttcctaatacgtcttaaccaattttctgaaaaagtagggaatgctctccggtcctcagaacccaagaggaaagacaaacttcatgatatgttccttggggttaagctagctcttctggaaaccttgacttctggagtaaaaaaaggctccaatactggaatttctgtagcaatggaaaatggcttaactgttgccattccatcattagcacaacagactgcactctgggtgtgtaacactggcacaacttctggagtccacagtggatttggccgcctgacttaagatgtcaggagcccctagaaagcagcacaacgtagccctgggagtgcaggtgaggatttctgcattcaaggaatgccagattattttccaagtgaacttgggcaactgcacctttcaccctcacttttctcatttgtacaaaaagaatactaatattccttgcctcacaggtttcttgggagggttaaatgagataatatagtgagagttcttggcacagtggctggcacagaggaacagcacagcacgtgttggttcatattgcagttatcatcatcaagctttccatataatcagcctagcatatggtaacacagggtcgtattgaaggaccttccagactcctctttttaacagtactgccacccaggaaagtcaaggggctagatgcaggcttagattcagcatctctctgccaacactcggagttgttgtgtgggcctattatttgcttactctggaactaagaacaaggaccaagaggacagagatcagagtaagtggggtgggtggccagaagcccatccgtgtacctgtcagtactggaactggatattccactgaagagtcagcaggctcgagttcaagcctactctgcccctttctacctggagcagccctggacaattaackttcttgccattatgcattctttctgtttgcaaactctgcgaaagaagcttcaagccccccagccctgggacgcttccagtcctttcctgactagaaattgaagtgtctctagygttcccagataattttcaggaaaatcatttagtctcgctgagactcartttcctcacctgtggaatgggaatggcagcattgcccagtgtgcctcacaagggcgaaacttctatttactagggttctgcaggtgagaggagtcctgggcacggatgtactccctgaatgtggttctgttgccctcttctgcccagtggtggtactgccagagcccttctgagtttcaagggttattcagaaacagaattgcctcggccaggcatgagacggatgctccctgactaaatgtgatccacacggcctggcaaggagatatttttgattccttgatcactagtttgagcataattagagactgargtgacagagtcacacgttaagacttccttcagaaagagcgtttctaaaagccaatcgaaaaatttaaacaaatcacacaagatagaaccgtatgcctttgagctctacaaggcagaaataactcctttcacggcttctctttgtccccaagtcattgatcattcctgggcaaatgtatcttcttcctacctctaggagaatgagtttccaagtacctaaccttccttatagtggtataaccctagggcagatgcttgtgtgtgggctgttctaatagagacctgagtaaaatgtctctactggtggacttctagcctgcagagaaggtggttttggtttgtcccatttccattccttagatcgctgctgcaggcaattaccaatatggacygtgaacattggttacgctgccatgctaggaaggccaggcagaatcagccagggagtgctgcatagattccagggctgatgggcacagtttgtgagaaggttcatgttgtcccctaagcttcagctcagggggacacataagtggtgtcaccatgagagggggaggtcctggaagargatcaggtccaggggaagatggccagttccattttggacacaagcattgaggagtgtctcacgtaccatgcagctgtcctcagggttataattctccatttatttgtgcgattatttaatggttttccctcctactggactcctagaggacaaggactttgtctctcattgctcaacactacaaattttgtgtctagcacattgcctgccacttggtaaaatgyccagtaaacattaatttgataagtgactgaattgtattggtggcagctaaattcaaagtcaacaatatattcaataaacatctatgagccctgatatgtgctaggcattatgctgaactccttcacttctacctaaccacaaccttgagaagttactaattattatcactctaagaacastgcagttgacaggcgtgaccagctcctaactgggagggcttggcaccaaccacatcttctgcttccaggattaaggctccttctgtatcccacaaccatcygacaccaacatcatgacagtggttccgccccacaaactgattcaataaacacatctgtgttatggatcagatgggtgtaggtcrggtcccaacactgctgttcaccagttgtatcatcctgggacagttacttctcaatgtgcctcagtttccttgttttaaaaacaagaatgacaacagcacccactcataggaacgtaggagttttaatgtgataatgtttgtaagagtgtttagcacactgctaggcacataagtgctcaaaaaaaatggtattgatcatcattcttccgggattcctgagccttcctcacctaaccagctgacctttcaagtctgttagattaagtgaatgctatgcttgctcgcagaactgagggtgactctttgtcccagcttctctgggactatctgggttgaagcccctgaggcctgacacagaggcataatgtgcccagacacaggtgcagcaagccccgccccatctcactcctctggcagggcaagtctgctctgtgattgactctgatctttctggggagtttcctctcaggtgaagggggaccatgacttatccctcaatgggattaataactgcaacaataattagagaataatttcctcacaagcattccaaaccttcagctgcctgccacacccacaactcctcagctccccaagcacrcaagagactacgtggggagcagaattaccggcaccactcactgcacaaatggaaatgttcttaagcaaagtgcrtgccaatcaaatatttataaatcaagccacatcctaaaggcgctagcagagttcactggtcaaaacaatcctaccttgcagccctttctaaagggcagattcctcttcatgaaatgcctcctgccctgttgctttaggggagtccagacttctattttctggttgggatcactcagcacctagcagttaaggcactttattccccaccaacatagacccgaagycaaaacagtttttcaaatgaccacgatggggagagctggaccccrctgccagaagtcagagagaagggraggtctccaggcaggaatgtactccgcgacagggttctctcacctcggtcatatgtgatgggaaggactccttgccctcctccccacaaccctcatctgattacatagaggatttttatacataaactttaaaatacacacacacacacacataatatatcacatatactatatatatatgatatatatgtgtatatatactatatatatatgatatatatgtgtgtgtrtatatatatatgtcattcagtctctggactgtatcaaaattttccagacaactttttcagaccttaaagaagcagacaccttttaagataaggttttttttttcatatatatttacatatakgtgtgtgtgtgwatatatatatatatatatatatatatatatatatatagatgtgtatatatattwatatatatgtatatgcatatatatatattttttaccactggaattattttcccccaaattcgatttttccccttctctgtctttctctaatgttttaccaatcccggcttgtggctacattttaattataaatgtcactgacataaaacaaccgcaccaatttctgaatgaggctgacctcactttgggtaaacacggcaaaggacgggaagtctccaacccagaataaaccaggcacataatctctcttggcctctctttggagagcagaggcggaaagcaggcttagaggccacagacagacatgctacagaagcagaacctctctctccaggcattttcctcattgaatgcaccagttgtggtcttatcgttacatttgcctgggatgggacaggaagatgctaggatagcttggggctcagaaacagggtgcaagacctcaaagttgacttctcttggcactggcaggatcataaccctttttccttttttctacctttggaaagtaagggattgctattcttactgtgaacaaactactgctaagacctaatggaaggctttggggagcagaggagaaaaccaaagctacaaacttagttcctcagacaaaaggtgtgaacagtgagttgcgggctagcacagccatgcaaaagctctgggctcccctttatgtaggtttcccaggtatgcagggactcgtgaagcagtttaaataatgagcatgggacaaggaagaccatgacccacaaaggtgagtttgcacatttcagtttcattgacatgtagttctgacaaataggctgttttcaaaccaacacttcttaactcattcttagtaaaggagcaggactctggattctattgcgggcacatacagtcacaaatccaccaagtaaacacttccagccctcttcccgtacatttttacaatgcttwatctgagtttgaatttctccaagaaatttctatcgttagagtacctttttaaaagttgctttccatttcttcagctaaattaattgttaatgtccccatttcagaaggggaaaatgaagtaccctacagaccatggacgtatcttgtttttcaaaaagtacttgccccttcatccctgggatacttgagagacactgaccttcctgttcatagatagcaactcctagatcccygtatgggataaagaagagtgcttgctcytcatttgctctgtgcgctaacctggtcggggggtattgaaaaagggagtggacagagaagttagagctttagaggtgcctcatccacccgtcctgcctccccatttctcctgggtccctgtctgcccccaagaagacccaccttttataagtgcctatgctctggtctagatgcaacatggactcaaacctaagctgggtcataaaacatctcaggggtcacgaggaacaaaaagtgggagtcttggccagctctaagtgtcccattgactatgaayggagctttaacacatcagctaccatcctaaaatgtatgaaggagaatcaggggagatcatagcaaatccctgatgaaaattttgtaaaatacacaaaacaatatgcatagttcatgcatacrtagtaaaatagaaaactatgcactagatatagactaaacaccagcaaacactaggaatcctatcactcagagtcctccagtgtcaccagctggctgttcttacctcagaactgtttataaagaaatagagttaggatgaaggaaacatttcctcaattcctctcccagtcttagttcctcttatccttcccaaagcagctacttgtatgaatctggtcagtatctggtgcacagttttatattttactatagatgtattcatgagctacacacgtattgtgttctttttcttttcttttcttgagatggaatctcgctctgccgccaggctggagtgcagtggcacgatctcggctcactgcaacctccttctcccrggttcaagcaattctctcgcctcagcctcccgagtagctgggattacaggcgcccaccaacacatctggctaatttttttttttttgtatttttagtagagacggggtttcaccctgttggccaggctggtcttgatcttctgacctcgtgatctacctgcctcggcctcctgaatgcattgtgttttttaatatgattttcatcaaggatttactatattctcccattgcaatttagtttttttcactgtatgttatattctacctttctttgaaaggggattaaaaaaaaaaactacatacacacacacacacacacacacacacacacagagagagaaagaatgttgcagattttgtgcttttgtttgcttttagctcaaaaacaattgcagcttttgttattgtgttgctgtatcactcccaggttcatttgtctgtatccctaatcatgcagaagccccaagtgcagggaccatggctggcrctgagcgtaagtcccagcacctagtagatgaatatgtgttgactgaatggttttctgtcccccaaccctgagctgctacccgaggaaaaagctgctgctgtgtggccagcccctccctctcttyccaaggccccactttctcatgctctctccttccttgcctgtcctcagcagcagctgcaagaggatgtaggtctggaaaactggaatgaagtcacactagagagctggacaccaagccagctacacragccgctcagcctgggtgttgctccttcctgccagccctacttgcagaaggatatatgtttaggaaacttagccagaaagaaatctagtgaaaatgagctatgaaacttggacatcctggagaaataatatttacagaggaaacttttgagacgaactctcaccggcacaacaaacctggtgtcgggactcatggctgagggctgaagtcatgtgctaagcaggcctctggctcttgtttacctctatgaggcctcttcatggccatgatggaactccacagatggcaaagccaaccctattcagccccatggccagacaagtgggtgctattgaaggcagcaaaacagaaatgcataggaaatgaaaagctttttaaaaatcttctttgattggctgggcacggtggctcatgcctgtaatcccggcattttgggaggccgaggggggtggatcgcctgaagtcaggagtttaagaccatcctggccaacatgatgaaaccctgtctctactaaaaatacaaaaaaaaaaaaaaaaaaactagccaggcrtgatggtgcgtgcctgtaatcccagctacctgggaagctgagacaggagaatcgcttgaactgggaggtggaggttgcagtgagctgagatcacaccacagcactccagcctgggcaacagagtgagactccatctcaaaagaaagaaaaaagaaacaaacaaacaaaaaaaacttccttgattacctaaaaagacctcccctttggggtttctgtcgcacctataatgtgtttgactaaatatctacatatatgggcgataggttgaaaagagtcccaggcaactaacctcactccattccatrgctacaratgggatcctggatggccacccaccatcttgtccatgtgtgatcttgaacacaagagggtccaagcaggagagtatcgctggatttggatcaatccattcccataattggagcccaagagattgtgtgaaagacaggaaaaagtaggatacttggagtactcgacctggggtctggtcatgatttttccccttcttagaagtataacrttgcrtaaaacacactctcaccaaacttcagctcttcaccaaaggacagagcaagcaccaccttcctccagggaacacttcgaggagaaaaggccacaaaagcacagaggaaacagtcatacgagtactggccactttccatgcattagcccttacaacaactcccactatagataaggaaacagaggcaaatactttgcccgatgatcacacagctaataggcagccaagcagaacttgagttcatgcagttgtgttctggagcccacactctttaattttatactgtttatatcaagatagaaactagcatggtgcctggcacattgtaggtgatcaataaaagttagccccttcctttgatctctcttaaacatataggattatgctgagaaattgacacaaaagtatatgygaaggttctctgaaaaccataaagtctgataaccatttaaaaaaaaaccagctttattgagataacacacataccatacaattcacctatttaagttgtacaatgcaatggattttcttacaacttaacagagttgtgcaaccaacaccacaatccattttagaatattttccaaaagaagccccakgccttttaaccataattcccccatctccacccaccctggccctggataccctgaatctacttgctgtctttatggatttgcctattctggacatttcatttaaatggaaacataaaacacatggtcctttgtgatgctttcttcccactcagcactgtttccagactcatctgtgttgtggcatgcctcagaactctgttcctttttattgccaaagaatattctattggcattccatgtatctacttgctccatagactgttagactgagaaataactttatggagactgagcgcaaatacccctcattttactgaaaaagagactgtgtctaagaggctatgcagcctagccaagatcactcagctcagagcccagccttgagccttacaactctccacgtggtcccatcttactgcccccctcagagagttattggagacataattcaaagtgcacagcttattgataatgggccaggagaatcatctctgccaatattagcccaacaccattcattcaccaaataatgtagactgccccctgtgtgcagggcactgtaggaggtgctgaggaccccagagggaacaggacaagatctctgcccttcctctcagagtgtacactttcctgaggaggcagaaatagatcagtagctccctagataataaaatcattgcatgttgtactaagtgccatgaaagaaacaaggggcagaggaggargaggatgtgggggagggtggtattggcagggagaatggggtggggatgaaaggacccygtgcgcagagtgtcacacactctggggagggcctcttttaggatatttaggctgaggcctggaggagaaggaccttgtgaatatctggaggaagaatgtcccagagagaaggctatagcatgtgcaaagatcccaggaaaacagggaaagtttgaagtttaataggagcagaaagagcgagcaagtggtgtgactgaaggctcgagagagcagggcccagcttacagtggaggcccataggcctgttccctcacggctacactctcagagctaaccattcctaggaggacccgtgagaaagtgcatcagtggcttccagttccttcctgtgaattaaataaactccagttgccactggaagctagaggaagtcctgagtctctatagcaaagacttccaaggaagggagaattgcatcttaggtaaaggtgatgaaactatgaatcatcctgggggtgaatcaggagataaggaaggcaaagagaaataagaaaatacaggcatattaacagagaaatggttaaacaattatggtatagctacataatggaacacaattcaatcagcaagaagaaagaagtttactctttccatcctgatgtagaaagatctacaattagttgttaagcaaaaaaaaaagcaaggtgcagaactgtgtgctcagtacattaccattagtatgagatagtatgtcttttgcaatatacgcacacaagctctctagaaaggatacacacacaaggtgtctaggaggggtttccttgtttctgcatccccccaggagatgtgcactccagaacgaagcttttcactatctcctctgctgtttgggaaaatggaagtatatttcctattcaaagaaattaaattaaaaatgaaaacaggccaggcgcagtggctcacacctgtaatcccagcactttgggaggctgaggcaggcagagcatraggtcaggaattcgagaccagcctggccaacatggtgaaaccccatctctactaaaaataccaaaattagccgggcatggtggtgcatgcctgtaatcccagctactggggaggatgaggcaggagaattgcttgaacccgggaggcagagcttgcagtgagccgagatcgcgccactgcacttcagcctgggcaacagaacaagactccgtctcaaaagaaaaaaaaaaaaagaaaagaacacaaagaaaaggcaatgaggggtygagatctaccaaccaaagctctgtgtgttccagcctctcctgccccttggcctctgccaagatgaacctcagagatgccccctcatcctcctagggaactaactattgggcagccactggttcctggtctagatttcactcctagttgtaatgatggttgtgacggtctagtgaccaaataaattatcccgaagagtctagaattaattccaattcccaaatgtgaattatcaaagcacctttctcaagagggcaccctagggtgaataaacaagttaataattatcaaatggacattggattccaattaagtgtccagcaccttgggagtgtcaatcagtgtgaatgaggagagtgtgactctgtaactcatagtcctttccctccatctccaggtttctcaacctggacgctgctgacttttgggctggaaaattctttgctgttgggggctgccctgtgcattgtaggatgttagcagcatctctggcctctacccactagatgccagtagcacccgccccccctagctgtgacaacagaaactgtcttcagagattgccaaatgtcccctttggagcaaaatcacccccagttgagaaccactgttctcatcactgcatttccaggtaacggcttcattctcccccyatcagaagctggtgatctcccctctgcctctaccccaggtgggttgccatagaggctgagggattgacggaaacttcattgtgagggagttcmccgagtttcatatgtggcaaccagtcctaactccctgggaacctcttctgtctcagggaaaacagcaatctcagattttataaaataacgatctgcggacaggaatctctcccatgactagaaggcccagacaattaaaaggcamccctgtgcaggttgataatgaaagcagaacacatgcaggctggccagatcctactctatggcatcccaagattgcagggatgagggagcccgggggagtgagtgccatttcctcctgtgattattttcctacaagtgacagaaagaaaggagcgaggcaccgtgaaggtgcactcagggtcattttgtaaccaacagggtggacaggtaggtgagccggccgttgtctctccttcctttcccaaggacgtaattyccaatggacagctttctttggaaggcaaagaaaaagggactgtatttctatgttttgattaatctgaggctcatccctgagggctccgtgaaatgaatgagcagaattttccatggccaactrtcctggctgccgggtcctatcggcaaaagcgtagtgtttatttacttttgctcgtgttatttttattccagttcagctgcagctcagtgcggaaagcgtgggggaggtgtatataaagagtaccgagactggccagtacttggccatggacaccgacgggcttttatacggctcagtaagtatgaagctgacatgcttccagacgtggccaaggtttgaggtttccagaaatcttgttacatggagtgaggcaaactataaagcaacaattagtctctgtttgttattttttccagaaggattcccaccctcactctgctttattttaggcacaaacataaaagagtttcttgtagtattctctcaaaactctcaaatgtattatcatataaacacagagkaaagattgattgatgttttggtaactcttcaatcactcattttagaatatctaatcccattccattcattcattcattcattccaaaaatgtttttctttctttttttcactttgagacagggtctggctctgtcgcccaggctggagtgcagtggcacaatcatgactcactgaagcctcgaactcctgggctcaagaaatcctcccccctcagccccctgagtagctgggaccacagatgaataccaccatgcccrgctaatgtttttattttttgtagagacaaggtctcactatgttgctgaggctggtctcaaactcctgggctcgagyggcctcagccttccaaagtgctgggattataggccaccacacacagcccaaaaatgtttcttgagtacctaggtactacgtgctataggtgtgtctcttattgctttttacacaaatggcagagcctgggctttcatagtttatatgtcatgcacaaaactttgaaaatagccccttttattctgaaaggatcacctaaaaggatagaaagcttaataacttaattcaacatttatcaaatgtctcctgtgtctaagtgccatgttaggtactgaaagggtgtgaggatgaatgagctgcaatggagaggcatagtctaattgtttcttcagtagctaaaatcctccatgttccctgccctttccctatcatagctagtgctttatacaggtttgaccatgtatagataggtctttatgggaaaggaatagaaatagaggcaatgtgattttgcccctattggtatctctgtgacaggagttaactggagagacagcttaaaccaaygactgcgggttttgaagttatttctagattttaatgttccctcctctgtatcctaacagttgataaactaaggcttggctgtaattcctagcccaatccacacccctttcctcccttttatgaagatgtcttcaaaaagacagtcagtagggggaattttagtctggagcttcawcttacatcraattgccaagtgacagagggcacagaaaccctctcttgaagttgtcatctcagccaagggtcccaatgtgaacacagcttcgtttcctctcactgcccactagggatcaggagattaaatcatcagcgtaataggtaacctctaaaatgctatgtgctcagtacagatcacctgggacggctttaaggggtttggcagtaggggatttttttaaggtagttcttccaagtggtagtaaaatcaatccatcagtcaatcgyttagtctcagactcatgattgaatctcacgcctctgccactctggcaagtcacttacccactctgagctttgtctaaaatgaggacagtcatggatcataaccgcctcacacagagcgtacrtgggttcagtggtgcaacacacagaaygcgcccatcagagtggctggcacgtcacagaccagtggtggctgtaagacargtcatcagcttagaagcccctcaccctcactgtgtcttaggttatgccacagttttatggcttttcccyctttaaataaattttgacgtttattgtaacctgctttcacttatataaaaatattgagggagaactcccagaatctaatttccgataggctccaggcacccccttctcccaccatagccgtggccatcactacaattcacctgaaatatgatcttagtatattacgcctaagaatgtttgcattttccccattgataaagagaagttctaagatatctcaaagctctgcttcatgctcttcayaaaatttaggcactaatccatcctgattcaaacttgtgtgtgtggaaaggatatrtatattttttttaagtttgaaaggctatatatcaaaatactgatatagttatctctgggggtggagaatgggtgattttataatatgtgaataacttcctgtattttccaattttttttttacagtaagtatatgtcacctatgtaatttagggtgggaggggaaacatgccaaatataaaaaagaagacaatttaaacaatagacatgaatcaatagttaagccacatgtcttcagcattgtaccaagtgcataatgagtgctaacaaatcctggtggagggacggagcaccgctgatctggcctgctgactcagcctgtgactcagcyattttgtgtgtgtcaactcctccagtataatagagacatcaggtggggaatgtggccatcctcaccttcgtcacagaacacaggcctgatgcccactatgaggtgtcaggcatgagtcctccctacaagggagtgggcaacccacataggtccaagctgtctacctccttctacccccaacaacatgcatcaaacacgaatgtctgcaccaagttcctctagaggcagcagagtcatccaataaaatattatatttatatctcatcttgttccaatatgatctaaagtgtctcaccctgttgtcatttcactagattatgaatgaataagaagcaggatacttcctgttacacagttccttactaagaaaggctgactttactgactgctttatattatctcaagaatcaaattaaatgcattacttagctggtgagcacctattatttgcaaggctctgtgtctgggggatggagagaagaccaacaagattccatctccttcctcactagggtttataatctaaagaaacaaacatgctcacacatagagaacaatgaacaatrtaattggaaaccgccagacagggaatcaccaaccactgtgggtgaagagagactgcaggggtcacacgacttgaaaaaggcaaagcaaagtcagatgtctcagttccagcataagtgttttaatatacctgttttagacccaaatgtaataaatatattctaagatcttgacgaatagaaagttcaaaaactgagttccccttccaccaacagattgactacaagtaagcaaaatagtggttgctggatttttttcaagtaactgcactctttaatacgttgtggctgattttcaacttaataaatgtacagctgcactgggttctactgtacggatattcttttayccacttaaccaatcacctytccatggacatataggttactcctaatcgcttgcccctataaccattggttcagagaccatcctcaaaaatacagttgtacacttactcaaccatctcctaggggtagattcctagaagtgaaattgctgagtcaaaggtaatacatcttgtaaattttgatacatattgctaaattgtcttcagaaagtttccactaatttttctcgccaactgtgcatggcagtgcctagttcccacattctaagtcttgcaaatggttttttatctttgcacaaatttttttttatctttgcacataggatarctaacatatgataaataatttttaatttgcatttttctcgttagcagtattgaatgttttcataggtttgttgttcatttttaaaacatcaaataaaacatgacattttgatgatatcataagtctatatccatatagccttatctagtctgtatgtacataaagagatgtaaggcaggatgtttatcagtgattaacagttgcctatatctgggtggtgggttttgggatagttttttctttttacaaagtaaaggtatatttttaaaagtacaattcttcttataagtagcatttttattactctttagagacaggttcttgctctgtcacccagactagagtgcagtggtacaatcatagctcactacagcctcaaactcctggggtcgagcaatcctcctacctcagcctcctaagtagctaggaggacaggcacacaccatggcacctagctaattaaaaaaaaaaaattgtagagaatgggtcttgctatgttgcccagactggcctcaaattcctgggctcaagcaatcctcctgcctcagcctcccaaagtgttgtaattacaggcacacaccatggcacctagctaattaaaaaaaaaaaaattgtagagaatgggtcttgctatgttgcccagactggcctcaaattcctgggctcaagcaatcctcctgcctcagcctcccaaagtgttgtgattacaggcacacaccatggcacctagctaattaaaaaaaaaattgtagagaatgggtcttgctatgttgcccagactggcctcaaactcctgggctcaagcaatcctcctgcctcagcctcccaaagtgttgtgattacaggcatgagccactgtgcctgaccacaagtagcatctatttataagattctttttataagtagcaaaaaatamagctattttcattttaaaaaatctacattctaggatatgtttcatgyttaggataaattttgcacaagcatatcttcataacaatactcaggtaaaatcctgacgttagtgaaaatcaccaggataaaaggcattttagcagctttttgtttattctttaagtctagccttcaagttaaaacaacagcaacaacaacaacccactacatcacagtctggtttttacctatttggaatgtttttccatggtcaggcctgtgtgccaggccactacagagatgaaagatccagccctgccctcaaggtacttacagtcgagcagaatgtccccagtgggagattctagagtcctgaggactcttagaagtgctcttatcagtagcatcttaattactttacaatggattttaaatggaaaggaagtttacaataatagcaaatgcatattgacagctctttagtgcccggtgctgttctaagtccttatgactaccctgtgaaataagttccaccatgaccccaattttcctgaaaaggagactgaggcatggagagctttagtattttgcccaatgtcacacagctagtaaatggggacccccatgtgaaactactcactgattgtcctactctcttktggttttatctttttagcagacaccaaatgaggaatgtttgttcctggaaaggctggaggagaaccattacaacacctatatatccaagaagcatgcagagaagaattggtttgttggcctcaagaagaatgggagctgcaaacgcggtcctcggactcactatggccagaaagcaatcttgtttctccccctgccagtctcttctgattaaagagatctgttctgggtgttgaccactccagagaagtttcgaggggtcctcacctggttgacccaaaaatgttcccttgaccattggctgcgctaacccccagcccacagagcctgaatttgtaagcaacttgcttctaaatgcccagttcacttctttgcagagccttttacccctgcacagtttagaacagagggaccaaattgcttctaggagtcaactggctggccagtctgggtctgggtttggatctccaattgcctcttgcaggctgagtccctcmatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagaataaatccttgggagtcattaccacgccttgaccttcccaaggttactcagcagcagagagccctgggtgacttcaggtggagagcactagaagtggtttcctgataacaagcaaggatatcagagctgggaaattcatgtgsatctggggactgagtgtgggagtgcagagaaagaaagggaaactggctgaggggataccataaaaagaggatgatttcagaaggagaaggaaaaagaaagtaatgccacacattgtgcttggcccctggtaagcagaggctttggggtcctagcccagtgcttctccaacactgaagtgcttgcagatcatctggggacctggtttgaatggagattctgattcagtgggttgggggcagagtttctgcagttccatcaggtcccccccaggtgcaggtgctgacaataytgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaatagttatgcctgtactaaggagcatgattttaagakgctttggcccaatgcctataaaatgcccatttcgaagatatacaaaaacatacttcaaaaatgttaaacccttaccaacagcttttcccaggagaccrtttgtattaccattacttgtataaatacacttcctgcttaaacttgacccaggtggctagcaaattagaaacaccattcatctctaacatatgatactgatgccatgtaaaggcctttaataagtcattgaaatttactgtgagactgtatsttttaattgcatttaaaaatatatagcttgaaagcagttaaactgattagtattcaggcactgagaatgatagtaataggatacaatgtataagctactcacttatctgatacttatttacctataaaatgagatttttgttttccactgtgctattacaaattttcttttgaaagtaggaactcttaagcaatggtaattgtgaataaaaattgatgagagtgttagctcctgtttcatatgaaattgaagtaattgttaactaaaaacaattccttagtaactgaactgtcatatttagaatggaaggaaaatgacagtttgtgaaagttcaaagcaatagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttaacgtctctttagtatgaagatttggccagaaaaagatacccagagaggaaatctaagataattataatggtccatactttttattgtatgaatcaaactcaagcataacattggccaaggraaattaaataccattgctaacttgtgaaatggaagtctgtgatttcggagatgcaaagcattgtagtaaaaacaccaatgtgacctcgaccatctcagcccagatatcattcatatatctgttcaatgactattaaggtgcctactgtgtgctaggcactgtactggatactggggaccttgtctgtctggtttgctgctgtatcttctcccagggcattatatttatgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattttcaactttagaaccgggtcagcttcagggggactgctttcaaatcagccaaagagcctgtcagatcttcttagaaggaagaggttggtagttccctgctctgttttgaacatgctctagtttattaacctggggacattcccattgctgtcttaagtaagtctcatagccagctcctgtcacrtgactctcatatggattcattttcgggccagctytgaacaaagcatcatgaacatatgtgcttttggtcgtttgcaatgtgatggtggtggaggtaggtattggtttccttggaaggcatgataagaaagattcacaatggccaacagtgtgtatgaacaaaaaactgattggagcatcagctagtactgaaggtccttgctttgtgtcagaggcaaaggaacccaaggcgccaagtcctcagccttgagtgtactgctgacaactaaactcacaggctgcaaagcagacctctgatgaagatgcctgttatttcacatcactgtctttttgtgtatcatagtctgcaccttacaaatattaataaatgttccaataataggtgataatgtctctgagtttctgagcatcctgctgcctcatctttctatcaaaggacctccccagcatccctgaggtgtggctgcttagttttcgatacttaccttgttaccagatgtcagactttaaaggctaacagggaatgcgaaggtagaaacatttttcaatgtgtttggaaacagaaggcagtatgggtgattttctacatttctgttagggtaatatacatatacaggaaattcgcctcctgaggagccaggcaccataaataactcaggtgaaactttttcttcttaacataaaccatgtaaaattatgctactattgttgaggtgactggctcgtgcttaggcaaagatatgatatggcctgaaaaaaaaaaaacatttaaggacttatttacaattttaagtcaatggcaagagggtggatctcttcatcttaagagccctggtgtggagctatagatttgcttctcagattttctaaattatcattttaagcagtgtttccttaaataaacctctggatcttatgacatcttattcttaggaggaagtacgctgctgcctagtacatcatgcagaatcacacacacaggcacacacacagatgcacacgcatcgtctaaggaaaaaggtggggagagtgtgctcactctgctaattacataccacaatattggtataccacagtcaatcctttcttttccttctaaagttgcctaaagcaatatttttctactttttggatcttgctccaccataagaactaattttccattacaaactggcacatacatactgttatacatacacaccactgaaacaaaaatttcgcaaaactagatgaggggcactttgattcttcagttacattccactaaaacacactagtcaaacagcatttaacttggttgacaacattcatgggtcacaaccgcagtttgaaaaacactgacttaaagcaactgttcttcccaaagatggcgagacccaatgaggatcttgtgttatgactttagtgttttcaaagacgcagtttgttcttgagtaaacaagacaagaggacatcctgttacccaggaaccatctgttttgaaggctctgttaattcttttagcctggtttgctgctaatcatgcaaaatgaatgtaatggaacagattccatgggcgcccactgctgcctccaaggctggtctagcagatttttctgctcttggaagccctggagactttgaccccccctccccctcctttggaattctcatcacgttgggtcttgaagtcattccctccctaactcccacagtcttcacttcattcctctctgttgcctccccaacccctcaccaattcctagttcttaaccatatctaataaaaacataaaaagcagattgaaccaagaaaaggctataacctggggcctctatgcatcttccccagctcccatcactttctggaaatgatcctctctcacctcttatctaccttttaaaaagtgtgccattcctggctcagtcataagctaaacaccattgttcctggtatgcagcttatacagggatctgcattttccatcttggctgaaccaactaaacaaagtaattctatgtcttaaatatttggtggggtgtgggtggctgagaatggacctcctgtcagtgaacttgaccacaaagagaaaaatataaatatagtcttcacttttcatatttatctgagtgatgtcccatttatcatggggtgggaagagaggaggaatctccaatcctaagcacttttgggttgttatattagctagtatggtagtagtagcacatcagacaaaaatgtgctgtcaactacactttcacaaattaacaaaaaatatttttagaagcagtagtgacaatgtggaaatatttaagcccaactgagcagcaagacttgtatgttctccatttcaaaatgactagggatgatttgtttgatgaccgttaaaattgaaataatggctattaaaaagtggcaccccctccttcgaatccactccccaaagctgtcctccaccccccagaaaaaactccttttgccattgtatataaatgtacactaaaatccactcagagaactcagagctttaggcttggggatctgacactagggactccagaccctagtgattgaactaccattctctcaagtaacaagggaaatgtactaaatgactattggaatctttctgcaacattggacccactttgcggttgacatattgaccatgacatactacactgttagctttccaccctagttataaaattaaaaagagaaaccaggtcacacacagcctgaagccagagggtgggtttgctttataaaatgcacatactgtaggaccttgctttggggtcttctgatggttctgagaatgtttgtgatgtgggaaggaggtatttcccaaattgcttccttccttcttagctccccactgtcacgcaggctatatttacacattcagcagctaaacattggtgtctgttttattacataaacaaggaaaacctcacatgtccttgatgtgcttttctatcagccttaatgaaaggttgggcattccctgtttggaactgtgttcaatttaaggatttggttcacttggccaaagtgtttggggatagagatgtaaatagtcaatttgtgcgaattgtcacagagacacacttcactgtgattttcacatttcatgttttcttaggaaataattttttttagtctgacccatagatacataagagtaagatgttggattattttctaacatgccttattctccaaaataagttataggaacgtattatatactaccttgttttgcatggtttagaaaaacaagactgttcagagcctgggaatatcaactgtattaagagtttagcaacttcctgtggaaatgaatagtaaaatctattgcattctcaaaatagaacacctgcagtagggacagtgctattgacccaggaaatggtacaagttttaagactgggcagattgtttctactaatatgggacaaaattgcaaatccaagatggttgtgcagagagagcacacgagagggaaatatgtttctatatccttggtgctactgaaatctgctgtatatttaattgaggtgaaaaagaggtaggtttttggtttttgttgtttttttttttgagacagagtctcactctgtcacccaggctggagtgcagtggtgcaatctcggctcactgcaacctccaccacccaggttcaagtgattctcctgcctcagcctcccgagtagctgggactacaggcacccgccaccacgcccggctaatttttgtatttgtggtagagacggggtttcaccatgttagccaggatggtctcgatctcctgacctcatgatccgcccgccttggcctcccaaactgctgggattacaggtgtgaaccacagtgcccagtcaaaaagaggtaggttttatagattgcttgaaaacgtataagaattgcttgaacccaggaggtggaggttgcagtgagctgagatcatgccactgcactccagcctgggcaacagagcaagacgaaagaaagagagaaaaagagagaaagaaagaaaagggcagggtagggcagggcagggcagggtagggcagggcagggcagggagagagagaagagagaagagggagggggagggagaaagaaatgaaagaaagaaaaaaaagaaaagaaagaaaaaaggaaagaaaggaaggaaggaaaaggaagaaggaaaggaaggaagaaacgaacgagagagagagagagaaaatgtataactctgagaaacttcacttcaaaaaacttcactctgtcacccaggctagagggcaatggcatgatctcggctcactgcaacctccgcctcctgagttcaagtgattctcctgcctcggcctcctgagtagctgggactacaggcgagtatcaccacgcccggctaatttttgtatttttagtcagggatttgccatgttgcccaggctggtctcgaactcctgacctcaagtgatctgcccgcctcagcctcccaaagtgctgggattacaggtgtgagccactatgcccagcccatccattaaccatttattgtctatattagtcagggtccagtcaggagacagaaaccagacaaatcatttgaacaggggggatattttaatggaaagaattgttaactagtaaaagggattaactactaagaagggtaaggagatctctaaagaacattggaatagcaggtgtagagagcaactactatcttcaaagctgaggagagtactcaaggaaggaactcacttgaaagaggacaccctgtgaagatgagattcaggctgcattcgagatgtggccatggcccactggatggtgaagaatttcaccgaggtgcttcattcccactagaatgctggtgaaactctctggaagcaacttgctggggtgccagtaaaactcaccaaaaggtgtgcaccataggagcaagaagaaacacaggagcaagaagaaaagcacaagaaccccaaagaaatgccccttcttctgatagtgtctccccagcgccctctactgacaaacattacttcatatcagctcgtatagaaatgttttcagggttccgcttcactgtagcaaaacgatgcaaagagtagatttggagcagaaaagcaataaactggtaactgtcataaacatgatttagatactctgctagatacagagtattcaaagatgaaaaaaggtggtcctttctctgaaaaagcttatagtggtggagaaagtgctaatctttttggctttatttcctttaaaaaaaatgctatctttctaagccttctgagattctcagaagaacactaggtatgttcaaggtactatctttacatattgttaagtcattccctaatttaaattaacacaaatcaacgtgagatacagatacagaagaagatagctttgaagtcagacagccagagttggaatcttgactcctccacttactgactttgtaactttgggcaaattacttaatctgtctgtgcctccatttcctcctctgtaaaatgaggatacaaatagtatcaacctcacagagttgttgggaagattgagagggaggcatgcaagtatttttaacaaaatatctagcatataataaggattaaataaacgtgccattatttttataataaatatcctatatattatataataagataggactaaaaataaccttttagagcctccatttaggttccgaatgatcaatttcatgaatccatatttggagagatcttgttccacagcagtgcgtatgaaaaagatgagaatcttaattgactccaagtttaataagacccagatgatgataatttccctattgtagtttcagctggtcagtccacatatggactatggtatctcattctagatgctgcatattaaataaacttttataaattttaaaacaaaattatgtggagaataacggatgactagtaaagggccagaaaaacatatacaaaacaaacaaacaaaaaacaactaaagaaacgagacttgtttagttatgggaagatttaaaagataccatagctctcttcagctagttcaagggtcatatcatatcgtttttcttgctctagtcatcaaaatgagtataggcattctacaaagttccagcctatcccctgtctgcaatctatatggatgatcctcaataaaaccttaaccttctttctaatcacctgtcctaatgttacttgggaggggcactggttaagtcactaggtttttcattcaatcgcttgtccattctttcaacaaatatttcttaagacctaaatatgcactcggtctggtgggtgcaagggtgcacagtaaacctctttcctggagcttacactctcataaagggagacagatattgatgaacacctcatttttc

SEQ ID NO: 17760 - DNA, 33042 bp, Homo sapiens
tggtactgtcttcatgatagtgaatgagttctcacaagatctggctgtttaaaagtgactgtcacctccccacatccctctcttgctcctgcttttgctatgtgatatgcctgctcccctttcaccttctgccatgattgtaagcttcctgaggccttaccagaagctgagcagatatcggcaccatgcttcctgtaaagcttgcagaagtgtaagccaattaaacatcttttctttataaattaccaagtctcaggtaattctttataacaatgcaagaatggcctaacaaaatgtctatctagttccaaaatatttttatcagaagaaaactctgtaccctataagcagttagtccccatttcttcctcagcccctgggaacctctaatctactttctgtctctatggatttacctcttctatatgtttcatataaatggaatcagacaacatgtaaccttttgtatctggcttcttttggaacaggaattaaaagaaattaaataatgtgtaagcggaaactcagttgtatgtaacaaaacccaactccccctgagaaagagaaagagctggagccctttaaaaattaactgcctgtttttctgtggctagtgagacttacctctcctcctttcccaggcattgtgaagaccctgtttctctagctgtgcagctgcaaggtcactagacagataaactcaagtcgcaaaacatgtttcttcttgaaaagtaagaaatgatgtaatgcatgtctcaattaattgaataactgtctttatttctcacttctgtagtatgcttccccctgcacagatacccctctctcccaccccacaaaatgcttaaaaggtaacttaactctttgttcagggctcagtcctttggatgttaatctgacttggccagtgcacctaaataataaatatcctcctgaaccccatcggtctctctgatttcttaaaaaatcccgcaatatttccactaccaaaatttgttgacacattggatatgacttgtgaaaaaaaagagaggtgtctcagttaactccaaaagttttggtctgagtaactggaaggatggagttataatccactgagatggaaaggctgtgggaagagccctacagattggaggagaaattcagaagttcagtttgggatatgtaaaatatgagaggcttattgaacaactaaatttgtttggggatggagatgttgagtaggcatttggctacaggagaatggttctggttgtacagaatttagaattcgttcgcatttaaatggtattcaaagtcaagagtgtgaattggaccaccaagttagtgaggttagacacagaagagcaaagcggtgatctctggagtactccaagggtttggaggttggggagatgagggagaatcaacacatgatacagaagaaatagccagtgaagtaggaggaaaaccaggagctccctggtgaagtaagatgaggatggagaataggctgtttgtgttagtgaagtgtaggaccttggtgagagcagtctcagggaattggtgtggctgaaagcctgattggacaagcttcaagacagaattacagcctgagcaacatagtgagatcctgtctctacaaaaataaaaaataaaaaaattagtcgagggttggggcatgtgcctgtagtcttagctacatgggaggctgagggagaaggggcactagaccctaggattccttgagtgcaatgagctatgatcgcaccactgcactctagcctgagtgacagagcagcattcccatctcttagagaaagagagagagagattgagagaattagaggagaggacttagaaaaaagtaagtctagatacttctttcagggtatagtgggagcactggcactttcacaagtctccctggctccacgtttttccccattttaccatgtcttccaagttcctgccataagttcagcttaatgatcaagagcatggatttggaactgattggcctctgttcaaattcccaaccatgtctcttactagttatgtgactaaggcaactttctttttttaaactttttttaaattatactttaatttctgggatacatgagcagaacgtgcaggtttgttacataggtatacatgtgccatggtggtttgctgcattcatcaacctgtcatctacattaggtatttctcctaatgctgttcctcccctagccccacatcccctgacatgccccagtgtgtgatgttcccctccctgtgtccatgtgttctcattgttcaactcccacttatgagtgagaatgggtaatgtttggttttctgttccagtgttagtttgctgagaatgacggtttccagcttcatccatgtccctgcaaaggacatgaactcatccttttttatggctgtatagtattccatgatgtatatgtgccacatcatctttatccagtttatcattggtgggcatttgggttggttccaactctttgctgttgtgaatagtgcctcaataaacataagtgtgcatgtgtctttatcgtagaatgatttataatcctttgggtatatacccagtaatgggattgctgggtcaaatggtttttctagttatagatccttgagaaatcgccacattgtcttccacaatgattgaactaatttacacttccaccaacactgtaaaaagcattcttatttctccacatcctctccagcatctgttgtttcctgactttttaataatcgccattctaactggcatgagatggcatctcattgtggttttgatttgcatttctctaatgaccagtgatgatgagctttttttcatatgtttgttgactgcataaacttcttcttttgagaagcatctgttcatatccttcactcactttttgatggtgttgtttgttttttcttgtaaatttgtttaagtttcttgtagattttggatattagccctttgtcaggtgaatagattgcaaaaattttctcccattctgtaggtttcctgttcactttgatgatagtttttttttttctactgtgcagaagctctttagtttaattagatcccatttgtcaattttggcttttgttgctgttgcttttggtgttttagtcatgaagtctttgcccatacctacgtcctgaatggtattgcctaggttttctcctagaatttttatggttttaggtcttccatttaagtctttaatccatcttgagttaatttttatataaggtgtaaggaagggatccagtttcagttttctgcatatggctagccagttttcccaacatcatttattaaatggggaatcctttcccaattgcttctttttgtcagctttgtcaaagatcagatggttgtagatgtgtggtgttatttctgatgcctctgttctgttccgttggtccatatatctgtttttgtaccagcaccatgctgttttggttactatagccttgtagtatagtttgaagtcaggtagcatgatgcctccagctttgttctttttgcttaggattgtcttggctatacaagctcttttttggttccatatgaaatttaaagtagtttttttctaattctgtgaaaaaagtcagtagtagcttgatggggatagcactgaatctataaattaccttgggcagtatggtcattttcatgatattgattcttcctacccatgagcatggaatgtttttccattcatttgtgtcctctcttatttccttgagcagtggtttgtagttctccttgaataggtccttcacattccttgtaagttggattcctaggtattttattctctttgtagcaatcgtgaatgggagttcactcatgatttggctctctgtttgtctattattgctgtataggaattcttgtgattttttcacattgattttgtaacctgagactttgctgaagttgctgatcagtttaaggagattttgggctgagacaatgggattttctaaatatacaatcatgtcatctgcaaacagacacaatttgacttcctctcttctatttgaatacactttatttctttctcttgcctgattgccctggccagaacttccaatactatgttgaacaggagtggtgagagaggcatacttgtcttgtgccagtttttaaagggaacgctttcagtttttgcccattcagtatgctattggctgtgggtttgtcataaatagctcttattattttgagatacgttccatcaatacctagtttattgagagtttttagcatgaaggggtgttgaattttatccaaggccttttctgcatctattgagataatcacgtggtttttgtgattggttctgtttacgtaatggattctgtttattgatttgtgtatgttgaaccagccttgcattccagggatgaagccaacttgattgtggttgataagctttttgatgtgctgctggattcagtttgccgtattttattgagtattttcgcaatgatgttcatcagggatattggcctgaaattttctttttttgttgtgtctctgccaggttttagtatcaggatgatgctggcctcataaaatgagtgagggaggagttcctctttttctattctctggaatagtttcagaaggaatggtaccagcacctctttgtacctctggtagaatttggctgtgaatccatctggtcctgggctttttttagttggtaggctattaattgctgccttaatttcagaacttgttattagtctattcagggatttgacttcttcctggtttagtcttgggagggtgtatgtgtccaggaatttatccatttcttctagattttctagtttatttgtgtaaagatgtttatagtaatctctgatggtagtttgtatttctacgggatcagtggtaatatcccctttaccattttttattgtgtctattgattcttctttcttattagtctagctagtggtccatctattttgttaatcttttcaaaatgcagctcctggatttattgattttttgaaggctttttcgtgtctctacctcctatggttctgctctgatcttagttatttcttgtctttcgctagtttttgaatttgtttcttaacctctttgagactctttagaatggggataataatcatatctatagcagagagctgttataaagattaaacaatataataaatatggggcgctgagcttcagagtttttgttgttgttattattattttcctaaaaatgcaaatctgatttgcatttgactcattgactcacatcagtgggtcttcctttttattgtccttcatcatatgggtcctaatttcacatgcagtcttataaaaccatctcattttatagtccaagaatattaaaggtacttgtaggctcccaaacctacacggtgaaaagctagagagcatgggctctcttcaggggttaacttcaggaagtgccactaacaaggacgtccactaggtggtgagcaaggaaagacggaggtgaaggaaccgaaacgagtcaagtccactgcttagctctactgaagttttgcaaacatcataaatatgtctgaaatgcagttttgatttgtagtatttgcaatttccaagggccatttaccacaggtagccaagagttagtttagcatttatgaaaaagataggggagggtggtggaaaagaaggaggaggaggagagagagaaggaggaagaggagaacaagaaccaaacaaaaacaagaacaagaacaagtagaagaagaggagcaggaggaaaaagaagaggaagaagaacagcaacaacaatgagtgaaggaggaggagggtaaggaaagatgcataggagaatggaaggaaggatagaaaggagggaaggaagagagaatctagtcacattactttctgatcagcagttcatttttgtctcagtgggaggcaatagaggccagtctaggaaaggggtggggaaagaggaaagagaagtgcaggaggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatggtgagcctttcagcctaaaagacgtttagatgctcagatagaaactcttggggttgtagaggcaggtggcaaggataggaatcaccccatttcaattctggttttaaataatatagaaactaaacattttctcagaccctcaaaaaaagtgatcctgaaatctttcttctcagatatgctgatttcctcttcttgactttgtctctggggagactcttgaagaaatactattgaaatcagatcttttgcaataaacactgtgtctacctgagaagtgatatgctttggaagatagaatttttttaaaattatactttaagttctagggtacatgtgcacaacatacaggtttgtcacacatgtatacatgtgccatgttggtgtgctgcacccattmactcgtcatttacattaagtatattttaaggtgtgcaggaaatttgtgactttgtcatttcagttgctcaaaaaggtatttctttttattaaaaaaagaaatacttttctttcctggtgtctggctatctaattttttttttttttaggtatttgaggcattgacycattatgatcaagagtgaggctataacattaaatataagcatcaatagttaattaagcagcaacaatactttaaaaaatatacatagtaaatattaaatagttttatctaatagctcagcagaaaagcaggtataaaaattaccaaaccatagaaaaaattcagggcagtaccgattagcaacttgagactaaagcgtaaaaataaaatagaacaaaacaaaactgtgcatcagttctgatgtaaatttgaagtaatttttcatctatgtctgagaaacctgttacctcagacagggttagyagacatatgtgttttattctgattattaagaaagttgtaagcaccacctcaaaggctataaatgtgtggtttaagagtatacatctaaatataattttgtatttcatttgcagatatttccatggaaatgtcagagcacccagagggacttatggaacatcttcaagttgtgggggtggacaatgctctgttgtggtatgttatgatatttatatatcgctaagtctattttacttatattcatttttcttaaatatccactagttatacatagtctaagggaaaattatttcacagagctgttaattctatcccttctgtaaacatctcttttcttcttacctttagttcttccccagaaactcctgaacactatttttaacctataatagcccatgctgtagagttcaaatcccaataaccccacaaaatccctcaattataaaggaataatgttaattaagaaatctctgttaaggtacttacaatctgtaccaaatatttagcacctcattttctattttttattcatagttcagtgtacattaatgtcatttctacaattacaatacgagcttattaagggacggggstttatcattttttggtccttctcccattgttgtgacaaattttatatctgattcttgaagactctccagcaatagctttgaacttggtttttcatttcctaagtaaactaatgtcttctttctccctagcctggattttcagctctagccaagcaaacatgctaactctcccgttcacacattccttatgccatgtctgcactgtgtcacatagaaacttagtgctcttttcatacaacaggtattttctgagtccctacaatgtgtgaaatttatgctaggcactaaggatacagcagtggacacaacagttttttccctcttagaacttgcattctagtggaatgctcattcaaaactctgttcaaaatgtttattttatgatgctctttaccatcaattatatctgtttctttactgtattaaatagtgattcatgtagatcataccatgcttagaatgccatatattattatgaagtcattgtgtaattatgtgtttaattagatatcttcaaagccctcatatttgatgggtccatatgtttattaaacatcatcagttgagtctctttgtgtatagaacatgatctaatgaatttcataatcctataccatttggctttgtaaattgttctttttaaaaattatacagttagatatataagagttgagtggtatattgggcttttccagaagcagttcttcctatggtaaaataaaatgttttttatgtaaaagaggttacttaaaagtatgtcactgttcttcctgtccttattatgcttctcccataggtacatatgtgttggccttcaagaaatgattccaggattaaaaagtatacgtaaattgtatagttatatgatattacackgtaattagttgtaaatcattaacagctacaaagaaaaagaaatatgaatgtctaaaatatgttggttaaatttcacctgaaataattttgagaaaaaaattaataagaaaataaacctagaaaaccactaaatttgtttcaaatagaaccttagataaaagcatcttatattcaagccagaaggtctaggttctacttcaaatctgcaaacaactattctgtgatcctgagatggtcacatacactcttaggctctgtttcctcatctctaagtgtctrgctcagcctggagtagtgctaggttctttttagctgtaacattatgtaagtctgcataggtcacactgatgtcttgcagatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctctyactgaagaagcagagaactggggagatggygagcccaacaacaagaagaacaaggaggactgcgtggagatctatatcaagagaaacaaagatgcaggcaaatggaacgatgacgcctgccacaaactaaaggcagccctctgttacacaggtagggagtgasaagacggctatgctgcctcagactcaggaagggccacgsttaagagaatactcagatttaccccatggaaaggtggggggatgagaacagcttctggttcattctaaaatacatctagccctctatataatcttgcatcgtgtcactcctaagaatttttggtgtgtaagatttgtccctgtgcacaaaagctatacccctaaatcaagttacatcaaaatgatagatctacgtaggaagtacagaggaagarctagacaatcagtgcctttgataataaggcaggggaggagaagctgacagctggggccagttggaaacttaggctcacatcacctcagttttcacattgtgaagtagagagtgtggtgctgcgtgcttccttcttggtctaaccttatataattttatataaaaattgcactrtctttggtgtatgaatatttctgtaaaatcttctacaattccaaaacagccagcattttccaagtgatgttttaataatgaaccatagttaatttggtctcttataaattggactctacygttttagcaaatttggactttttaatctttgatttctataaagaaagggattgccaagaaataattgcatgcagaaatgattgaggtcaggtcatcatttaaccttctcactcattaaaaacaagtaatttcaagagtttcaaggtatgccactaagyttcctatargtgttacagaatattagtattggtaatttcattccaaaagcaaataaatgcctatgactatatgcttagtgtattttatacgtaaaaattttagcatatgatttttatgctatgaatttacaaataaacctttcctgattatttaaatcatctcagacaaaaggttatctatgtctaaagaaatgactttgagtactaaaatgtaatcacattaaaatattttttttctgacctccttaaagcttcttgccagccctggtcatgcagtggccatggagaatgtgtagaaatcatcaataattacacctgcaactgtgatgtggggtactatgggccccagtgtcagyttggtaagtctctttcctttctttgcttcttcttaggtaaagtcacaggaatcattatagcttatcatgaagctggttggaacaaaatgatactagccactctgagaaatgggaagttttgatcagaaagctctgctttcacaatattgttacctttccgtaaagatttcataagtcagcatgaagtttcgaytcacttctcaacaagtctttttgagtaccacaagaagcacagtgttgggataaaagctgtcagggttacmataaggaattagcatggtagattcccgctctcaagaagctcacgatctaatgagcttgttagattaattagaactctaaggtctggaagaaactatgccatttatcattaggaggctgagttacccagaaagtatcttgctttttccttctagtagttcctttccttcttgcagttctccacacttaacacatgtgctctgtagcacactgactttgctggtggccttctctctcattttgcacatggccaaaaaacatgtcatctttaagacattgttcaaagacagtttcttctaggaagctttcttagttctgatagctccacatatttcttcctcatttctcccacttatgttgaagtcatctgttcacttgtccgtctcctctggtactgaaaacttcttgagatcagtaagtgtcctatttatcattgcatctttgggatccacaaaatgcctgtatatatgaggcacttgcttgtgagcctgaattgaattggacaatttaattttttwaaaaagcaatgtttgtaaacaataaagaattaaaaccaaaatacatttaaatgtcaaccaactgaaatagatctatagatctaactcatttcacttgatccctgggccatgactccttcctaatactttaccctcaccccatttttgaactctattttttaacccttatgttattggtatgcctattttactcatttttaattattggtatgcctatttcactcatttttaacattttacttttctttgtcttggtttctctcatatcactcttttctcattctttctacctgtgatcatttctcctgagatccttcatgagcacttatccaggaccataaactactataatttctcagcttttgtcttttgtatattgctcttctgactctaatctacatgtatcctttggtcaaacttactgacttttgcggactcacaaatctatgtgatctttggactgataagcctatctccagctctgaactcaaatatgctaaggatgtcctttgggatgtttaaaagactataaaaccaattgttcccagtcagcttttctcttcgtatttcttatctcagtatgtggaatcaccatttacatgggcaccctggtatgagactctcttaactcccccaacatttatgcagggtaacattctaccaatttttacaacttagtgtttttctaatttgtcttccacttgtcaactctactaccattgccgtcattatctttcttctagattcttgcaatagtttattagatgagttccacaattttaaattagctcccctcaaatacattattcatactacagggagactgatcaattaaaagcaattaaaacacatcacacatacatgacaatccacccattaatttctacctaccattttgtcctacagggtgaaatctaagctcttcaagccccagagtaatgcttgatatataatagatactctttaaatcaatgaaaaaagataacattttctcttagttcccatgtytctccctaatctcatctcatatagtttccaaatacaaaaattcttctgattccttgagtccattcttccttgaagtctctagagcaaggtagcaataatggcttaaatytgacagatgaggaataagacatgaaagttgtactgtttactaaatggcatggcagggtctaaaatgtgaaaactttgatttccaagtcttaaatttacctattgtaccaccaatcagaacagggaaatagatacagtttctggagagggttgtcaaaatcaaaagagttaaaattctggaactgagctagaatagaagacagaattgaggtcaaaatgcttcctagacttttatattctctccttgcaaagaaggcttattatggagacccactctttctctgaacatcttgctcccaatactctagtagactcaggggctctgatgtgatagttatttcccgactaagctggtcattcccagttacacctatttggctttaaggattctcactacagataatgctgaagataataatatgaagactagctaatgtttacttagaatttctgatgagtcaggctttgttctaasgtccttgacttatgctaattgaattacatttagtttccatatcaatttgataaagataacacaatttcattattcctcttatatagatgaagaaactgaagttggagggttcaagtaaccttgtttaaaggcacatggttatcaagtggcagggctaggattcaaatccaggcgtcagttcctcttaactcttccccatactgtttctttccctattgaagtgattcagtgtgagcctttggaggccccagagctgggtaccatggactgtactcacyctttgggaaacttcagcttcagctcacagtgtgccttcagctgctctgaaggaacaaacttaactgggattgaagaaaccacctgtggaccatttggaaactggtcatctccagaaccaacctgtcaaggtgagtaacttcagactagaggttttgtcatgcaatcctgggcttacagtcagaacattcagtagaagtttgctgagaagtcaaacttaggagcctaatttaacctaactttgtttaacctactgtgatgtttctcaaaggacttattctaactaaatttttttgaaaaacctcccaaacaaaaagtaaaaaccaaatacccctgaagccatctcccagtgtgtaacatgacttatagcaatacagcatggttatactgtgttttttatttttctcattgccattgcataaataatgtcttgttgaacctcagttacattttggttcttctcctctcaataacacctgttttatgtggtgtcctacttaataccaaccagtttccttcccagggtagtggaggtctttcttggttgttttatttggcttattcttaaaatcacttttacttttcctcatgcataaacttttaggagaataacaactgaaaaacaaaaacacaatctcttgatcttttcaagtttgaaataaggtaggtttttttttttttttcatttttaactgccaaccttatctccatatgggagaaaaccaatgtcatctgaacttacgaagttttggttaacttttctacaagtatgctcctgatgcattagtttaagtagtttaattcttagaagtgctatcaaaatcccttattgaaattataaaactgtcaacccacctactggaatttacggaagttggacttgcttcagtgaattgggatgtttttcaaaatgcttgggtagatatcagaacagatgaaacggcagagattctctgagaatatcccataagagcccttgatgcagaggccatatggcatggtacttccagcagaaggggagggtcaccttagctagggcagcagcctggagtagctactcctctccccacagctttcaatgcttccttgccttcatctctcattcaccacccaccatcattctcaagaaaataaagcctggaagcaatatcacaagtaatgtagtcaggcagctttggctaaaaatcctttgctcaagggagggtctctactcagaaatactgttttgtcttttttttttttttctttttcattgaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaagtgagtaagtttgtcctggaaaactgaaatcttaacgatggagctgatggatgagcagatatgaggaaagacatacataaacatttacatgttgttttgctaagaatatgtggcctagaaataaatttgtatgcttaactcactgtaaaatctttggctggtctttcctcctcctttaatgacaatcatttcctttttttgttctcacctcttgccatcttaactcctaaaatctgaactcactgatttactttttacccattcttctattccactacaatctaacatctctgttagcccattgaaatgcctgtaaaaggtcactaatgaccacctacttccccaaataatggatactcctgaatcatcactaagctaatgcctccaaaatctatctgtatatgagaagaatcatgtcttgttcatctttgtataccctccacctgacacagtgcctggcaataggtgctaaagcaaatgcatgttaagctagcatgtgaaagaatagctacctgtgtctgctcctgagactatctgcatggatgacaaaagtctttaaatggtaggatctacagaagctgtcagaaatgctgatctctgtgtgctgcgtgcccagggccagggagtagagtggatgagcagagagaggcagggaggcctttagcagaggactgtgtattaggcctatcagagacatttccctttaaggcctagctagtgttcatttcctcctcatcttcatcaagccaacaggtaccttctgtctggagctcctgggaacttgagccttctctcaatcatatatttgggtgtggggatcaaatcaccttgaaaaggttcatcaaagtaatgggaagaactaaggatagaatcagaccctctgccaatatgtaaaaaagtagattccttcaaatgttagtatcaggagacagatttttttttataccagtattttcaaatagaggctcccaaatgaacttagtttacacttacaagagtatctctaaacatgcccttttacttattcgtgaaggaagtagagggaagtggtaactactgcattggaaagaaattagtgcaggtccttggcatgtaaaaatcaagtgcttatttttgcacaactgctttaaagtaaaagcattaatgatttcctttgactggtgaattatccagttcagatcattggcttttatttttcctgaagttgtattaggcttttagctcttctctgtgtttcagagttccagwcattgaacaagtccatggagctaaatacaaygatgaccattcttgccaacatttttaggkgcattttcaggaactctatgaaccacaaatctgggcattgagattctgtaggcattagactagcaaggctggtccagtctttgcctatgctgtagactcatcaggggccttcccatgccagtttcctcatctgtcaaatggcatcaaatgggctactactgggagatgtaaggaggaaaaaagtcaaatatcatgagatagactaaggaaataatgctggtggtctcatgctatgtgccttactgatttctctttcagaattggacaaaagtttctcaatgattaaggagggtgattataaccccctcttcattccagtggcagtcatggttactgcattctctgggttggcatttatcatttggctggcaaggagattaaaaaaaggtatgtgagtttaacttcacatgaaaagaacacaactttaaagtgaaaaagaaaaaaaaaagaaacccacaggaaattaaatgtgatagattcaacacaagcaggatgccaagctttacattctagagccatcagtccctggagacatgtaaatcagcccaggacacaccttcattaaaacaggttggctgattttcgcttttcatctgataaacttttaaaaatgtctattaccttcaaggcarcttgctaggctgataacaactaagtgagatattctaatggttctttgctcttatgtaattctttaatacttttttttttttgagacagagcctcactctgtcaccaggctagagtgcagtggtgcaatttcagctcactgcaacctccgccttctgggttcaagctattctcccacctcakcctcccaagtagctgggactacaggagcgtgccaccatgcccagctaattttttgtatttttagtagacacggggtttcactgtgttagccagagtggtctcgatctcctgacctcgtgatctgcctgccttggcctcccaaagggcttggattacaggtgtgagccaccacgcctggcctgctcttaattaattctgaaaaaatgacacactatctctgtcctctaagagcctacatgccttggatttcaatgctacaattccactaggaagtgggtctaatgtccactaaggtttcaaggcactgctcccaaatacctgacctcttcaagagtcacctggttcccaacacatgggcattgcattaaccctgggagaaattcccatgtattctcccaagtatctattcaccaaggccacagctctaaccaaatgcaccatatatgctttccaaccatccgtcactggagaggaaaagagaaggaggactgccttgagaagttaacatctgctgcccagattatcactccctttaccttaagrcatgagtgtgtctcagctttaaagtgtgagcaacccactagcctgcagcaggccttgggtgtatggtgccacatttggccaaactcacctggaagaaccattcaaggctgtaacattcatggacattgggcagcttttaagatatacctgttttggccaggtgtggtggctcaygcctrtaatcccagcactttgggaggccgaggcgggcggatcatgagctcagcagttcaagaccagcctggccaacatggtgaaaccctgtctctactaaaaatacaaaaattagccaggyrtggtgryrggcacctgtaktcccagctactcgggaggctgagacagaagaatcacttgaacccgggaggcggaggttgcagtgagcygagaccgcaccattgcactccagcctggtgacagagygagamtctgtctcaaaaaaaaaaaaaaaaaagatatacctgtttcaagttcagggatgatctcgaaacaattgctaaccaactgctctgtgttgcctttctgtgggctcagttgattgtcattttaattttccttccatcaaattagttagtacgtattctgttcactgaatatggtatgtaaaggttgccccctgtccatttacactggcaattacaaaaatattatttatcagtccctaattgcgtgccactctgatcttatctttcatttaaatttgagaatagtgggygctargtaagttttctaaccaatccagaaagacaaagtgtgtgaggggggtggggattgttgatatgcaagaacttcattagctatgtataacctgagagcactgagcagttaaaatgtctctgcccttgctattagaaattctgtgctgattgaatctcactatcttatagtattatacagtactaagtactatacagtactaagtataagtatcaagtactgcattaaggcaaaagaagaatgacagttttctccaaccactgattattctttccattgagacttcaaatcttgaccccggttgtcctgtctttcttcctaccttgggcgatgatggcagaactgacggatagagaacagggtgggttattacacactgccccctgggataaggtggctattgtctaaataattttaaggactttggggctgtaagtcaccttaataaggaagctatttatttccgaattctaaaatcttttaataagtgtttgtagaatcaaaagaatagaatcaaactcatttgcatgtagtgaggggttagctggctaaggctgttttataagcaagggtaaaaaaattagaggggttgtttttaaattttttaccttggagtcatttctgtacaagatctcaaaccgataacttgaaaactgctgtgggaatcagtgtggggcaaacaggaaacagataacgggcagttaggctagttacagttatgccaacaaagaaaacagaagccccaaaagatcactggcttggtaggaagcttagggtatctttaagataacattaaatagtcttcatctgtgggccaggcaccttggctgtcacctctaatcccagcacttttggaggctgaggcaggaggattacttgagcccacgagttcaagaccagcctgggcaacatggcgaaaccacatctctacaaaaatacaaaaaattagtcaggcatggtagcatgcacatgtagtcccagctacccaggagactgaggtgggaggatcacttgaacccaggaggtcaaggctgcagtaagccatgacagcaccactgcactccacaacagagtgaggccctgtctcaaaaaaaaaaaaaaaaaaagtcttcatttataaaacaacatcttccattttcaccaacttacaaatgattctgctttccaaagattttagttgtaggttggtcctttaaaacatgaagagtatttttcctatggaggcaatggtagaaataatggctacattcccaggctaaatctaagacaaaatatagttaatggcatttacaaggataaaagtaaaaagtcataaatctctatgtgtgtgtttaggtgtgtgtgtgtgtctatgtgtgtgtgtatatgtatatatatacacagagagagagagagagagagagagaatttataggctttttgggttctaatagttagaaaaagggcacaggtaactatttagagcatggtagccaatgaagtgactagagccttcacccctattcttctgtcctcagatgaatcttctgactctagcactttgtcccctgccctagtagtcttagtatggagactttccctcctttcttttaggaaaggaataaggaacagttccagaaacatgtgtccttgtgcatgggctcatctagacacattttgtgcwccaggcattatcattttctgattagtcactaccattggccctgtttggtaaataaggaaaccagggcaatgatgttttaggccaaatctcaaaaataccatatcagcaggacccagagtcagagattagactccagtccagatacatcttctaaaatcactggtcttcagatttgtgaactggttttttcctcggttggaagaatttcccaccagaaccaacacacagggttagaccagggcatgaaactgaacacatgcccccttagttcctttttcttcaaaatgaaactctctcagtaggaacagattcttactcatctattgctgttaggttcatcatccctaaaaaaaatatttatgtgaagytaaccagaatctgaaattaattcagatttgattccccctgctcaagtgcacttggtcatcagcaggctgaattttagaagaaaagatttcaaatagtagtctttaatactttaaakgattaaaacagtaatgcaacactgtctacgtgctaggacctgaactaaatacttggaaatattttattttatcaacccaatgaggatgatacaattattatgcctctttaacagatgaagaaattgtagtttagaaaagaaagtagctgttcaaatacacactacactacaggtggcaaaatagggctttcacctgggtaggatgattctagaatgccactttacagccactgaaatatattgcctcccaaatgattctttctgctcaaagagttttttttaagttatctacttatttatattctgcttttttcaaaaagaatgtgagaacagtacaaaatgtgttcagtatagcaaattaaaattaattaaaaagtaagaaaaagaagccaatttgggcaacccactcgggtccccttccacgctgtggaagctttgttgtttcgctcttcgcaataataaatgagcttgatgttttattgagtacaaaaaaaaaaaaaagaaagccaaatttaaacttagggtacaaaaatcatttggaaccaaggttgaagttatggcacaaaaatgtatgtcacaaagttttatatacttggtaggagagggtctcagatctagctctgagtttccttacagccagtcaaaggagaaccatgtgatattccttgtgtttgtaagataaaaacacattagttactcagatgaggctgcacaattcctaccaacaagaccaaagtgaaattctcttgtggattctcatagagatgatgctgtgagctgtaatggcacatagttttacagtattagcagctgtccctcaagggaagaatctgcaggtaggatgagatggcagattgggaagggataaacacttgaatggacatattgggtcttgccaccaggcaatttagcaattctgtcttcttgagtagcacggagaatggaatggaacctcaggaggcatctgcatcaacatgtctgttctgtattagtgtctaccactgtttattaagccagttcctcaaatctcctttgacacagatagggtccacctaacaaatacctaatatacttcaaaagacagttttgagagtgggagtcttccttctcccttacttgaaaaactttaaattgtctaatttttgctaatgccttttctctattttctattttcaggcaagaaatccaagagaaggtaagttttattagtggcgaggagtttccacatctgctgattcrttctctacttccttaagttacttcctgctctagctagacacattaaccccatagtagtttatttacctggggtcctcatccaaatgaccagataaggtgataaatctactagcttcctttcagagctgtgctttttggtgctagtggagctgaatgaatgaatgaacgaacaagtaatccctattagaaaagggcagtttatgtaaagggagatttttctgattacctcagaattttttctgagggttaaaaacattgtggtgtgttcttcttgttcttaaatatattatttaagaaatattcaattgaacaagcacttattgagaaatgaataaatgcttattcaattgactatttgcattcaattgctctaacaggcattgtccttcagaaatgtgggaaagatagggagcatgaattctacctacagcttccccaaggaggcaagtatttttcagtttggtcttgaagctcaaatttcttctactggagaaatagcacagtgggaggagatgcagacatgtgaaagttgatggcccacctggcagaaatgaagatggaaaaatatttctcagtatctagggtttagtgacttgctctggaattttaggaaggagagtttaagtaaaataaactatgaaaggaggactttggtgacatattcagtacccagctggacaactgagcttcctttaaaatgctagaaatgaagtgagatgatttctgaagggattggatgctggtttgggcaaccatcctaccaatcacaaacttagtatgggccattgcttagaatgcaaaggaaaaagtggggaaaaatgaggcaccagaagccagatcataaactaatgtataagccatgtgatatgggctttatcttgaggtcttttgggatatcactaaaggggtttaaacagtgagtagccttacctctggcatcttataaggtcaccctgcagagcagtatggcaagtgtgggagacaggtgagcctggattcaaagagacttgttttggaggcatttgcagttattagattaaaaccgatggcgcctgtctagggaactagtagtaagaatgggttcatgaaataagaggaggtgatattaactgaatgtgtctgttaattggctaaaagtgagagagaagaatcaaattatcatctttctcacctggaaactggcggatggtagtcctgtttacttctgagaagggaacataaaagaatgagaggttttggaggtaaagatcatgggttcagttttgtactgagctttgggtgtatgcacatcattcactgtggctcattggacctatccaaagcacagaggctatggcaggagaagtggatttgggtccctcacatttcaggaggtaactgccatctcaggagtgggtactatcatccagggagggtgtgagtgctttaagaatggaagaggacctgggagagagtatgggagccagaggaacatcattatctaataagtcacctaagggaaagagaaatgaaaagatgttgccaggcagggagaaggaagaggagaaagagtgtggggtaatgaatgccaaggaaacaaagaaaggggaacggtttcaaacattgccaagagaaccagtaagtatcccctggatgcaacaagggtgtcagtggggagactatttgcagtgcagacatcaagacagaggtcagacggccaagcattgagcattactgaggatgagaaagtagagacagaacaagcagtcatctcttttaaaatgtttggctgtgaaggagaagtggggcaggggtaactggatgaggatgtacgatcagtggaggttctttttattctttttaattactctgtcttctctttactagtgcaaatggagtctagtgaggaaaggcttctttctctgggctggtctccctatgtctgtggcaggaaacccacagatgtgaagatttctttcaaactcgcacctactgagtgaaagtattttctggcacaatctacccagagctgttttctggctaccggaaccacctgttttaattgccactagatggaagcagatcaactagattttttttttttaagatgtccttgaggcacaggaggagagactggctggaagaatattagcaaaaagctaattaccatgctaagcaaattgctatattaagtttaatggttcactgattttttataatcagtcaattaatagttgtttattgaacatttttgtgttggaaactgctaagctttcttgagacagcaagaggagtcagcctggtccctgatttcaggaaaattattacctagctggggagttaagacaggaatatagaaagaaaaaaatcagaaaaatacaaggcagagcatggtaatggccaatgggtgctatatttaagaaggaaaaggtcatttggcttggtggttatagaaaatgttataaagaaggttgcttatgaagaatagataggatttaggtatatggagaaaagcaggaaaggaaggcagtctgtaggaaggaaattgtgtaagcagtggtatggtagtgagamtatgaaagcatttttcaggggccactgagcagaactttcttgagcccatggcttattgaggagttgtggagttgaagttggaaaggaaggctggccccaataacataagtcttgaatgcttcaccagatggtctagaaaggcctagcaaagaagaattatttgcccagctctcatttattgaccaaggctgtattaattcataagaatcacagaattctaggtctgaatatgatcttggtggatatcacattcaaactctttttgtagttgaactaattaagtaagttttctataggccttgagcaagtgacagagttagttacaataatcataaacctttatcaaatattaattccatgttgtatactgttatgaatggtttacatgtcttaaatcatgaaatatgcctttaagtctgtgggagaagggtctatgaacatcttcattactgataaagaaacaggcacagagaaataaaatagcctgaggtcacaataaatggcaatgctgagatccatactcatttggatccaggaatcatgctcttaacgcgtatgcttttagaactcaagacccttgactaccagcttagagtggcaagtcccaggcaccctccttttccagtaacgtggttttttttttcacactgaaaccattgtgtgacggcactgaggaagggtggggtagaagtatggtgtgtttttagaacaagtcaaaggtaaaatgaatactatcacactaaacaccatgagcctttttttttttttttaagttcttgggtgaattttcatagtagtttgtgttcatttctattagcttttgaatggtgaatgaatgactccttgggcatttgtggtttcatttcttgctgggttattttgactcttctgcaaaatgactctgtttatcacctcatttggtttctactgtctaaattctggcaggatagaagctacacccaagatacacaggaagatatgatgccaacctcagaggagggcatatgtgaaattttgttttcagaaacatttttttgtctctattttggcaagcacatttgcagctgctgaactgtggtttaccctgacagttcatcatgagaccagctcctcagaatctggttctccctttgaaaggtgctgtgaagacataccatatttcattctctccttgtcctttccaagaataagacagttgtgtcacacaaaaaaagtgtcacttatttctttaaactaaatgtgttaccatctcattaaattatatcccaggatataatttatcacgagtttataaccaccactatttcatgagtttaaattttctccaatttcactttccatttaagcatgccttctaattccttgactttccactgctcaaaatcaatctacagctgggctcggtggctcacgcctgtaatcccagcactttcggaggccgtggcaggtggatcatgaggtcaggagtttgagattagcttggccaatgtggtgaaaccccatctytactaaaaatacaaaaattagctgggtgtgctggcacgtgcctgtattcccagctactcaggaagttgaggcggaagaatcgcttgaacccaggaggccgtggttgcatgagctgcctccgtgccactgcactccggactgggcaacagagtgagactccatctcaaaaataaataaataawtaaattaaattaaattaaatwaaaataaacataaatttaaaaaatcaatctacactgtccttcagactcattagatctggagacaaagaccgtatgcaccacaaaaatttctccaagtggggtctgtgcgccagtggcataagcatcactaaagagcttgttaggggtgcagaatctcaggctccactcagacctactgaatcagagtctgcattttaacaccatctctgagtggtaagcacatgaaaatctgagaagtgctgctactagggtttgcttacatttgttcatcttcagaggttcctaaagcctggcctcttgtctgagatttccagctgaaagcatttccttgctcctcttctcatctctaatgaatatttacctttactactaacactccaagttttgcaatttttaaactcttattatcttttgtttttctttcagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctaccygaccaacagttccttcagcttccatttcgcccctcatttatccctcaacccccagcccacaggtstttatacagctcagctttttgtcttttctgaggagaaacaaataagaccayaaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagamcttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaactagtttgcctagtttgttattttgaaattatcatatgttttgttttctccccagtgagattacatgctccttcagggcagagtttgtgtcagatccctggagtatctagtgcattacttgacactcaataaatgaatgttcaaataaatcagaaagagcatacagtgcactgctgatataagtttcagcaaaccctctttctctatggcatctgatgacctgggcagatatcacctaatgtcaacagctgaattcttatgagagaatagagccctttcagaagctagctggaaatacctccttgtcccatggccaatatagatttcatacaaatttgcacacattatgagaataattttttggtaatgattacacttttctttctcaaagacatctcagattctgtattatagcaaaagctgttgcaaaagattctccctatagtacactgtaaatcttggatgtgcaaatcacattcatgtggtttagggtacatcccctggaggtgtacagtgcacacgtgcacagacacacatggcaaccctgacaaaaatgtttattccactaacacatcagggccaaggaacccaaatggacactactccttgtaattatgatgtatatagatttaaaaataaagttctatattcaagctctaggattcctatatgatcttaggaattacataatagtaatcccataaatcaagattcataatataaaattctccagaaaccttggtcttaacctccctgagacttacttcctatgcccataaaacaagaatgaaatttgccttgcttaccccacagggttattgtgatggtaccttaagtatgaaactgctttgtgaactgaatctgaaacacagactttttttttttttttcctcactcaaatcttacctttcatgctttcatggtgtaagattctggttcttatcctaaggctggaacagatggagctctgagtccttatcctgagattagaagccaggaagtctttcacttgtgttccaataggaactcagccctcagattttcactgcacagggtcagctctgccccctgcacttctgcttgcgggaggaggaagggcctgggacagggagtcagaggcatcagtgggaaccctgcctctgtctccgtgatgtgaccctggccagttgttactctctctgaacttcagatttatttatgaaatggggatcccattatcttcgtcacatgattgtgctccacattttatgaaataactcctcctatgctttactcagagtaccaagttcatgaaattgtcagagtcccaggaacacagaattattcattccttctgatttgttcacccaagatcaatgtgcctgggctgtattattgtagtttcctacagaaatagttcaccaaattaaaatctaatttttaaaaaattagctgggcatagtagcacatacctgtagtcctagctagtcgggaagctgaggcagaaggattgcttgagctctaatgatttaatgagaatagaaagaagcaagaaagaggcttcttgtccaaattgcactgtggaaaatgaataaatgtattctttagacatctatatttttccccttaaacttcctcccatctgccagttgacttctctgtacagttctttctccaaagttctttgcattgccctctttcaacttcagcaatttgatttttcccttctgttcaaatgtcctattatggacattttatggaaagaaaatctgccatcaccataacagcctacccaccatttatgacaaaggacagggaaattattaggagaaataatgagatctttacttccctttggcctttgtggccttgtctgatccagtgggccccaacattttatgagatatatacagccttccctgcgagactctgaaagggttttagttaaaagtaatataataattatcacgcgtgtcggtgtgaagagaccaccaaacaggctttgtgtgagcaatgaagcttttgaatcacctgggtgcaggtgggctgagtccaaaaatagagtcagcaaagggagatggggtggggctgttttataggatttgggtgggtagtggaaaattacagtcaaagggggtttttcacttgtgggtaggggtgggggtcacaaggtgctcagtgggggagcttctgagccaggggaaggaatttcacaaggttaatccctcagtcaaggtggcgcaggaacaaatcacaatggtggaatatcatcagttaaggcaggaaccagccattttcacttcttttgtgattcttcacttgcttcaggccatgtggatgtatacgtgcaggcttgggctcagaggcctgacatttctatcttcttatattaataagaaaaataaaacgaaatagtggtaaagtgttggggcagtgaaaatttttgggggtggtgtggagagataaygggcgatgtttctcagggctgcttcgagcaggattaggggtggcgtgagaacctagagtgggagagattaagctgaaggaagattttgtggtaaggggtgatattatggggttgttagatgaaactgtagcaggacaagacacagacaaaacccctcagacactgagttaaagaaggaagggctttattcagctgggagcattggcaagactcatgtctcaaaaaccgagctctccgagtgaacaattccttttcctcttaagggcttacaactctaagggggtctgcgtgagagggtcatgactgattgagcaagcagggggagcaagcagggggtacatgactaggggctgcgtgtactggtaattagaggaacagaacaagacagggattttcacagtgcttttccatacaatgtctgtaatctatagataacataactgattaggtcaggggttgatcttaaccaccaggcccagggtgtggcatcaggctgtctgcctgtggatttcatttctgccttttcatttttacttctttctttggaggcagaaattgggcataagacaatatgaggggtggtctcctcccttaaaacatttgtcgtatagaatgattggtgatggcctggatacggttttgtatgaattgagaaactaaatggaagacacaaggtctgcataagagaaggagaaaaacaggtattaaaggattaagaatcgggagaacccaggacatctaattagagtgcccaagggggttcagcataattacttgcttggttggcaaggtttttggctctatccttgagttttttttatgttgtcatataccaggccagattgatttaggtaaaaacaacactcttcatttaaaaatatgcagagtccccttttttagcagtgagtaaattgaggactcggtgattttggaggaaagagaaattgtaaagccagcaattgtttgttaaagaaggattagaaatggctaggagagagtgagtgagattgatagtgtggtggagatagctggggagaggtagagagtggcataagaatgggaacaagaataagagtgaatataaaagtaaagaatagggctttattagggtgaaagtattggagtgtaccttgtcactgaagatcttctatccactttaagagagacttaagggtggcggtttgaggtaaaaccaggagatatcagttatgatggtttggaggaaaagtataaatcagcactgtaaaaaagggcagggcatttacaagtagttgagaatggtgaataggagtatgactagacagaagattgtagggatgacaagtttttggggcacagttcaagttgggctggtgtctygaatragactggggcctaataaaaaggagcgtccatacagaatcttaaatgggctgtaccttgtagcatttcgaggacaggcccgaattctgagaatggcaagtggtaaaagtactgtccagtcctttttaagttggaggctgagcttggtgaggtgtgtttttaaaagaccattaatcagttctacctttcctaaggattgaggacggtaaggggtatgaaggtttcactgaataccaagagcctgagaaactgcttgcgtgctttgactagtaaaggcttgtccattatcagactgtatagaggtgggaaggccaaaccaaggaattatgtctgacagaagggaagaaatgaccacggtggccttcttaggccctgtgggaaaggcatctacctatccagtgaaagtgtctacccagaccaagaggtactttagtgtcctgatttggggcatgtgagtaaagtcaatttgccagtcctggggttggggagattagctggacatgatcagcagggagagcacgtgtgttttcatgaagaactatgcctggataggtaatggatgaagaagaaatttgggttgactgaggtaatgggggctgtccatgaagccttgcggcagtacagcccaggtaagttgctgaggctgatgggtgtcagggtcagtccaagtgaaagtgaagagaggctgggatgaagggtgcaaatgaatagtaaagaaagcatgttttgagatccagaacagaataagggttatggaggggttttggagggaggtattgaggataggagagtatatgggtttggcaccatggcgtggataggcaagacaatttggttgataaggcacagatcctgaactaacctgtaaggcatgtccagtttttggacaggtaaaatgggggaattgtaaggagagtttacaggctttaaaaggacatgttgtaacaggcaagtgataacaggctttaatccctttaaagcctgttgtgggatgggatactggcgttgacccaggtaagggtgattaggttttaatgggatagtaatgagggtgtgatttgttgccagggagggagtagaggtgtcccatacctgtgggttaaggtagggggatatgagaggaagtggcaaaggagttgccacttttgggttgggaagaagggcagcaatgagatgtggctgtagtccaggaatagtcagggaagcaaataatttggttaaaatgtctcagcctaataagggaactgggcaggtggggataactaaaaagaagtgtataaaagaatgttgtttaaatcggcaccagagttggggagttttaaggggtttagaagcctggccatcaatacccacaacatttatgaagacaagggaaacaggaccttgaagagaaggtaatgtggagtgggtagcctctgcattgattaagaaggggacggacttaccctccactgtaagagttaccaaaagcatctgtgatggtccaggaggcttctgaggcgatcaggcagcatcagtcttcagccactaagccaagaagatctgggaaggagtcagtcagagagccttgggccagagttccaggggctctgggagtgggtgctgggcaagttggacagtccgatttccagtggggtcccacacagatggaacatggcttaggaggaatcccaggctgagggcattccttggcccagtggccagatttctggcacttgaagcaagatcctgatggaggaggtcctgtaggaatgcttgaccactgtggcttaggcattttgaagttcttgtgtactggagatgtggctggggtttctctcacagtggaggcaaggaattgcaactcagaaatatgttgctacttggctgcctctactctattattgtacgctttgaaggcaaggttaattaagtcctgttgtggggtttgagggccggagtctaacttttggagctttttctaatgttgggagtggattgggtaataaaatgcatattgagaataagatgaccttctggcccctctgggtccaaggctgtaaaatgtctaggagttgctgccaaatgagccatggagtgggctaggtattcatatttgatgaaaaaaagcctaaatactaactgagatgggagaggttggataaagaaaaaggagcattaaccttgactatgcctttagctccagccacctctttaa

SEQ ID NO: 17761 - DNA, 28693 bp, Homo sapiens
gtagacatgggagacttttcattttgttctgcactaagaaaaattcctctgccttgggatcctgttgatctgtgaccttacccccaaccctgtgctccctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaattaaaaaaaaaaaaaaattaaaaagtgaggctgggcacagtgcctcaagcctgtaattccagcactttgggaggctgaggcgggtggattgcttgagcccaggaatttgagaccagcttgggcaacatggcaaaaccctgtcactacaaaaaaaaaaaaattagcagggtgttgtggcatgtgtccataatcccagctactcaggaggctgaggtgggagggtggaataaatggaatgtgatccaacaaaattattattattattattttgatgatgtctattgcccttttgaaatacccaattctggcagggtgcagtggttcacgcctataatcccagcactttgggaggccgaggtgggcagatcacctgaggtcaggagtttgagagcagcctggccaacaaaccccatctctactaaaaatacaaaaattagccagctgtgttggtgagcgcctgtaatcccagctacttgggaggctgaggcatgagaattgcttgaacctgggaggtggaggttgcagtgagccgagatcatgccactgcactccagccagggtgacagagcgagactctgtctcaaaagaaaaaaaaaaaaaaaaaagaaatacccaattctttcacagaaaatatgttcttactggctggcggggagaggggtggttggtaaatgggaaaagggtgcttcctttgctgatatccaaagcagatactttctctgcctatttgatgatacaaaactagccctaccacaccaggctaagggagagaagaggatccgtgtcctacagaattccccctattagcctacctgccccatagcccccaaactctgctgctaatcaactgtgccaggtcaggaagaaagaaactggagggaaagaagaagcctaatagattgaaaatcccttcagcaaacattttttgagagccttataactgttagtgtctactgaattaaacttactagtgttaagaaaaattatctgaaacatgttactaaggtaaaaagatgattgtgtgactttttgctgtcatgataaagcattgactagcaagtctacttgtcatctgtccctgaagagaaacgtgacactattttcatattaattacggcccagacattgtacaattctgtaaagtaataagatgtgacaatttcctttcctgcctggtagagaagataatcccaaaggttatgatattattactctgtaggacattaacccatttagtatttaatttagcaatcttacttcaatattttccttttccattgactataaaaactcaagttcttttttcttttttttgagacaggtctcacattgttgcccaggctggagtgcagtggttcgaacacggctcactacagtcttgacctcccacatcccaggctcaagtgatcttgcctcagtccctcaagtagctgggactataggcatgtgccaccatggccagctaatttttgtatcttttcgtatagacggggttttgccatgttgcgcaggctggtctcaaactcctggctaagcgatccacccaccttggcctcccaaagtgctgggattacagatgtaatcccaccatgcccagccaaaactctagttcttatattctattttgaactggctttgtcgtcctgcttgtcccttcattaatgagttaaatgaaactctgacccatgctcactgtctatttcaatgagaattatggttggttttgtttgtttgtttgtttgttttgagacagagtctcgctccgttgcccaggctggagtgcagtggtgtgatcttggctcactgcaatccccgcctcccagattcaaatgattcttttgcctcagcctcccaagtagctgggattacaggcacctgccaccactcccagctaatttttgtatttttagtagagacggggtttcatcacgttggctagactggtcttgaactcctgacttcaagtgatccatccactttggcctcccaaagtgccgggatttacaggagtgagccactgcgcctggccaagaattacatttttaacatgctgacagttgtccttgacactaagtgtcagaccctggattaagtaatttatagacccatgatactcctttgagatagtttttgtccccattttccagatgagaaagtgaaggcacaaaaagataaaagaaattttctcagtgccagttttgtgccaggagctttactaagttacagtttttttctccttccctcgaagtcctgtttatctattcattgattaaaaaaaaaaaaatcattgagtacttacgatgtgccaaatactctgctaagctggtaatacagaactttaaaacacattctctgccctcttatggcttttggtgtggaagacagatgcataaatagacaattatcatttaaagaagtaagggaggaaaactctctgaacttattctggtttgggggctgcctgcaaaaaaattaattaatgaattaattaattaaaaattaaaaaaaataaaaagaactaagggaaagagagggctccagtagaacagagggagcatctaaccctggcttgtggacatgaagtcagggaaggcttcctgtagtaggtgacacctgagtattctaataggaattagtagggctgaagaaggtggtgggaagcacctcaattcaaaattttgattcctttgtgtattatgaaaggctcttctgactcctgcttacctcctcatatcacttcttccttcctatcacctactcctatttggccatacttaagtattactgctttctcaagtatgttatattctctctcctttcctattatattcttttgtaccttcttcaccctgtacttgaaacaactttttcctcacccctacttgccccttaggcattatcggggttttttgtttttgtttttttctttgtttgtttgtttttgagacagggtcttgctctgtcacccaggctggagtgcagtggtgcgatctcagctcactgcagcctcagcctcctgggctcaagtgatcctcccacctcagcctcccgagttgctaggactacaggcacacgtcaccacgcctggctaatttttgtattttttgcagagcccagatgaactcctgggctcaagcaatcctcccacctcagcctcccaaagtgctgggattacaggtatgagccaccggacccggcctggaaagcattcctttttaaaccaggaaaatggcaagaatattctcttatattctctatcacttttttttttttttttttctggagacagagtcttgctctgttgcccaggctggagtgcagtggcacgatctcggctcactgcagcctccgcctcctgggttcaaacgattctcctgcctcagcctcctgagtagctgggattacaggcatgcaccaccacacccagctaatttttgtatttttagtagagatggggtttcaccatattggccaggctggtttcaaactcctggcctcgagtgatccacccacctcggcctcccaaaatgctgggattacaggcgtgagccactgtgcctggccttctattactatctctgttaaacattgtactagaggttatagccagaacaataagttgaaacaaacattataaaaattaaaaaagaagaaataatctgtcattatctattggtgctatgaatatgcatgtagaaaatccaaaagagtctaaaaataattattataacaaacaaaagaatttattaaggttgctagaaacaaaactaatgcaacaaaatcatcagtacttctatatgctgagaataagcacaccatgagatttaaaaaaaaattatttgcaataatatttttaaaatatggagaacttgactgggtgcagtggctcatgcctgtaatcccagcactttgggaggccaaggcgggcagatcacttgaggtcagagtttgagaccagcctggccaacatggtgaaaccctgtctctactaaaaatacaattagactggtatggtggtgtgtgcctgtaaccccagctactctggaggctgaggcaggaaaattgcttgaatctgggaggtggaggttgcagtgagccaagattgtgccattgcactccagcctgggcaacagagcaagactctgtctcaaaaaatatatatacgtatgtatatatgaagaacttagaggggaaaacttaacagaggatgggccatatgttcagagagaaaattatgaaactctgagagataccaaaaaagatgtaaacaaatgaaaaaaatacaccctatcatgcactggatgattcaatattgtgaagatgtcaattcttcccagtcatttacatgctaaatgcaataccaaccaaaacttcatcaacgtgataaaaaagattccaaaatttaggtgtagacgttcaaatattcaaaaatagctaagacactcttgaagaacaaagaggaaagacttgatctacaagatataaatacattatgaaataatactaatcgagggccaggcactgtggctcacgcctgtaatcccagcactttggaaggccaaggcaggtggatcacctgaggtcaggagttcgcgagcagcctgaccaatatggagaaaccccgtctctactaaaaacacaaaattagccgggtgtcatggcgtgtgcctgtaatcccagctactcgggaggctgaggcaggagaatctcttgaacccgggaggcagaggttgcggtgagctaagatcctgccattgcactccagcctgggcaacaagagtgaaacaccgtctcaaaaaaaaaaaaaaaaaaagagaaaaaaaaattaaaaaaaaaaaagaaataataccaattgagataatgagcattggtaccaggtgagacaactggaccactgaaacagaatagacatatttactgtaagtcagagatgccactgcagatcagtaaggaaaggccaacttttgataactggttctgtctgggacagtggatatccattaaaagaaactaatcttgacctccacttcataccatacctcaaggtgaaagacaaaactaaaaagctttgaacataaacagaatatcttcatgaccttggggtttagggaagggttgcttaaataaggcacaaaaagtacaaactgtaaaggaataggttgataaacataaccaccttaaaattaggaacttttgtttatctaaagacatgataaagaaagtgcaaagcggctgggcgcggtggctcatgcctgcaatcccagcactttgggaggctaaggtgggaggatcacttgagcccagaagtttgagaccagcctgggcagcatagcaagacctcatctctacaaaaataaggttttttaaaaaaaaaaaaactgtgacggtaaaaccacctactcaagactcagcaatggtggatgccctacgacacctaggtggcgtagcctactatacccctaggctccttggtatagcctattgctcctaggctacaaacctgtagaacatgttatgatcctgaatactttaggcaactgtaacacaacggaaatatttgtgcatcttaagaaatctaggatttgctggcaagatggccaaataggaagagctctggtctgcagctcccagtgagatcgatgcagaaggtgggtgatttctgcatttccaactgaggtacccggtttatctaattgggactggatgggcaatgggtgcagcccacggagggcaagccgaagcagggtggggcgtcgcatcacccaggaagtgcaagaggttaggggatatcccccctagccaagggaagcggtgagggactgtgccctgggaaatggtgcactacggcccagatactgcrcttttcccaaggtcttcgccacctgtagaccaggagattccctctggtgcctacrccaccagggccctgggtttcaagcacaaaactgggcggccatttgggcagacaccragctagctgcaggagttttcttttttttttttcataccccagtggtgcgtggaacgccagcaagatagaatcgttcactctgcaggctgggcgcggtggctcatgcctgtaatcccagcactttaggaggccaaggtgggcagatcacgaggtcagaagttcgagaccaccctggccaacatggtgaaaccccgtctctactcaaaatacaaaaattagctgggtatagcagtgggggcctgtaatcccagctactcaggaggctggggcaggagaatcacttgaacccaggaggtggagcttgcagtgagctgagattgcaccactgcactccagcctggacgacagggcgagactccgtctcaaaaaaaaaacaaaaaaaaaaaaacaggwttgttcaatccgctggaaagggggctgaagccagggagccaagtggtctggctccatgggtcccacccccacagagctcagcaagctaagatccactggcttgaaattctcgctgccagcacagcagtctgaggtcgacctgggatgcttgagcttggtggtgggaggggttgtccgccattgctgaggcttgagtaggtggttttaccctcacagtgtaaacaaagctgcagggaagttcaaactgggtggagcccaccacagctcagcaaggctgctgtggccagactgcctctctagattcctcttctctgggcagggcatctctgaaaaaaaggcagcagccccagtcagggacttacagataaaacccctggccagcacggtggctcacgcctgtaatcccagcactttgggaggccgagacgggtggatcatttgaggtcaggagtttgagactagcctgactaacatggtgaaacaccatctctactaaaatacaaaaaaaatgagccaggcgtggtggcaggggcctgtaatcccagctactcgggaggctgaggcaggagaattgcttgtacccaggaggtggaggttgcagtgagccgagattgtgccactgcactctagcctgggtgatagagtgagactctatctcaaaaaaaaaaaaaaatctccctgggacagagcacctgggggaaggggtggcttggaaacagcttcagcagacttaaacgtccctgcctgatggctccgaagagaactcccaggacaacattcgagctctgataagggtcagactgcctcctcaagtgggtccctgacccctatgtatcctgactgggagacacctcccataggggccaacagacacctcatacagaagagctctcgctggcatctggtgggtgcctctctgggacaaagcttctagaggaaggaacaggcagcaatctttgctgttctgcggcctccagtggtgatacccaggcaaacagggtctggagtggacctccagcaaactccagaagacctgcagcagaggggcctgactgttagaaggaaaactaacaaatacaaaggaatagcatcaacatcaacaaaaaggacgtccactcagagaccccatctgaaggtcaccaacatcagagaccaaaggtagataaatccatgaagatggggagaaaccagcacaaaaaggctgaaaattccaaaaaccagaatgcctcttctcctccaaaggatcacaaytccttgccagcaagggaacaaaactggaaacagagaatgagtttgaagaattgacagaagtagacttcagaaggtgggtaataacaaactcctccgagctaaaggagcatgttctaacccaatgcaaggaagctaagaaccttgaaaaaaggttagatgaattgctgactagaataaccgtttagagaagaacataaatgacctgatggagctgaaaaacacagcacgagaacttcgtgaagcatacacaagtatcaatagccgaattatcaagcagaagaaaggataacagagattgaagatcagcttaatgaaataaagcgagaagacaagattagagaaaaaagaatgaaaagaaacaaagcctccaagaaatatgggactatgtgaaaagaccaaatctacatttggttggtgtacctgaaagtgacagggagaatggaaccaagttggaaaacactcttcaggatattatctaggagaacttccccaacctagcaagacaggccaacaatcaaattcaggaaatacagagaacaccacaaaatcaatgtgcaaaaatcacaagcattcctatacaccaataacagacagagccaaatcatgagtgaactcccattcacaattgctacaaagagaataaaatacctaggaatacaacttacaatggatatgaagacctcttcaaggagaactacaaaccactgctcaaggaaataagaggtcacaaataaatggaaaaacaatccatgcttatgtataggaagaatcaatatcgtgaaaatggccatactgcccaaagtaatttatagattcaatgctattcccatcaagctaccattgacttccttcacagaactggaaaaaactactttaaatttaatatggaacaaaaaagagcccccgtatccaagacaatcctaagcaaaaagaacaaagctggaggcatcacgctacctgacttcaaactatagtacaaggctacagtatacaaaacagcatgatataccaaaacagatatatagaccaatggaacagaacaaagccctcagaagtaacaccacacatctacaaccatctgatctttgacaaatctgacaaaaacaagcaatggggaaaggattccctgtttaataaatggtgttggaaaaactagctagctatatgcagaaaactgaaactggaccccttccttacaccttatacaaaaattaactccagatggattaaagacttaaacataagacctaaaaccataaaaaccctagaagaaaacctaggcaataccattcaggacataggcatgggcaaagatttcatgactaaaacaccaaaagcaatggcaacaaaagccaaaattggcaaatgggacctaattaaactaaagagcttctgcacagcaaaagaaactatcatcagagtgaacaggcaacctacagaatgggagaaaatttttgcaatctatccacctgacaaagggctaatatccagaatctacaaagaacttaaacaaatttacaagaaaaaaaacaactccatcaaaaagtgagcaaaggatatgaacagacacttctcaaaagaagacatttatgtggccaaaaaacatatgaaaaacagctcatcatcactggtcattagagaaatgcaaatcgaaaccacaatgagatactatctcatgccagttagaatgatgatcattaaaaagtcaggaaacaacagatgctggagaggatgtggagaaataggaatgcttttacactgttggtgggagagtaaattagttcaaacattgtggaagacagtgtggtgattcctcaaggatctagaaccagaaataccatttgacccagcaatcccattactgggtataaggattataaatcattctactataaagaatacatgcagaggtatgtttactgtggcactattcacaacagcaaagacttagaaccaacccaaatgcccatcagtgatagactggataaagaaaatgtggcacatatataccatggaatactatgcagccataaaaaaggatgagttcatgtcctttgcagggacatggatgaggctgaaaaccatcattctcagcaaactaacacaaaaacagaaaaccaaacactgcatgttatcactcataagtgggaggtgaacaatgagaacacatggacacagggaggggaatatcacataccagggcctgtcagggggtagggggctaggggagggatagcattaggagaaatacctaatgtagatgacgggttgatgggtacagcaaaccaccatgacaagtgtatacctgcgtaacaaacctgcacattctgcacatgtaccccaaacttaaagtataataaaaattaaaaaaagaaatctaaacacagaaaaggtacagtaaaaatatggtatagtcswttttaaaaggtacacctgtagagtgtgtacttcatgcatggagcttgaaggacttggtgttgctctgagtgggtcagtgagtgagtggtgagcaaatgtgatggcctacgacattactgtacactactgtagaatttatcaatactgttcacttaggctgcactaagtttatgcaaaaatatttttctttcttcagtaataaattaaccttagcttactgtaaaaaaaaaaaaagtgaaaagttaatatttatgtgttctgtgttcaggaaaccaggaggaatggatttggctgaaactggaatacatggatagataaggctagagagataggcaggagccaagccaacaatactaggctcccaycaattgctggggcaggcaagagcaggcatcatcctgagtgtttggagcttcttttcatgttccctaagttggggggtgttggggggatgatacagggggaaattctgattaagacttaacatctattcctttgccttctcttcaagaagtcatacttgatgtccatccctcctggacagggtccgttctgtttgctgctaagctcctttcttatctctcccacctactgaacacgtactgtgttctgggagttttgaatgcatcatcttgtttatcctcatgagatggtctaataatgaagaaagcatgttttggcatccaactcacctgggtatgagtcccagctctgccttttactagctggatgtctttgagcagctcagttccctgttctgtgcttctgtgtcctcatctgtaaaatgggaacgacggctatttcttcagactgccctccctccctccttttctgtctccctccctccctcccttcctccctccctctttcccccttcttcttttcttttctttctctctttctttcttttcttctttccttctttcttttttctttctccttctttccttccttccctcctctctctctctctttatttctgtctgcctgtctttcaacagggtcttgctatattacccaggctggtctcaaactcctggactcaagcaatcctcccagcttggccccccaaagtgctaggattacaggcctgagcacctggcctggactttcttcagacttttcacagggtactagtgagaaaaaaatacatggactctgcttacttaatactgtgcctggcacattgtaagctcttcgcacatgttattgttattattcctcatcctaagggggaagtgcctttgaagggtccacactcctttgttacccaaattgggccaggttgcttaaactgccgttcttcagtagctaacaacaggggtgggagagcctggtcctctgaagtccagctgggcacacggccagtccctggcctgtccctgctcctgctgccctggcaaggcctccctcacccactggggctgcaccagcactggccccagctcagcttcctgtctcccttatcttcctccagcatgtgctctctggagtaggaaacaccaccgcttgcttccttcatttccctttgctcaacgggaccctcattctttaggtctcagtcaaatcccagctgctggcctggtgcccactctgtgattttctacacctcagccacccaggccagatgcagtgtaggccatggctccaacagcagcatttctcttttcttccccacccccatccctgggtttagaatgagaaaaggctcaagttgcccccctcccaacttccctacccgcaacactctttttattttctctgttcccagctccatacttccatgcttttttttttttttttttttttttttgagatggagtcttgttctgttgcccaggctggagtgcagtggcaggatctcggcttactgcaacctccacctcccgggttcaagtaagtctcccacctcaacctcctgagtagctgggattacaggcacgccaccatgcccagctaatttttgtatttttagtagagacggggttttaccatgttgcccaggctggtctcaaactcctgacctcaggtgatccatccaccttggcctcccagagtgctgggattacaggcatgcccagtcccatactttctgagttcaaatcctcgctctgcacttccaagctgtgtgaccttgggcaagttacttaactatttttctgggctttgattttttttttttttttttgtacagaggagcagaggaggattcatcaggttgcccaggttggtccaaactcctgggctcaagggatccttctgcctgggcctcccaaaatgctgggattacaggcatgagccaccatgcccagtttttttggttgttgtttgttttgttttgttttgtttgagacagggtctctttctgtcacccaggctggggtgcagaggcacagacatagctcactgcagccttgaccttttgacatcctgggctcaagccatactcctgcctcagcctcccaagtagatgggaccacaggtgtgtactaccatgcctggctaatttaaaaaaaatttttttgtagagatggagtctcatatgttgccatgctggtcactaatttacaggcatgagccactacacccaggcagctttattttatttatttttttgtctgtagcatggaaacaatgagcatggtctgccccagagaaagtgattaaaggcctagcacatagtatgaatttaaagaatgttttataacatatatattaaacattcaagcatgttggaggtatgtgttaaaaaaatgtattgatggaaagtgatcaaaataatttttgagtcactgtgtgggagttaaattcacaaactttggcaccagagagagagagaaactttcaaattatagcttttgctgtgtgaccttaggtaagtcacttaacctctctgagcctcagtttcttagtaaaatggtgatgctagtgaaacccatttcacagggctagcataagaataaagtaagattatttaagtaaagagccgaacactgtttctggcctacaataagtgttacctataataatgctatcattgtctcactgttcaattttcagggctctagtatatgagaggggtgcttgggaaatagctgttgctgctgctatctgtccatgatggatcttaacctgattagaaaggcctccatgtggctgggcgtgggggctcgtgcctgtaatcccagcactttgggaggccaaggcagatggatcacttgaggtcaggaattcgagaccagcctggccaacatgatgaaaccctatctctactaaaaatgcaaaaattagccaggcatggtggcaccygcctgtaatcccagctacttgggaggctgaggcargagaattgcttgaatccaggaggtggaggttgcagtgagcagagatcataccattgcactccagtctgggcaacagagcgagactccatctcaaaaaaaaaaaaaaaaaaagaaagaaagaaaaggaaagaaagcccttgatgtaatgagctctgtgtaagataatgtggatgaaagtggacccagaccctacccgcttagatggaaggctcacagcattcaattccaaattggttcaatcgtacactcttttgccctctcttatccatcccaaagtacccttcaagccttcaagggagaaaaaaggcaaagcaaaaatatgcacaacctcactaagaaccagaaaaatgcaaactaaaaccaaagagaaatgccattttacacccaaccatctgataatgccaagggctggcaaggatgtgaagcgagggaattctcatacactgctgggaacgtaaattggcacaacctttctgtaaaacagtttggcaatatctagtaaaactgaagatgcatatactttattactcagaaattccactgtcaagtttgcacctacaaaaactcccacatatgcacaaggactcghgtatgagaatgttcataccagcactgtttgtaatagcaaaaaactggaaaaaacttaagtgttcagcaacaagagaatggatacataaataatgatctattcccaaaattgatttttttttttgagacagggtcttgctctgttgcccaggctagagtgcagtggcatgatcatggctcactgcagtctcaacctcctgggctcaagcaatcctcctacctcagcctcctgagtagctgagaccacaggcacaacccatcacacccagctaattttattttttttgtagagatgggggtctcactatgttgcccaggctggtcttgaactcctgggctcaaatgatccayccacctcggcctcccaaagtgctgggataatacctccccagccggaatattttaaagcagtgaaaatgaatggtctacacatagccacatgaatgaatcttattaatacattaagtgaaaaaagcaaaaggtacagaggaatacatacattttaataccatttatataaagctcaaaatatgtgaaataccactatctattgtttagggatatatacataagtagtgtaagtatacagaaatataaggaaatgaaaaatatcaaatcttcattttcatctgaagtggttacttcaggggctgtggcagggagagagagatgcagctgaggaagagtccatagggggcttcaactatattagcaatattgtatttcttatgcttggtggtggggataggtatgtttgaaatgtaatcctttaagcatgaaataactcttcaaaaatgaaatatttcaggctgtgcacagtggctcaggcttgtaatcccagcatgttgggaggctgaagtgggcggatcacctgaggtcaggagtttgagaccaacctggccaacatggtgaaatcccatctctactaaaaatacaaaaattagccaggtgtggtggcaggtgactgtaatcccagctacttgggaggctgaggcaggagaatcgcttgaatctgggaggtggaggttgcagtgagccgagatcacgccactgcattacagcaagactccatctcaaaaaaaagaaaaaaaaaaagaaaaaagaaatgtttcataatttttaataaaaggcaagacaatataaattggtagttatttaagtcattctacttttcctgaggcccagtgcaggaaaacaaagttcctatccttgttccaactagaccattttgataagctgcaaaaagaaaagactttgatgctatttcttagccagtttgcaacagctgagaggtgagcatggaagctcttgcatatattcagttcagagaatgggtgcttagtttatgtccagagtttgtcccagatttcactatgacgtcagctctccggggagaagtatataaaataaaaagttaaaatccctctcagtcctttacccaatcctattccccagaggtaatctctattgacagtacccctccagatattttccctatgtatatacaaatacacagatacacactgaaagttaattttggccaggtgcagtggctcctgcctataccagaggattgcttgagtgcaggagttcaagaccagcctgggcaacatagcgagaccacatctctagtaaaaataaaaaaaaatagctaggcgtggtggcacagtggcacgtacctttagtctcagctactcgggtggttgaggtgggagaatcacttgagcccgggaggtcaagcctacaattagctgtgattgcttcactgcactatagcctgggcaacagagctagaccctgtctcaaaaaaataataataaattttatatatatatatgaggatgaaattacatatgtattatttgaacagaagtgaaatcttttctttttttttttcagacagaatcttgccgcatgacccaggctagaatgcagtggtgtgatctcggccctctgcaacctccacctcccaggttcaagcgattctcatgcctcggtctcccaagtagctgggattacaggcatgcaccaccatgcccagctaatttttgtatttttcgtagagacgttcgccatattggccaggctggtctcaaactcctggcctcaagtgatctgcccacctcggcctcccaaagtgccagcagcatgctcggaggagtgactttaaagcttttctacttgcttcctagagtaagggacgcattttacactgctatccaaaactcatcatagaaacatacacacacaaaaccaaagcacacatatacaactgagcaaatatttcatgacataacactttctcttactaagggtgacgcgctgaaattttgtattctgtcctatttcattttttaaaaatggtaaccatgacctgctaaattgatttcattgtccactaataaattatgacctcagtttcaaaaagattgctttaggtaascaatcatcttctgagatttatacagattgctcataattctctcctattttttaaaaacatgctgcagtgaactgctttacactcattttatgactacttctgagaccaagatcycggattatgtaattgttatttacttaaaattctggtaaaatgtagccattayactggaaaactaaattttaatcttggatctgtcaccaccatgatatataaactttgggcaagtccctgcacctctctggacctcaatctccccatcagcaacctgctgatcctactcccaggagtgtgctctaagttgaaagtagatgccccaccccctgagtcagcgccggcaggacttctcaccaagcccttctcccccttttccgctccctgttcctggttcctaggaagcagcccaaggagaagggaaaaggcaggtctgggcaggagggagcaatgaagggcggggcagagggagggcaggagggaggccggccccctagtaggaaatgagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggtgagtcgggggcacatctcctgcctcaggatggttctggagaatctcagtctatctgggcacatggcaagaccacaggagagcttatctcacagcatctgtgtctgcagctggctagatctctctacagggcaggcagagtcttggggactggttcgtgtcccaaagccaaggtgagttagtacatttaagcccctgaaaagggggagatgaaagaggctaggggaaacaggatgactggaaacatgagaaagaaaccagcagagagggtaggagaatcagccccagggagaggggagaaaggggaactgagggtgatggtagataggggtacatctaggggagacrggaagaggctcagaagagaagagaaatggagggaatgggaagaccctgggaaaactgatggaagaagtgggggaagagtggggcagagagaggttaggggaggctagggaaaatggaaggagactggtcgcagctggtggaactggggagaaagagatgctgtgcctaatagaacttatgggcgatcaggctactgaagtggccctgtttaagcagaaaagggagttattaccctccattataattgcacaggggcctcctttcccctctctcacaatccccgtaacttcagtctccccctcagagaggcagcaaataataaccagtattcaatgagtgctcactatggttaatacatgtattgacccatttmacttgcacaaacccctaaaggtgggtaatattattactatctccattttatgaggaggaaactgggtcacagagtagttaaggaccatgtctagggttatccataaatatacttattcacatctgcagatacaaagcacaacttctcaaatgcaaacacagacaggacccactcacacacacagatttacaaccccggactcatccaaatgtgctctgggcatcaactctgtgccagcctcttttctgggtgtaggaagcagagattaccaagcatggttccatagcctagaggagtccagtgtggcctgtgtgtgtttggagacagccaggtagtatcccgtgagatacacactaatatrtggtggtctgggatcactgaaacagacacactgtgtctcgtggggcatcagaaaaaaatttccaagaagagggcaactgagctgggtctttttttctttgcttttctttcttttttcttttttttttttttttttttttttgagatggagtcttgtgctgtcacccaggctggaatgcagtggcacaatttcagctaactgtaacctccaactcccaggttcaggcgattctcctgcctcagcctcctgagtagctgggactacaggcatgtaccaccacgcctggctaatatttgtayttttagtacagatggggtttcgccatgttggccaggctggtcttgaatccctgacctcaagtgatccgcccgcctcggcctcccaaagtrctgggattacaggcatgagccaccgcgcccagtctctgagctgggtcttaaatcatgaataaacttcgccaggcagaaaaagggaggcagagcaatcctgacatgctattcatgtgtcagccaaaggcagcatgaggaatcccaactagtttgatatataagcagcgggaagcggccagaaaaggcagcaggggccaggtctctagcagccttgaatgccaggctaaagactctggacttgatcctgtggggaggcagtgtagcagaatggctgagtgctggacttgactgcctacgtgcaaaccttggctctgctacactatctctgtctcagtttcvcatgtagactggggttaataatagtagctattgcattaagccactggggaaaggcacaaagataataatgtatgtaaagcccattgcccaggttataataagcactgaatcracattggctatgattatttttgattaatgaaggggagggggttatggcactggaagattttaagtaggaaaaggacatgatctcayccctgggtcaggtgraggtcggaatagagaacggggagatgaagtagaaagttactaccccagtctagatgagacggatgaatcctgaatcagggcagtggaagaggagatggagaacaggcgatggaattggaattttattcaggtcaggatttgttaaccatttgttccgttggttaacaggaaacggggggagggagagccgagggtgaaaaaggaggcagaaaggagtgtctcttccactgcaggcctcagtttcctcatctgtaaaacggagataataatccctgtcctgtcctcctggcagagttactgtcagcgtcaaacgggagaagcggtgggagggcacattatagtttatgaagggtcgagaaggcgggcggccagcctcgaggtagggggttattatcttccgctgcccgccgccccctcccacgccggcccaggctgaagytgactctgcccgcaggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctgtgagtaggcgcgcagcgggggcggggtctgggcggggctagtgggggcggggcctggcgggtgggggcggggcctggcggatggaggcgggctgggrcttgcagggacccggcagccactggagctcggtggcgcctgggcctttgaagattgctgggtgggggctggagagaggcagttgtccccgctaagaaagccccgactcgggcggtcgtcctgctggcataacctcttgggatagaccctgttggaaggccctgacaccgtgacgtcgaaggtccccagaaaactcctcacccctcgcctcacagtcctccaactccttttcttcatagatctccgtccttcccttcccacagcccccagcacttcaccccccaccctccagccacttctcatacaagctgatgacttcgctcttagctccactcatgacccgaactcttcccccaaagaccccaagttcttctctcaaagccccactccttccccgtcacaaccctaactccttcttctcaaagaccscaatttcttttctcaaagcaccaagcaccactccgtcccccttcccccaccatcatggcctttaaytcctttctctcctagtcccccaccccacccccyyttttttttttttttttttttttgagacggagtcttgctctgtcgtccaggctggagtgcagtggcgcgatctcggctcactgcaacttccgcctcccgggttcaagcgattctcctgcctcagcctcccaagcagctgggactacaggcacccgccaccacgcccggctaattttttgtatttttagtagagacggggtttcgccatgttggccaggctggtctcgaactcctgacctcaggcgatccacaagcctggcctcccaaagtgctgggattacaggcgtgagctgccgcccctgccccagcctcaccccctgttttttttttctattacagttgaacaaggcctgacaattcccttttttcatcacagtccctrgccccttctttcttagcctctaacaggctaaccccaaacccctcctcacagccccaggcccttctccccatagttccctgacctagactcccctctcctcacagcactgactcttgccttctcatgttcttttccccttggtgggcctcgccccacacctggcaccctctctgcacagtcccctgaycctgactgtctatccacagttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtstgcagtatgtgcagaaacatatttccgcggaaaacacgaaaggtatgatgggacggggcccaggcctgcaagctggggagagggcgggttccagacaaatggatggacctgaaggatggatgcctagagcaacaagaggcccacagctgggggtttgggacagaacacacgcagcttcagtcagttggtaaacgggtccctttcctctggggcagaaacgctttggggtttgactcaaatcatggactccttgggggcctattcttcgggctaactctttgcatgttctgcagggagccaaacaagccgctcctacacttcgctggtcctgggcgtcctggtgggcrgtttcatcattgctggtgtggctgtaggcatcttcctgtgcacaggtggacggcgatgttaattactctccagccccstcagaaggggctggattgatggaggctggcaagggaaagtttcagctcactgtgaagccagactccccaactgaaacaccagaaggtttggagtgacagctcctttcttctcccacatctgcccactgaagatttgagggaggggaratggaraggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccmcaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggcattgttatctcctccactttgcaaaatttctggaaaagtaacctatacccatttcttctgcttccttatttctcactcattcttttttttttttttttttttttttgagacagagtcttgctctgttgcctaggctggagtgcaatggtgtgatctcagctcactgcaacctctgcctcccggttcaagcaattctcctgcctcagcctcccaagcagctgggattacagatgcatgccaccacacccagctaatttttgtatttttagtagagatggggtttcaccacgttggccatcctgacctcgtgatccgcctacctcggcctccccaagtgctgggattagacgtgagccactgcgcctggtcttctcactcattcttagacccagtgcaatctgacttctctataaactactctaagatcaccagtaacctctaattgtcaaaccrtcaccctacatggtatctgcaaatttgcggactagaactctctttttgccttaacttctgagataccatacttcaatttttaaaactgttctgtctactttttttcaatccctttgactatgtcatcttacacgattcaccctggaaatgctggcttccttagaattccattttttggttccttttgttcctgtttgaactataccctttctaggtgacctactgaccttcatggctgcaaatactatctacctgtggtttccatggagaagcaatataattttatctttaagagcatgtgttttgtcggccaggcgcggtggctcacgcctgtaatcccagcactttgggaggccgaggcgagaggatcacttgaggtcaggagttcaagacaagcctggccaacacagtgaaaccctatctctactaaaaatacaaaaattagctaagtttggtggcacgcgcctgtaatcccagctacttgggaggctgaggcaggagaatcacttgaacccgggaggcagagtttgcagtgagctgagatcacaccactgcactccagcctgggcaacagagtgagattctttttttttttaattctaaaaaaaaaaaaaaaaaaaaaagagtatgtgttttgtcatcagacttaagttttacttctttgaactagaaatttaacttcttcaagtctcagttttttttttttttttttttttttttgagacgaagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccgggatggtctcgatctcctgacctcgtgatccgcccacctcggcctcccaaagtgctgggattacaggcgtgagccaccgcgcccggcctaagtctcagttttttttgttcccaaatggtattaataaaatataccaaagggtctaagaaaaacaatacccaattcataaaggcatgaagagtattaaataaaagtatatatgtaaaataatatgccaagcgcaagctgggcacggtggctcatgcctgtaatcccagcactttgggaggccgaggcgggcggatcacaaggtcaggagatcgagaccatcctgactaacacagtgaaaccctgtctctactaaacaaaaacaaaaaattagccgggcatggttgcgggcgcctgtagtcccagctcctcgggaggctgaggcaggagaatggcatgaatccgggaggcagagcttgcagtgagccgagatcacgccactgcactccagccttggcgacagagtgagactccatctcaaaaaaaaaaaaaaaaaaaaaaatgccaaacgcaatgactggctcacacctgtaatcccaacactttgggaggcagaggcaggaggattgcttgagctcaggggtttgagaccagcctagacaacatagtgagaccctgtctctacaaaaaaaaatagaaaaaattagctgggcatggtggtgtgggcctgtagttccagttactcaagaggctgaggtaagaggattgcttgagcccagaaggttgaggctgcactgagccatgatcgtgccaccacactgcagcctggcaacagaccaagaaaaaaaaaaaaagatagtgtatgtatagtcagtaaatacagcagtggcttctgatctccagacctctcatttgcattgattctttaaaatcatctctaccttaatgttctgtagacatttcaaaatcaacatgttcaaaatcaaatttattatctatctccccaaatctgctctctctacttctgatgtttactgttcattaatggataacagaataaccatcaaatcatgtaagtggagagaactcagtgttaacctttatttactccctcttatttatccccatctaccaactacagtatctataaaacacattcactcctttctaccccattgcttttgttcaagatatcataattcctctctttctttgtggtaaacatgaaggtgtaccatccagttctacctccaaagaaagacttcctgttggccgggcatgatggttcacgcttgtaatcgcagcactttgggaggccgaggtggggggatcacctgaggtcaggagttggagaccagcctggccaacatggcgaaaccctgtctctactaaaaatacaaaaattagccgggcgcggtgatgcacgcttgtaatcccagctactagcaggggctgaggcaggagaatctcttgaacccaagaggcagaggttgcaatgagctgagatctcgccactgcactccagcctgggcaacaagagcaaaattccatctcaaataaataaataaatacataaataagaaaaaaaagacttgccgttcagctatagggggaatagccagcagatagcttccgcttgcttcagttctttcaatgtctgcctcagctgtagaggacagtcctgcacaagatcatgcccatcccagggctgccctcactcggtgcctaagcaaggcaggggtataaaagttcggtcattttggccaactgcaggacaactctgagaataggttggattgacaagggctagccagggctggaaatattcactccagagctccctgccagggaggctgggtctttgtcagatctgcattgccgtttgacttctctcttagctcagccctacttcttccccctggtaagcatcttgcacctcaaactctgtctcagcctctgcttccagataacccaacttgtgtgtgtgtgtctctctctctttcaaaattgagaaattttctcaatcttgtctggaccatggcagcagcctcctcctaagaaattgcctctaatttctccatattttaattcatcttctacatggcagtaagaaacacagatctaattgtgtcattattccgttttttgttgttgtttgttttttgttttttgttttgttttgttttgttttgagacagagtctctctctgtcacccaggctggagtgcagtagtgtgaacttagctcactgcaacctctgcctcacaggttcaagcaattctcctgcctcaacctcccgagtagctgggattacaggcatgtgccaccacgcccggctaattttttgtatttttagtagagtcggggtttcaccatgttggtcaggctggtcttgagctcctgacctcaagtgatctacccgccttggcctcacaaagtgctgggattacaggcgtgagccaccacgcctggactgttttttaaatttctcattgagttaaattcagaatcctcaaaatgacattcaaggccttgcacaatgtggccccaacctaattttctaatttaattttaattttattttattttattttattttattttgagatggagtctcactctgtcacccaggctggagtaaagtggtgcgatctctgctcactgcaacctccacctcctgggttcaagctattctcctacctcagcctcccaagtagctgggattgcaggcatgtgccaccacgcccggctaatttttgtatttttagtagtgacggggtttcaccatgttggtcaggctggtcttgaactcctgacctcatgatctgctctccttggcctcccaaagtgctgggattgccggcgtgagccactgtgcccggcccctcaaattttattttctaccatttctctttagccactgtgccttagattatttattttaaaagcatatttttaaatgacggaagtggtacaacaacagcaataacagagaagtttacaaagaaatttcataaaggaaaaacggaacgcctcctgctttctcattctccccaaatccttactccagaggtatgctaagattattagttgcaagcaacagaaaccaattctgccaacttaaggggaaaataagtatattggaaggttattaagtaatcctcagagttgatgggaaagccagataatcaagctcagaaagtagaaccagggaccacagccaaagtcacaccacaggaatggtattaaggatgccacagctggaagcactacctccatcaccaatgctgctgccatattaaaggaattctcctctgaccctgtgtctttacatcatttgttcaagagtcaatatcctgagtggaagcagccaaatgaccaagccttgatcatgttgcttttgccttagctgcaagtgcaggggggaaaaggaaaactttagatacctttgacttctcttgtgggaggtgagaacctgtctcccattaagactcacacagaggaagagatttcagatgctgggcaaccaaaacaggtacaggtgattttaaagaattgatgcaaatgagaagcctggagatcagtagccactgctgtatttactaactctacatatattatcttttttttgagacagactcttggtctgttgcccaggctggaattggtggcacgatcatggctcactgcagcttcaacctcctgggctcaaaaaacagaacaaaagaaaaataaaatagaaaagcaaaaacaacaaaaacccataaatgttcactatatctcacatcattaatttatttactcgtttaataaatgtttgtcagaaacttccatatagaaggctttatgttatgtactttggaagacacaaaacgattaggatatgatccttctcaaggagcccagtcttttcttgggaagataaaacatacaaaagagaacaacacaaggcaagatgcattgtataactagaagaaacacacaaataaaaatgtgatgttatgtggccgggcatggtggctcacgcctgtaatcccagcactttgggaggctgaggtgggcagttcacctgaggtcaggtgttcgagaccagcctggccaacatggtgaaaccgtctctactaaatatacaaaaattagccaggcatggtggcacgtgcctgtagttccagctactcaggaggctaaggaaggagagtagcttgcacccaggaggcagatgttgcagtgagttgagatcgtgccactgcactccagcctgggcgacagagcgagactccgtctcaaaaaaaaaaaaaaaaaaaaaaaaaaggaaagaaagaaagaaaaatgttatgctctgatttactcttgtagctatcatttacatattgctatatagtttttggaattctgtaacttgcgtttatcatttaatactctctttggtcttgtaagatagatataatcattttagattaggagacatgtttagggagaataagaaagttaataactgatatggtttggatgttttgtccctccaaatctcatgttggaacgtgacctccattgttagagatgggcataatgggaggtgtttgggtcatgggggcagatccctcatgaatggcttaacaccatcctttagtgttgagtgagttcttgttcagttagattacacat

SEQ ID NO: 17762 - DNA, 67126 bp, Homo sapiens
  misc_feature (1)...(67126): n = A,T,C or G, or insertion/deletion polymorphism (see Tables 1-2)
aaggcaggtggatcacttgagtccaggagtttgagaccaccctgggcaacatggcgaaaccccgtctttactaaaaatacacaaattagccaggcatggtggagtgtgcctatgatcccagctacttgggatgctgaagcacaagaatcacttgaacccaggaggcagagtttacagtgagccaagatcacaccactgcactctagcctgggtgacacagtgagactcagtctcaaaaaaaaaaagtagaaaactcatcaagctgtacagctaagttctgtatacctcatatatgaatattatatcttaattaaaaggaaaagtctattaacaaaaagagttctcaaaaatgctcaacctgaacctccttagggggttggcagaagcattaactaaagctctcctatatttcaccaaaatgtgttggcaattcgtagcctgctggaggaagggaggtgtgagctgttccctgtgttcagctggacagcctcccactctctataggcgcttcttttagagccagctccactgctggtcctggaggttttttggggaaggcgatcaaaaaatttacaatgtccatgactactatagggaatagttctacgatgctggctgcgaaaaccagatcaacttattaggcacagtagacacagtgataattttactgtcccatgaaaatgttttaattttaatttcttttgaaatcagaacaaaaataagaatactgtaataatgagcatataataatgaattcagccagcgttatatgtgtctttataatgcaattggaaactctcattttaaatttttttttttgaaggaaaaaggggtccttaaaggcaaaggtgcctggggcccacacaagtcataatgcagccctgagtaaaaggaaaggtgctagggactgaattgtgctcccccaaatgtcttgtgttgaagccctaaccccccaaggtgactgtatttgaagataaggcttttaggaggtaattaaggttaaataaagtcataagggaggggccttaattcaataggattgttgaagaagaggaagagagagagaaatctttctccctgaaagcacacacttaaggaaacaccatctggggacacagggagaaggtgctgtctacaagccaggaagagagccctcaccaggaaccaaataagctccccatgctgawcttgaactctctaacctctagaactgtaacagataaattcctattgtttaagtcacaccagtctttggtattttgtgcaatggcctcagaygtcactaaatgacattgattacattctattaccccaaaaccctagttctatcttcattttctgttattgaactttaggcttcaggttaggaactaggcaagcttgcaatttgttaggtaggtaggcattctttttttctctgcctatttgaaggactacctactttgaaggttgcagatcagcagcagaaaaaaattttttaaaaagctttttaaaaaaattttagaagaaatcaaaggtttttttggtaataaaattttattggcttggcatggtggttcatacctattatccagcactttggaggctgaggcaggaggatcactttagccagggaggtcaaggctgcagtgagctgtgatcatgccactagactacaacctgggtgacacagtgagactctgtctcaaaagaaaaaagaaaaaagcacagaaaaataaataaaattacttataaatgtgtgaaaagatttttaatctcacttataattaaagaaatacaaatcaaagcatcctaattttattttatttatttttttttttgagacggagtcttgctctgtcgcccaggctggagtgcaatggcgtgatctcggccactgaaacctccacctcccgggttcaaacaattctcctgcctcagcctcttgagtagctaggattacaggtgtgtgccaccacgcccagctaattttttttttttttttttgagacggagtctcgctctgtagccaggctgcagtgcggtggggcgacctcggctcactgcaacctccaactccctggttcaagtgattatctcacctcagcctcccgactagctgggattacaggcatgcaccaccacccccggctaatttttgtatttttagtagagacggggtttcactatgttggctaggatggtctcgatctcctgacctcatgatccacccacctcagcctcccaaagtgctgagattacaggtgtgagccatcacgcccagcctaatttcttgttgcccagactgcagtgcaatggcgcaatctcagctccctgcaacctccgcctcccaggttcaagagattctcctgcctcagcctcctgagtagctggaattacaggcatccaccaccatgcctggctaattttttgtatttttagtagagatggagtttcaccatgttggccaggctggtcttgaactcctgacctcaggtgatccacttgcctcggctcccagagtgctggaattgcaggcatgaaccaccgcgcctggccaatttttgtatttttaattgagacggagtttcagcatgttggccaggctggtctcgaactcctgacctcaggtgatccacctgccccggcttcccaaactgctgaaataataggcgtgagccaccgtgcccagccccaatattttttaaaataagaaacaaaataaataaaatcacagattgcatttaggtacttccatacattgctggctgcaatttctttggagggcaatttgacaacaatcaaaacttaaatacscatttcctttgatccaacaatataaaagtatttccaacagttctatttgcgcatgattgcaaagatttacatccaagaatgggccaggagtgstggctcacgcctgtaatcccagcactttaggaggctgaggcaggcagattgcttgagcccagcagttcaagaccaatctgggcaacatggtgaaaccccgtctctacaaaaaatacaaaaattagccaggagtggtggtgcacaggtgggaggatcgcttgagcccaggaggtagaggctgcagcgagccatgatcatgccactgcacgccagacttggcaacagagtgagactctgtcccagaaaaaaacatttttaaaagatacaaggatgttcattgcatcatttccagtaacaagtgacaagctaaatgcccaagaagagactgattaaataagttacatagtggatcaaaaattattaacgtaagtatttctagccttcccctaccatctgccagctacagataatttagtcttgggtcaactttctcctctccctctacaagggaaatgttcaaaagtgtttagactttggtgatgcagcatgattgggaaagyagagggcacagaaagatgccaggctttgtggtctccaggcaagctcaggaatgtgacaaagcataccgaaaagaaaagcgggctgggagcagtggctcacgcctgtaatcccagcgcttcaggagtctgaggctggtggattgctggaggccaagagttaaagaccagccaggccaacatggtgaaaccccatctctaatgaaatccaaaaaaaaattagctgggcgtggtagcgcacacctgtaatcccagctactcgggaagctgaggcatgagaatctttggagccggggatgtggaggttgcagtgagctgagatcatgtcactgcactccagcctgggagacagagcaagactctgtctcaaaaaaaaaaaaaagaaaaaaggaaaaggaaagataaatttataatgtattgccaggaccacacaaacccttcatatgtaccaggaatgcaagtagaggaattgagttattttgaaatacttgttggctggtgatttatatttcattgatttagacactgctctgagtatggcttcagaagtgttacatacgcataataaaatcctttacagctattaaaaggagtgaggtaggaaagcatactgctaaaagcaaagaagccagatgagaactgtgtactgtacatccccacttgtttaaaacgtttgtatattatattcacatatgtatgctttccactacatagaagttttctggaaggtatttctgcacatttataaagatgcacatctaataatttcatttccccccattttctacttattgctctgaggtcaacactgaatagtccttatgaagatggtattgaatattctttcaacaaaaaagtctccggatctcaactactggagctcagaaaacgataccccaaagtaggaggctttggcatgctaagtactttgaactaaaggagattaggtctcagtagcagcctcagaaacaaagtctacccatgactttctcctgccctcctgtctccagcggtcttgcacccctgaagtaagtcacaggaaccagaattcttcttccccaaggagggttatggaaacttagaaccttcaaagtaatttataaacttggaaatcttactgtaacattttcttctacctctctctgtctttgagacagggtcttgctctatcacccaggctggagtgcagcagcatgatcatagacaactgtagcctcctgggctcaagcaatcctcctgcctcagcctccttagtagctgagactacaggtgtgtgccactatgcccagctaacttaaaaaaaattttttttttgtatagagggagtcttgctacattgccctggctgagaatttacatttctaacaagttccaaggagatgctcctgctgctggtctggggatggccgtttgaggatccctgcatgaaggcatacacaggacttgatcctcagtgggggcaccaggagctggagcctggggagtgggaagcgagagcacagagctgactgaggaccacgaggtcgtcgtggaggacctaggctgaaggtcctgaagaaatccccatagtttcactgccaggccagccaggtggacatctcagggctgaggaggtgagaaggcaagacagaaagtgaaacagcactttataggatagggatgggaaggtcatctgcatcatgggactccttggggaggggttcggtcattgctccagatgaaggtttagtcttttcatcgtaaatttgctttcactgttgggaaagagatcttcacctccattttcttaacttcaaaatggaaatgacagatgcttttgagtggtctgaatacttgaaatttgagggaaaacgttaccagaaacacatacaactagagttaaagataaatacatatatcaaacgcatggctcaaaaatgacaacgcgtcttctttatctgccttcacgtagaacttaaaacagaccctggtccccacctcggggtttcctcgcgcccacgggctgcgctgcgcagctgggccagcaggtggcgaggctcccgcactttttttcccgggcctggccgcaccgccaccgcccaccccgcgctccgccccgccccgccccgccgcactcgcggatcgtcacacggtcaggccaccgcgcgtcaccgccccgggctctgctagaaagtgccggggtccagattcctttcaggtgactgggttgggaggagaagtcgctcagcgtaattgtcggagccgaaataaacagagactccgcggccgggcgggaccttacccggaagtcccccagaacagcactacccttcgctgaaacctcgcccgccccctccaacccagagacgaaaagggaaagcatcacggccagaaaccgttggcacaactccacagatactctcccgggccgagccagactccataagtcccgcgcctggcccccggggattgcaggggctgaggagaagggcaacacggggaccttgaagcggggtcgcggcggcgccccagcccgggccagggagtcccggcagcggcacctcccagaaagggcggagccgacgacgccttcttccttcctgaccggcgcgcgcagcctgctgccgcggtcagcgcctgctcctgctcctccgctcctcctgcgcggggtgctgaaacagcccggggaagtagagccgcctccggggagcccaaccagccgaacgccgccggcgtcmgcagccttgcgcggccacagcatgaccgctcgcggcctggcccttggcctcctcctgctgctactgtgtccagcgcaggtgagcggtcgccggccaccgggacgccctgtggggacgtggcggggccgagagccggggaaggcgacgggcccagcgacggctcaggcccgggtcctggggaagttggtctggcgatggagagctcggaggttcctcacttgtcctgtttctgtctccggccacgctctctttcctgtggtctggaagagggtggcagtgggggcttgggtgacctgttctgagcttgttccatctgtggtcacctaatttctctgtgtaggatgtggcaccagaagaagggaggaaagtgggtagagtgggatagggacactacttgctttttaaaaaattctgctacatgcgcacgaactccaaaatttaggagctctaaccactttatttcctcttctcatcacctgaggatggaggtggaagcagaggtaaagagacacaaacttcctcaagcacccggtgaaactgccttgagtacttgacataagtcagcttggtcttctaaagagggcaggttacttttcatcaactcctttttacacctcaggacactgagactcacagggcggtattgaatttccccttgtcactattagccagcgacaggatggggcctggaactcggtgtcctgctgactccttctgggggcttttgcttggtttaatagctttgggaaagagcacctcagtatttgtgtgtctgtagtttcctcttttaaaactggagtggggcagtgtcacgctgtgactcgttaaaccaaatcaggatgagagtgcctccggggaattgtgtccttgtgcacattaacgcccctcacataggtgtggcgtcaataggaagtggtgartcaggggagagggggttccgtggactagaaaaaactctccttcgacttctatttagttctcagaaggggataggtgatgttgatccaataatggactaagagccaggagaagggctccgcgggaggatctcttgagctcagcagttcaagaccagccggggcaacatggtgaaacaccgtcttaaaaacattttgtttttcttttcattgttgaggttgaggctgctgtgagctgtgatcacgccrgtgtactccagcctgggcaacagagcaagaccctgtgtcaaaacaaaaaagagagagaaataaataatagcaattatgtgccktagagaaaatgtggctattctgtttccctagagttttttaaaatttatttttaaaatttatttattttagagacaggttcttgctstgttgcccaggcgtgggggcagtgtcgccatcatagctcactgcagcctggaactcctggcctcaagcagtccttccaccttggcctcccaaagcactgggattattgtgagcaccactcctggcccctcctagagttttagatcaggaccttaaataggcttcccttttttttggagacagagtctctgttgcccagtctggagtgtagtggcgcaatctcggctcactgcaacctctgcctcctggattcaagcaattctggtgcctcagcctcccaggtagctaggattacaggtgcccaccaccacgcccagctaatttttgtattttccgtggagatggggtttcaccgtgttggtcaggctggtctcgaaatcctgacctctagcgatccgccctcctcttttggggattacaggtgtgagccacctcgcccagycaggcttcacattaytaagtagccrtctcttaagtattttttaaatctcaagtacccaaggctgatggccaatgagtgcttcttttatgacastkgggataggtcagaggtttgttgsaagtctcttgcaaaartgcctggaggccttttcaaggtctgtaaaccttaactggaaataatcctattattattttaaaaattcctcatgtctgaaagctttcagtgcacctgaacagattggggtggagccatgaagccaaacagattgggagagagagtgtgtctgcttttagaattcgtaccgatgatagcagctcattagcttcagtctgagcgctagtagagttctatcatggaattatggactagttgtcctgtgtaagatctgaaatacatgttggggggatttttgctttttcttaatgttcaatatgtacagatgatgtaataacattactagactgccttgtttttaaaaccctgtagtcatctaaaaactatatgcagttttgagacatagcctttatttttcccggctgtaattttggtaagctttatcttgagggacttggaacatagagaagcctgggtagaaattaagcattaaaatggcttttcctcagaagactgggaatggttaatcttttgacctgtgagtgattaagaacaaccatctgaaattggaatgactgtgggaaatctttccccatctttcccactccttgactgatgctgtgatcagaaattttactaacataagtaatcaaggggaaaatgagatttttttaaatttgagccagtgggcagagggaaaaggactcgctgaataggcctttgtattcctccagtgtttgttatattacccagaacaaagaatcactctggtcatgaagacagtgtgctctctctttcctgggtaaccctccactcctaaaagggatgcagtattctaagcatggcagattacctacagcggaagcctggatcagtcatctctgatctcgggtgcccctttctgscctttgacctccagctctgtgaagggcatcagctctccagtcaaattgaactgcttgctagcaaaatcctgcccatcttccagggccccatttcacatgctamattatctacgacatycttgtcctgttsccctaactagaatgccttccctctgaagttctgaatctttatttaaactgctgcaacagcatttgctgcctcattaaaagaccttggtgtgggtcttgactcttctctgttcccaagagtgatcttgggtaagccagttatcctctggagcctcagtttcctcctctgtaaaattggattaactgtgccaactatgcttgtgaaagacaaatatttcctaattgaactaccgaattgcaggctccttaagagcaataactgttgctctccaatatcatctacaaatgtggccaggacacttgacttgggactctttttttttttttttttttttgaaacagggtcttgcactgtcccccaggctgaagtgtagtggtttgattgtggctcactgaagtgttgaccctgggctcaagctatccttccacctcagcctcccacgtagctgggrctgcaggtgcatgccaccatgcccaactaatttttaaattttttgtagacacaaggtcttgctgtgttgcccaaggtggtcttgaattcctgggctggagatcctcccaccttggcctcccaaagtgctgggattacaagcatgagccaccgtgctggccctggaatcttttttttttttttcaagaccaggtcttactttggttgcccaggctggagcgcagtggcacgatcttggctcactacagcctcgacctcccgggctcaggtgattctcccacatcaagcctcccgagtagctgggactataggtgtgcaccatcatgccctgctaattttttgtatttttagtagagaaggggttttgccagcttgcccaggctggtctcgaactcctgagctcaagtgataccatccacctccgcctcccaaagtgctgggattacaggtgtgagccaccatgcctggcccactgggattctttgatcataagatatttgggccttgaaatggattttggggagagacttagaaactagtggcaatcaaaattggatttgcagttggtttctaggtgatggcagtgatcagctgcggccagccaggtttttcttcatctggactgtgcctctcactttcaaatttttggaacatttgctttggcarcaaaactttyaaaaaaccaactctctctggtgcaggtgttctgttggaggatttgagagaagctttaaaattttatcttattactgtcccttgcttaggtcacaagaggagctcaaaataatttcataaacatgaattggcttccctagacacaacaaaggataagatcaaaagaattaacccatttaaaaaaatcagtctaggctggtcctaaggtagtgtgttatcaattgatcaaagtcagttacagatcgaactccttgatctactctttcctcctgctcactactgcacttgactagtccaaaacaataagtaagtagtaaaaaaaagaaaaaaagtccgtctatacactgtaaagtgctgtgtaaatgttcataattactatcactgtcttcttcatagttgatggrgggaaggctggatacataaaaaaatggtaatacagtaagaagtgctcagataagaataaagataaaatgttatggagagtccatttttgagctgagctatggaggatgaattaatgtatcaggtggacaagaggaaaactagagaaaatagtcgggagagttgcctaattgttgccctaaactattgaactgttcacttgaaaagggtgaattttatggtatgtaaattacatgagtaaagctcttaaaaaaatttgcagggtgctatatactagattacataagactagagacaaaagctacccaaattttgcatagtactccattgctatcacatccgatcttgttttatcctcacagagcccctttaaggtaggtgtaatgctgtttttcctattttatagatgcagacatcaagggtcaaatttgtcccaaggtcacatagctagtagatggcacattgggtgcttcaactgccatcttctgacttctgtgccctagttttttgaaattcaaggctagattattggtgtttagcaagcttaattgaatgggtgttcagcagatattccacttggttagtagagcagtctcattcaaggcctggttccgtccccagtgtggctcttccagtagtccgtaatagatcaggaatgggtttagcctgctggcctgacccctgattcagtcaccacactgtgaacattccatagggaaaaaactgcagacagtgtatactgrcacccactttcatagttttgttttagttttgtggctcctaaatgtctaagactaactagtaatatgaccttgggtgagtcacataaaaaaccagaagctaaaggggttatctgtaaaacgaagagttggactagctgagcacacctagcactcaaaatatatgacttaaacacccacatgcaggcaggcctggtgcacacacaaattatcctttgttatgtagatacgttcatgccaggttggctataaaacacttccagagatttccgtcaatagaagtcagaccagcccggcagcctccaccctaaatgccctgccatatttgtttggtctgcctccctgactccaaagaagcagcaggcagcttaatctctggacaggattcttcatgccactccctccactccagcctgtgttgtcctgactggccaggccagcctctgctctctggagaagcaatgaggtagggaagttaaccagcaagcccctctcctccatcgcctcactggagcttgagctgggtatctctccatgttttgccattagctttacccatccaggacaggggcacaagtgttggtgccaagccctgcactcccagctctggtggatggccaagtcctaccctggggttgaggactgtcagtgatactgagtaagggagtcattgcttgacaactgcctagagagatactttaaaagataggaatgggaggcattatttctacaagtgaacaagtttatattgaaggaacacttgtataggatcatcatggatgggacagttcatctccagtgcattctccaattctgaggatacatcactgcacaaactggactagagtttaaatggtacagaagctgggggtaggggaggcaggaggacaagggggatgggtggagaatgcttaacttggtgttcaaaatcatgttatttatgagccatgtgacctcagagtatctttgagcctgagttcacttacctgtaaaattctgctgtgctactgcatagagtatctgagaaaatgaggcatgcagtcgatgtttggtatttttgtttcatttatttattttactgccatgcctcgagaacaatagatgttcaktaagtatttgaatatgttagttaatgctttaggatttcctaaaggcagtggaatagaattctcactgagttcagagcttttctgataataatgtgtgcttatggagctcctgaatggggtccaatttagcagttgctatagttgctgagatatagcacaaggggcatttttttttttttttagatggagtctctctctgttacccaggctggagtgcagcggtgcgatctcagcttactgcaacctccgcctcccgggttcacgccattctcctgtctcagcctgtagctgggactacaggcacctgccaccatgcccggctaattttttgtatttttagtagagacggggtttcactgtgttaggcaggatggtctcgatctcctgacctcgtgatccgcccacctcggcctcccaaagtgctgggattacaggcatgagccactgcacctggcctagaaggggcttttttttaacctttcctgaactgttcctrtcgttgaaagaagcttccctatccagtcattttcttagtaattaaactctagagcatgttgtgaaatatccatatgatctaacctttaaaaatagaaactctttagctgtgtaactactaaattctgggtagaagccaaaacaatcagcacttctcatttctgaacttagataatccagttgtactccctcagctcattgtgagttttgacaagttctgcatccatgaacaccagatgtaatacaatagggaatttcaaaggaaggattacacacctaggctctgccctctaggattttaccgtcttacaagggagttgagacaaaagtgagaaaatactctggcaacttctcccaacatcacaactttgcaattctcataaattttgcttgatcctagggcatgaccaaggcagaggcaggcaggtcctacttcatgtgggagagaaggaaggaagggtaggcagttagagtgataggtttggaatactgtagaaaggagagtgggcagagccagagtgaggtgtctgaagcttgtcgcacaggcagtgggaagggtgggttggaggtttctgagcaccagaaaactttgagcattgttccggaagaggcaagcggcaggcatctgcaccagagacactgccgggtccgagtgagggcaggaggctgcacgagggagcctccctgggagtgagcgataggttcgctatgggaggtgggttygaaaggtgcctgagattttcatttgaaactctgttgaagaggaattggcaatagaggaggaaatacaaatagaggaaagattggtttcgtcttaagcactgaggctgttgggcagctagtggaaagtgctgctggagagaagctggagatcactgaagctgagagaggggtttgtggatataattagagcagtgtttctagggaggtgcaggtgaagggactgagagagagatgaggttaaaaacacagaagagaaagagatggaggtgtggaggcccctgaggtggagcagctgcagaggcaggcctgggggccaggaggctggctctccactttcagctgttggtgagaagggagtgaaggctgagcagctcccattgtgcagctgttgagtgcacaggtgctcgtgctcttgcacacggtggggtttggggagggtgtgatgctacagggaggactttcatgatgcagctgattctcttttattgagagtctgtttctggagtcacctgctctgttttgaatcctggctttgccactgtgaccttggacaagttgtttagcctcagtgccttcgtttctgcatctgtaaaaggggtataataacgcctccctcatcaaactgttgtaggattaattgggttaacatattgagaggtgacagcgtgctggcagtcctcagagcccttgcttgctctcggcacctcccctgcctgggctcccactttggtggcatttgaggagcccttcagtcccccactgcactgtgggagcccctttctgggctggccaaggccggagcccactccctcagcttgcagggaggtgtggagggagagacacgagcaggaaccggggctgtgtgcggcacttgcgggccagctggagttccgggtgggcgtgggcttggtgggccccacactcggagcagccagccagccctgctggccccgggcaatgggggacttagcacccgggccagtggctgcagagggtgtactgggtccccccagcagtgccggcccaccggcgctgcgctcgatttctcgctgggccttggctgccttcccacggggcagggctcgggacctgcagcccgccatgccagagcctcccaccccctccgtggcctcctgtgcagcctgagcctccccgacgagcgccaccccctgctccacggcgcccagtcccatcgaccacccaagggctgaggaatgcaggcgcacggcgcaggactggcaggcagctccacctgcagccccggtgcgggatccactaggtgaagccagctgggcttctgagtctggtggggacgtggagagtctttatatctagctcagggattgtaaatacaccaatcagcaccctgtgtttagctcaaggtttgtgagtgcaccaatcaacactctgtatctagctgctctggtgaggacgtggagaacctttatgtctagctcaaggattgtaaatacaccaatcggcagtctatctagctcaaggtttgtaaacacaccaatcagcaccctgtgtttagctcaaggtttgtgagtgctccaatcgacactctgtatctagctgctctggtgaggacgtggagaacctttatgtctagctcaaggtttgtaaacacaccaatcagcaccctgtgtttagctcaaggtttgtgagtgcaccaatcgacactctagctgctctggtgaggacgtggagaacctttatgtctagctcaaggattgtaaatacaccaatcggcactctgtatctagctcaaggtttgtaaacacaccaatcagcaccctgtgtttagctcaaggtttgtgagtgcaccartcgacactctgtatctagctgctctggtggggccttggagaacctgtgtgtggaaactctgtatctaactaatctgatggggacgtggagaacctttgtatctagctcagggattataaacgcaccaatcagcaccctgacaaaacaggccactcggctctaccaatcagcaggatgtgggtggggccagataaaagaataaaagcaggctgcccaagccagcattagcaacccgcccgggtcctcttccatgctgtggaagcgttgttctttcgctctttgcaataaatcttgctactgctcactctttgggtccacactgcttttatgagctgtaacactcaccgcgaagatctgcagcttcactcctgagcccagcgagaccacgagcccactgggaggaacgaacaactccagacrcgctgccttaagagctgtaacactcaccgcgaaggtctgcagcttcactcctgagccagcgagatcacgaacccaccagaaggaagaaactccgaaaacatctgaacatcagaagggacagattcyagacgcgccaccttaagagctgtaacgctcaccgccagggtccgcggcttcattcttgaagtcagtgagaccaagaacccaccaattccggacacaatgtgaagagcatttaaaatagtgcctaagcctaggacaccgccagtgctttgtaagtctttgggtcctgctggcttaggttgcttctttcggcaggatgactttttttttgagaccagttttcactttgttgtccaggctggagtgcagaggtgctatctcagctcactgcagcctcaacctcctgggttcaagctgatcttcccagctcagcctccggagtagctgggactatgggcatgtgccactaggctcggctaatttttggctgttgttgtttttgtttgttttgtttttttgtttgttttttgagacagtttagctcttgttgcccaggctggagtgtaatggcacaatcttggctcaccacaacctccgcctctcgggttcaagcaattctcttgcctcagcctcctaagtagctgggattacaggcatgcaccccccacacctggctaattttgtattttcagtagagacagggtttctccatgtcggtcaggctggtctcgaactcctgacctcaggtgattcacctgcctcagcctcccaaagtgctgggattacaggtgtgagccaccgtgcccggcctgttgttgttgttgtttttaagagacagggtttcactgtgttgcccaggctggtctcaaactcctgggctcaagcgacccacctgccttggcttcccaaagtgctgggattataggcgtgagccaccacttccagccaggatgacttttttttttttttttttttttttttggtcttctcwgctgtgtctctagaagatgaccttttgagaagcaaacctgaatgttgattcaagcccaaatttcctgggctcaggtgttaattttttaagtctttggaacctctttgccgaggtctcaagcaggtagaagacattaataataattccttatatttgattgcgtggtgctctgtagtttactgagtacttactatatatgtacagataggcccttatttgatcttcacaggaacctgtgaggtaggcagagcttatgagcttcatttcccaggtaggaaaactcctacgtggttacgtaacctgctccaggtgtgatcccaggtgcaatccagctcaacaagcacactgagcctcaggagctcttgggatcagaacccaggactcgatcccactccgtgccgccttctcacccacccctcttccaccaagtgggtggaaatagcacttgctttgaaataagtaacgaatgatctttgtgaaaaggaacctaaacagcagtgggccatctttattcacatctatagtaccaagtgctgagtaaggggattttagactccagacacccgtcctgtttgtcaggccagagctgcagtgtgttgactgcacatctgtctcttgtcactcctgctcctgtgggtaaccagccagagtgcccctgaggcagagacaggccaatccctggagagttctgcgaggtctagggaagagttctttgtatttaaaatttcatgtgaacttcagcagtttcctctgcctctgtagtcagcttttgccttttcaaactttagttagatggataatgacttttactcattaggacttttttccattagttggaaacccagagttgcaatacgtttcttttttccttagaatcaccgggtttatgggaataacaattgggattctctttatataaaaatagtggtggaatcttggcacagggttcatatgtggctttgttgaaggcttgttgtcacttccttatttgtataatttccctcctttgtggcctaaacatgactttcaaagagtcaagaggagttaagtcctaatttttattttagaacatctgaaaaatgaattcagagaaaagtgatattgatgccttggatttccccacacatacaaatcccaatctcctgctgactttttctcatgtttttgggcttcagggactgttgtgggatttgtattttgatactgaaggaccaacacagactgacttagcttcttgcctgtgtgcaggtcatgtgccactgtcactggagagaatttcatgttgtgacttctgttcagatttgttttttttttatggctttcccatcagggttcttgggagccatggctgcttcttgatatcttctgtttccctgtagaacagacgattgcaggcccggggccctggcaagctgggccctctgtggctttctgagtccattgtgaggcagaggatcaggtgcgttttgggcagcagccttcagagcaaggcactgacctgatgattcacactgacccctcccctccgctgaattttctgacaaccttgtgactctcacatgggaaatgtgagtggtttttgagaaatctttacataagaggttttaaaattttcttttgagattgcctcggtgtttttccttaaagttagcacattctttgctttctacttcagcctcaaggacaggaagttcattctygctctttacattggggtgttgatgtttgtggttttgttgttttgttcttcatgttactcatgatgtattgatattaattaacctaaatacatatggaaatattctttcattacttagagcttatatagttcctggtgcagatgtgcaaaaatagtgctttagtaattgctaagtcactatcttgcttttctctctactgtgattgagtatttcttacatggaactatagcttcctcttatcaacaaataagcaggaaatagaaattatgtaaataagcaatttccattacctacttcactgacttgacaaataggcatttggtctgctttaattaatatttttcaaaatgttaagtgcctgttgctgttacttaattttgcaggtagcattggaagtttctgtgattgtacttgagtgggcacttcttgttgaaatttaccattgagaccctggtaacactgaagtttgtgttgactttctgtaggtgttttcacagtcctgtgtttggtatggagagtgtggaattgcatatggggacaagaggtacaattgcgaatattctggcccaccaaaaccattgccaaaggatggatatgacttagtgcaggtaagttcattatcttaggcactgggaacacaaaatgctgatcacaagatcctctgtaattattccttaaatgttattgcagggtggaggtggagatgagactaacaggcttaagtcttatcccggactctcaaactctaacctgtrgcatacagtgcagagaaagaacaccgtaactccaaaggcttaatttttcaggggctgactttatacctctcataaagtttcccaatagcaggttgctatttagagactgaccttggtacttcgtatgttgcccttgcagcatctgcaaaatatattagaagttagctggttttgattcctagatttcaggactcaaatggactctgttgctaagtggctttgacgtccttgtcccctggtcatttcagtgttttctctgtgttccactgagagcctgtgaattttggctgctaccaggattctgattcctgttctttttttaccatcctgtgatacacagggatattagaactggaaaaatcatgtgaaaagcctggttttagaggcttaaagtaatcaaaagtcaagtcgacatgataacagagttcctaggctcacttgttcgtttcttttctgtttttgagacagaaggagccttgctcttttatcctggctgaaggctagagtgcagtggcacaatcacggctcactgtgtcctcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggcatgagccacrgtacctgtcctcacttgctgctttcatcataattattaaaggtttcaactttccctggaattactaatagaaatagtaagtagcactctggttgaattgaatcaaacaaacaaaaaaccctaagaagacataaaatgattgtcaggagaggagagaaagcttccaaataaaaagaaaattagaaacatctctacttgtgaataaatagtaaatgtgtagccttttaaaataattctataataactttgcaaatacaggatgtgtcttacccttttgtacttcaaaaggattacrtgaatgaatgtgtcttagttcactgaggaatgttgaccttactctaactgttgcctactcccgtgtctgtgctctttcacctgaaaggaactctgtccaggattcttctttggcaatgtcagtctctgttgtgatgttcggcagcttcagacactaaaagacaacctgcagctgcctctacrgtttctgtccaggtaggttctgctggggaaacagaacaactgggctgtagatacttgtgaactggtaatgctcagctttccatttattctttgtttacatatttttatttattatatgtctatattatatgtatattatatatttatacatatatgtatacatgtaaagtaggtgaatatatatttatgtattaaaaatacatgtatgtataatgtgtatgcatgcgtgtgtgtataatagagacagagtctcactctgctgcccaggctagagtgcagtggtttgtggtgtgatcacagctcactgcagcttaaacttcctaggctccagtgattgttctaccttagcctcctgagtagctaggactacaggcatgcactaccatgtctagctaattttatttatgtttttctttatttttttttttttgagacagactcttgctctgtcaccgaggctggagtacagtggcatgatctcagcttactgcaacctcctcccgggttcaagcgattctcctgcctcagcctscccagtagctgggactgcaggcacatgccaccacacctagctaagttttatatttttagtagaggtggggtttcaccatgttggccaggctggtctcaaactcctgacctcaagtcatctacccgcctcagcctggttattacaggctgggattacaggcatgagccactgcacctagcctaatttttatttttttctagagatgagggtctcactatgttggccaggcctggtctcaaatgatcctcccaccttagcctcccagagtgctggattataggtgtgaaccacagttcccagccagttttttttttttttaaagtcagtttttgttttgttttaagaaagcactcttacaatttgtcagaaataaagagaaaaacaataattaccagacttggttcacttcccagttgcattcagagttgatgcttggtttcctctgcgatgttctcaccctgcagggtgtctgcactgcggccaggctcctttcaaacttgagctgtgcactgtggggaagagaggttcctaggggtcctgctcaggtgcctggcctgagactctcatcatgcagtccttcctctccccccatgctttgctttgcacatcattcttgtccctccctctggtgaagggttgtgatagagtcaggtcctcagtagagcyggcctcggggagctgttaaaaattttgttctgctgtagctggctggttttgtcaaacttagttttttatctgttctgttggctatgaccctgagcagtgaaaaagggcttggtaatagatgttcttctctaggcctagccagcaattctcaaatatgcaaaagagcaagctggtagtggtctttagaacagcagattgtggtatctttctaaatttttcagacttcagcacactgataaagatgtttgggaagcaaatattaaaaagggaaaatgcttctctgcacaaatatcactgcaggtggtgatagggcacaagttggcttccagtgaagaaattctgcttcttaccaaaagttaacaatagagaatggaaaaccaccactaaattgttttttcagaacaacaaaagttgaggctgtaattgggccagcatatcctatgaaaggcttgtgaacattgatggaaccaaattggagccttgtacactcagtcaaaacacatttatttaggatccaccgtaggtgaggcattatggacatacggacataaacataaaaagatagccaacctttctccatattatcagaggtaccaaagcttgatttataatagcaaacaggagaaacaacctgatatttggaaaaatatacagctgtcaaaattagtgattgtgggcattaaatgtagtaacatggaaaaggtttgaaaactgtgtaccccaagagtgattcctattagaataatacaattgtggtttctggctttgttgcagtaaagcagtggggctcctgaaagaaagagagtctgtgcttctctgtctccttcactagaacagagactcttgaaggccaggacacacttttttcattctttgtcttacatggtcactgggactgaatcggagtctaaagtaatcttgattgcaagaatgcaagtctaatgaaacagcttttgcaagtaacagtggaccaaagggaaaagagagctcttttatcatgtaacaagtcaacattaggagcttaaactttgaacctgaaggatagcaggcagcttatggttcttgtgcagttgtgtgctcctgaagtgcatgcagccagagaacaacattgctgttctctatctttacaaaccatggggatttctccttgtgtttcaggagggcctagtgattttccggggcttgaaagaaaacctttcaataggttataagatgaagattctcataattctcattattttattttcttcttaatcaaaactgtcagctggtgcagcgctcatgtcgataatcccagcactttggaaggccaaggcaggagggttgcttgagtttaggagtttgagaccatcctgggcaacacagacccacatctctacaaaaacattttaaaaattagccaggtgtggtggtgtgcacctgtagtcctagctacttgggaggctgaggtgggaggattgcttgagcctaggagctcaaggttacagtgagctgtgatcacaccactgcactcagcctgggcgacaaagtgagaccctttctcaaaaaataataataattgtcttcctgatgctccaaagtccctttactctaggtcagagaatgtatgtctctaaattataaagtgcagaattcagagaagcatctctctctttttgaaattataattggacacaataaatgcagaaagtaattagggcattttttaaaggtgtgcctttattttaacatgaagttttaagtttagaattgctggtttttaatatgttctcttggtaatttgtcactttacagtaagtttaaaatattctttgtctatttaaaatcgttcttgctggccctattatgtgtgagatcatgcagaatataatttacttttcctttagatgtccatcctgtttttataacctactgaacctgttttgtgagctgacaygtagccctygacagagtcagtttttgaatgttacagctactgaagattaygttgatcctgttacaaaccagacgaaaacaaatgtgaaagagttacaatactacgtcggacagagttttgccaatggtaagtaaacttttaattattcctcttttacagctggcatcaggacagcagagcaaattgttccttttagttgtcctgtcaactctggaaaatcacaattttcagttccattggccaggaaataagagttgttgctttgcttgtatcctaggacttgaactgcaacgaatataaaaatctccttaaagcgcttgctttaactccccctaactttaacttcccacatggaaaattttagtatgtgcaagtttgcatccatacacttcagtaaccattggatctttgactctaacagacatgagttgtgtaatgtcataaattactgcaagactgagaagatagaactgttaatagttggcagagaagaggtcatgacttgcaagaatcagatcaccataaaggaaagtcagcaggtctaacagatagcagaaatgatcccccagcattgaccaacatacaacatttaattataatgacaaagtaaaaaggtaacaaaaaaattccatagaaaaaaggtctcattcacaaaagcaacaaaaaataaggcacttaggaatccaaaagatgtgacatacaaggcaacctgactgaatggagagaggtcattttgtccagaaacagaagcctgcatgtatggaaagtggatgtgtaacacgtgtgtcattacaaatcattgagagaaaaggtgggctagttgataaatgagatgagaaaatagattatatttatctaattttaatttttacagaaaataaaaaaatcaattgtgtagattaaaaatcccaattggaaagttttagaagtaaatatggaaagatttctagacaggagaggaaaagcagaaaccataagaaaaatatttatgaatataaacaactgttatctagagcagacagcgaaatgcaaatttgaacagtaaactaccatttcacacctcatcagcttggcacaaattaaaaagttggtcaatttcaactgtgggtgaaaatgtgaagcaataggaatactaatgtactccaccacttacaaccataatttggtacaatcgtttcaaaactacttgaaaaacaactttgcagtacgtagtaagttgaagctaaccctcctcccagaaatttsacttatagatgcctgccttagagaaactctaaatgcatataaacctggagacccatataagaacacccactgtaacactattgtgattgtgaaaaattgaagacctcaagaacgagaagacaagacacagactgggagaaagtatttgcaaaagacatrttagtaaggactgttattcaaaatatacaaataactcctaaaactcaataagaaagcaaacagcccaattgaaaaatggacaaaacaacctgaacagatacctcaccaaagaaggcatacagtggtaaataagtacatgagaagagatgctcaacattatgtcattagagaattacaaattaaaacaacgagataccactacacatctattagaatggcaaaaattcaagacgctttcaacaccaaatgctggcaatgagctctcattcattgatggtgggagtacaaaacggtacagccaccttggaagataatttagcggtttcttacaaaactaatcatactccttggtatttacccaaatgagttaaaaatgtgtctaccccaaaacctgcacgtggatatttgtagcagctttgtccataagtgccaaaacttgtaagccaccaagatttctctcagtaggtgaatgggtaaataaactgctacatccacacagtggaatattatttggtgctaaaaagccatgaaaattcagtgctatcaagccatgaaagtacatggatgaaccttaaatcctattactaagcaaagccaatctgaaaagactactcactatgattccactatatgacgttctacaaaaggcaaaaccgtggagacagtaaaaagtcagtgattgccatgggttaggagagaggaaggcataagtagagcacagaagatttttaggtggtgaaaatactctatatgatactataatggtggttacatgtttatatgacattttgaaacaaaagtactacatacttaaaacaagtacacaaacatgcatgggaaggataaacatcaaattcaggattgtgtttaccttagggaaggggctactgtcagggaggggtaattggggagcttcaactgaatctatagagtgtgtgtgtgtgtgtaagtatttttttawtttttkgaagagacgggcctcactgtgttggtgaggctggtcttgaactcctggccttaagtgatcctcctgcctyggcctgccaaagtgttgggactgtaggtgtgagccaccacacctggcctatagtgsattattatttttatttagtttttaaattatgccatagccagttgttytgaatagtgcagtactacaaaacagagtcaaggtctcatgctgtcacccaggctggaatacagtgatgcaatcatggctcactgcagcctcaacctcctaggttcaagtagtccccctgggtagttggaaccacaggcatatgctaccacacctagctaattaaaaacaaatttttttttgtagagatagggtcttgcttttttgcccaggctggcctcaaactcctggcctcaggagatcttcccacagtgctgggattacaggtgtgagtcactgcacctggccragtccattatttttttaatgttgaggcaaatgttgtgaaatggtatgactgatagttaactgggtaatgaggaaatgagaattgtattattctccatgtgttttgtatgcttgaaacataaaataaaacctgaaaaccaaatggtgagctggaagatacgagggaattactcagaaaacagcatacagatacaaagacctataaatcattaaagaaatgacatataacatgagaagctccagagagttggggagagacaataataatcaaagggataatgaggattttccagagtggataagggatgaaccctgagaacttagagaaaattcagcatacaaaaatcagttgtatttctgtacacttgcaatggacaatctcaaagtgaaaataaaacaattccatttactttagtatgggaaatacttaggagtaactataacagaaggcaaaacactttaaagaacagccgggtgcagtggctcacacctgtaatccaagcactttggaaggccgaggcaggcagatcacaaggtcaagagattgagatcatcctggccaacatggtgaaaccccatctctactaaaaatataaaaattagctgggcgtggtggcgctcgcttgtaatgccagctacttgggaggctgaggcatgagaatcacttgaacctgggacgcggtggttgcaggagctgaaattgtgccactgcactccagcctggctgacagagcgagactccatctcaaaaaaagaaaaacagaaaaaacacactaaagaacattattcagcgaaattaacgaggatctaaataaatggaaagacattccatgtttatcaatcaaaagacttaatattgtttagatatcagtattctccaaattgttttatagattcagggcaatctctgttataatcccaactgacttctttgtggaaattgacaagctgattctgaaattcacatagaagtttgagggacttagaatagtaaaacaaccctgaaaaaagaacaaaataggaagactcacacttctcagtttcaaaactaagcaatggaaatcaagacagtggtactggaataaagatagacatatagatcaatggaatataactgagaataaataatatatctatggtcaactgatttttgacaagggtgccagggccattcaatgagaaaagaatactcttcatcaaatggtgctgcaataactggatacacacatgcaaaaataaataaataataatgaaattgggccctacttcacaccatatgttaaagaaattaactcaaagtggatcgaagacctaaatgtaagagctaaaaactataaaacaataaaacatagggattaatttgcatggcctcatatttggcacttgattcttaaatatgacaccaaaaacaagagcaataacagaagaaaagattaattggacttcattaaaataaaaaagtttgtatttcagaggacgccatcaagaaaagacaagaaggccgggcacagtgactcacacctgttatcccagcagttcgggtggctgaggcaggaggattgcttgagcccgggagttcaagaccagcctgggtgacaaagtgagaccctgtgtctacaaaaaataattagccaggcatggtggcatgtacctgtggtcccagccacatggttatctgaggcaggaagattgcttgagcctaaggaggctgcactaagtacctcgcactccagcctgggtgacagagtgagactctgtctcaaaaaaaaggacaagaatatatttgcaaattgtatatttgataagggacttgtatctagaatacataaagaactcttggccgggcgctgtggctcatgcctgtaatcccagcactttggggggccaaggcgggtggatcacctgaggtcaggagttcgagaccagcctggccaacatggtgaaaccctgtctctactaaaatagaaaaattagccaggtgtggtgatgtgcgcctgtaatcccagctactcaggaggctgaggcaggagaattgcttcagcctgggaagtggaggttgcagtgagctgagatcacaccattggactccagcctgagggacagagactccatctccaaaaaaaaaaaaaaaaaaaaaactcttactactcaatgatarataaataacccaatttaaaatggcaaaagatctgaatagagtagacatttctctaaggaagatatacaaatgaccaacaagcacatgagagatgctcaatactatgagtcatcagggaaatacaaatcaaaaccacaatgagataccacttcacacccaccaggatggctagaatcaaagtcacataacaagmagtgttgacaaggctgtggaaaataggaacctttattaaaaagaaatccaaaaaccaaaaacagctgggcacagtggctcatgcctataatccagcacttcggacggccaaggcaggtggatcaccttagctcaggagtttgagaccagcctgggcagcatggtgaaactccatctctacaaaaacttagctgggtatggtggtgcacatctgtagtcccagctacttgagaggctgaagtgggaggatcacttgagcctgaggggcagaggttgccagtgagctgagatcacaccactgcactccaatctgtgtgacagagtgagaccccactttggaaaacagtttggcagttcctgaaacaaacatagaactaccatatgacccatcagttccactcacaagacgaaagtataggtcaacacaaaaacttatacacaaatgcttctagcagcattactgataatagccaaactgtggaaacaactcagatatttatcacctgatatatggataaacaaaacatatgtccttgcaatgaaatgttgttcggccrtaaaaagaaatgaagtattgatacatgccacaatatgcatgaaccttgagaacattatgctaaatgaaagaagccggtcatgaaagaccacatattatatgattggatttatgtgaactgtctgaaatagtcagataaatagagacagttcagtggttgcttagggcttagggaagtagggaggtagttgwgcatagctagaatacaggatttcttttgaggtgatgaaaatgttataaaattgactatggtgatagttgcatatatctatgaatatgctaaactccattaaattatatagtttaagggggtaaattgtaaattacatgtaattatattgtaaattatatagcgccaccacacctggctaatttttttttatttttttattttttgtagagacggggttttgccatattgcccaggctggtctggacctcctgagctcwggcagtccacccaccagggcctcccaaattactgggattaaaggtgtgcataaccacccctggcccaaagacaaatatcttaaaagcaaatagagacaagacacaaatcaccttaagacaatgataattggagattttcttaccagccatgatagagcctggaaggcaatggaataatctgttgagaattctgagggagatgactgtcaccctagttaacctgtctttccagaacaagggtaaaacaaaatgaatgtgtaagcatctccttgaagattagggaaagaagatcctgsgaagtttctagcaagcagagactggtaaatgagaatcgacagtacaggacccattccagctattttcttaggtgtaatacactgatactatccttatrtaatgtgttgtgtgtatgtgtaagaaaataaaatccaaaaagataacagtattaggggttttttttgttttttttttttgtttttttgtgatggagtcttgctctgtcacccacgctggagtgcagtggcgcaatcttggctcacttcaagctctgcctcccgggttcatgccattctcccgcctcagcctcccgagtagctgggactacaggcgtccgccaccacgcccggctaattttttgtattttcagtagagatggggtttcactgtgttagccaggttggtctccatctcctgacctggtggtccgcccacctcggcctcccagagtgctggaattacaggtgtgagccaccgtgcccggccaacagtattaggtttattgacacgtgacctctgctctaaaaccagttttccaagtaagttccataattctctggctgtgtagcttcctgcggcagaggttttctggaaccagctttgttaactgaagaagtactgaggctcttagctgcgtcttcctgggccttggtatactcttctatatagtggggatttgacttctccaagctgttgtgagagctatgagataacgtgtgcctttccctttcctgtctgttttttacttttaagttacttggaatcgggcctccatattatttgcagggtgataagccaatttaaagggaatctctgttcgtgcccttagttagtgtttgctgtccagcattccagcatggtgcatatggagttcgtgtttcccttcaagaggccttttgtaagatcttgcctcgtgaattacagcaagcatcttgtctcctttttcctttgggtttcctcttctagcaatgtacaatgcctgccgggatgtggaggccccctcaagtaatgacaaggccctgggactcctgkrtgggaaggacgctgacgcctgtaatgccaccaactggattgaatacatgttcaataaggacaatggacaggcaccttttaccatcactcctgtgttttmaggtaggtataaagattccaagtttggtgtgtttatgatattgttttaaagccaaggaactggctgggcacagtggctcaccagtgcttggggagactgaggcaagagaattgcttaagaccaggagttccagaccagcctgggcaatgtagtgaggccccatctctatgaaagaattaaacattagccaggtgtggtggcatgcatctgtagtcccagctacttgggaggctgaggcaggaggattgcgtgggtccaggagttcaaggctgcagtgagttacgatcatcccattgtactccaaccttggtgagggcaaagccctgtctctccatgaatgaatgaatgaatcttagttgaggaagcataatctacaataggaagataaacacattcaggtaactagttcatagtttctcccagtaagagaggtaactggtacatttatcctgctgtggctaatttagggggtgctgggagtgggaatggaggagsaaatgaattgccttcaggcattgctgtcataattgaaagaataagcagttaaaaagggggtgggaggcagcttttctagagctctgctatagtattagctcctgagaatggagatgggacatgattgaagggttgccttggtatgtggtgtacttggaggattcctctatcagtgacaaacccctacgcgcaagtttattgaggtaacttaaaattccataggacgaagcagcaaaacataatttaattaaactaaaacctccaattctttttcttctttcagttgttttatgtatttcagtgggcttttctttgagtttaagtataatacaaaattttggatgtttttaattgagatttgtactcaacacaattcctttctgtagattttccagtccrtgggatggagcccatgaacaatgccaccaaaggctgtgacgagtctgkggatgaggtcacagcaycatgtagctgccaasactgctctattgtctgtggccccaagccccagcccccacctcctcctgctccctggacgatccttggcttggacgccatgtatgtcatcakgtggatcacctacatggcgtttttgcttgtgttttttggagcattttttgcagtgtggtgctacaggtaagcagttttgtttgtcatccagggcaaaaagagsaaaattgcccactggcactttgagctttcatttgtcagagcttggttacttaggacaagaaacaaatacctccatgaataccattgcatggattattgtgtcctacagctattctatagtaaaccatcaaagttctgtttaacactgcaacatctgaaatgaattttactgatttattcaaaatgatgtgtgatttaaagcactgtgcattagccactgattctttttttttttggagactgagtctcactcttgtcgcccaggctgaagtgcagtggtgtgatctcagctcactgcaacctccacctcccaggtttaagcaattcccctgcatcagcctcctgagtagctgggattacaggcatccgccaccatgcctgcatgcctgactaatttttgtatttttagtagagacggggtttcaccgtgttggccaggctgatctccaactcctgacctcaggtgatctgmccgccttggcctcccagagtgctgggattacaggagtaagccaccgtgcccagccggccactcattctttagaaagtcagagtcaaggccaggctcagtggctcacacctgtaatcccagcactttaggaggccaaggcaggagaatcatgaggtcaggagtccattgcaaacagccctggcgacagtgcgagactgtgtctcaccaaaaaaaaaaaaaaaaaaaaaaaagtcagagtcaaatgagcgaaatcagattcaaatctaattaaatggagtactatagtccttttagatatttgcatcttaatttaggacagtactttttttactttttattttgaaataattgtagacttaaccaaaaagttgcaaaatggtagaatttatgtgtatccttaacccagtttccccgatgatacaacttacataactcatagtacatctagaactagaaataccatttgacccakccatcccattactgggtatatacccaaaggattataaatcatgctgctataaagacacatgcacacgtatgtttatagcggcactattcacaatagyaaagacttggaaccaacctaaatgtccaacaacgatagactggattaagaaaatgtggcacatacacaccatggaatactctgcagccataaaaaatgatgagttcatgtcctttgtagggacttggatgaaactggaaaccatcattctcagcaaaatatcgcaaggacaaaaaaccaaacaccgcatgttctcactcataggtgggaattgaacaatgagaacacatggacacaggaaggggaacgtcacrcaccggggactgttgtggggtgggggcctgggggagggatagcattaggagatatacctaatgctaaatgacgagttaatgggtacaacacatcaacatggcacacgtacacatacgtaacaaacctgcacgttgtgcacatgcaccctaaaacttaaagtataataataattaaaaaaaaaactcatagtacaatgatcaaaaccacgaccatgccattattattacattattattagctaaaccagagatcttaatcagatttcaccagctttttctctaatgcccttccctgtttcaaggycccatattacatttttgtgttttatgagtcccctctaatctgtgacagaaagttcctcagtctttccttttctggccttaacactcttgatgatactggtcaggtattttgtagcatgtccttccatttggctttatctggtattttctcatgatgagattgaaataaggtgttttgacaagtacatcacagaagycatgttatgtctttctcggtgcatcatgtcagggatccctgatgttgatgcgtctctttcctggtgatgttaaccttgatcacttgctcaaggtgatgtctgctggctatctccactgtgaagttactgcttttcccttcgtaattgataaatatcttgggggaagatgctttgagactatactaatattttgttcctcctgaaactcaaccactgattttagcattcattgttgggtcttgtctgcaacmgttataactaaggtgtttgcctgatagtgattttyttctctttccctctcttcctctgcatttactaacyggacttctgtacagaaagctatcccttctccctcatttatttactcagttatttacatcatggacttttaattctgtgggttgtatccaacactgtcatttatcttgttactcaaagttttccactttgggccattgggagtgccttctggctggcttctgtgttcttacatacacctcccatccccagctttatcttacatattccctgtccctgccctgcaaggagctctggttccttttattggagaatggtatgtagaaacgaagatctgggcactaggtaygctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctgcctcagcctcccaaggcacgtgccaccacacccagctaacctttttgtatttttagtagagacagggtttcaccatgttggccaggttggtctcgatctcttgacctcgtgatcccgcccaccttggcctcccaaagtgctgggtttacaggcgtgagccaccgcgccyagcccagtagtgtgtttttaaaggacctaaaagttttaaataaaatgagggccacaaggtgaaattatcctttattaattgttctcttaacatcttcttaaattttctcctgagactggtgagcagagggacccagagcaaggggacttaggggaaagaaggcagtaattagggaggaggaggccaggaggaggaagaaagcatttcatgggattacaggaatgtcccaaaaacaacctcactgtgatgaagtccactaatgctatttcttcacttctgtttttcagaaaacggtattttgtctccgagtacactcccatcgatagcaatatagctttttctgttaatgcaagtgacaaaggtaggcatatttgtccatgaataaaagggttcagatgatgctgtctgtcatgagagcattcgtttcctcagtggggttgcagcagtgggtgaggtggtgtgccagtgccgaggacacggctgcgaccaaggcagacatggtccttgcctttgtggcccyaccatctagtcagggtggcacagcagaaccaagtaattaatcatagctggggaggcgcgaaagcagcaggacaagagtgggaatagcagggcagggttgaacctcacccttcagaggctcctgtgtcggcatctcctctgtggggtgggaatagcgctcattgagggcagccaacaaaggtggcttygctgagcagataggtagctgagggcaggggtctcatatgtgtccccaggtgggcttgattcctgccatgagatagcaactaatgctttccctgttcygactttcaggaacggcttggctcttaacctccaccttcccttcctctcccgttcttccaggagaggcgtcytgctgtgaccctgtcagcgcagcatttgagggctgcttgaggcggctgttcacacgctgggggtctttctgcgtccgaaaccctggctgtgtcattttcttctcrctggtcttcattactgcgtgttcgtcaggcctggtgtttgtccgggtcacaaccaatccagytgacctctggtcagcccccagcagccaggctcgcctggaaaaagagtactttgaccagcactttgggcctttcttccrgacggagcagctcatcatccgggcccctctcactgacaaacacatttaccagccatacccttcgggagctgatgtaccctttggacctycgcttgacatacagatactgcaccaggtaacctgctgtttgaagaaataagtcactctagatgaccttgtggtttgctggcttttacatgttkactactgctagatggggatttggggctgaatgtcatggtatatcttgaaaatcttagcgtataatggcaaagctgcctttaagttaggtttcaagaaagtgaatgatgttgaacttaatggaatatttattgttgctcacttttgtatttacttcagatagtagaccttgcctttttcttgaaattgagatgagcagagaaagaagacttcagtggcgtttctctattgaggcaggatatatttattaggaagtcaccttaggaatttgtgaaatgttttctgttggtaactgaaagtaatatgcaaggacccagaggcatgaagcccttactgctgtcctgggggctgaggaaggagctgccagattaccatccctgatccaacctgtaggaatgaacttatcactcactgcctgaacatgggcacccagcctgtttttggtgagaggcgcatttggggcaagatccatcccattgctcctagaaaggcatgtaaaccttcccattgtccctgtcacacttgccttggagaactgtacctgtgcataaactgtaccggcttcttttttaatgaatgtataatcacatggtttttcctttaaacattgctcatgtctacaagaaagtctgcaatcttgaaaagcattaaaatggtcccaagacttgaatcttttctctacccagtgactgtctgttgctttttccagcttgttgctgaaggtgaacagcatagtcatttacctccaagatcatcttctctgttaggaaataaggggacatatataaatggctgtagtgcagagcaaggcaggaggttatgtgttactattgagaggagggtcagggagaccaggagtccccctccactctcccctctggcctgctggccaccactggagaacggtggaggggagatggttgtgtgtcctatgttgatagctgttctggtcatggtgttccccctacccctcgccgcctctgtggacgcctctaactagtttgctgttagagtgggcctgtggcctgaccagttttcttactgtattgcatcttaattctctccctcatcttaggaagtattttccccaaatactctttgtcttctgaccctcagggcaatgctgattaatcaagatctgagagaaatgtgacgtgtttctgggtttgcttatttttaaaatcttctttcaggttcttgacttacaaatagccatcgaaaacattactgcctcttatgacaatgagactgtgacacttcaagacatctgcttggcccctcttycaccgtataacacgaactgcaccattttgagtgtgttaaattacttccagaacagccattccgtgctggaccacaagaaaggggacgacttctttgtgtatgccgattaccacacgcrctttctgtactgcgtayggtaagtggcaagagacaatcattggtagacaccattcttgggtctgacttagggtacatgggcaaaagcttgttttatgagcataacccagaggtgagcaaacaacaagaccttgccctgtgaagtttacatcatctttttttttttttttgagacagggtctcgctctgtcgcccaggctggagtgcagtggcgcaatcttggctcactgtaacctccggctcccaagttcaagcgattctcatacctcagcctcctgagtagctaggactacaggtgtgtgccaccacgcccagctaatttttgtattttcagtagagatggggtttcgccatgttggccaggctggtctcaatctcctgacctcaggcgatccgcccacctcggcctcccaaagtgctgggattacaggcgtgagcttccatgcccagctggaagcttacatcttaatggagggagacggttgatgaacacataacatrtgctatcgtgccagctagagattagtgctatgaggagaaaaataaggctggacagagtggggggtgcattgcttaagcgtgragatgtgcacaaagggagaggaaaggacagctgggcacatcacagggatgagagttcccggcagaaccagcagcaagtgcagagccctggcaggaagctctcgtggtgtgtgattgaggagtgcagctgcctctcaccctttacctcgtgcctgggtcgctaacacagtgtcatgtatcacaccccccacaagatttaaagatagaagagcctttggtgycttttgttctgtctcagatatatagcccagtcccctgtagtgccccagctatttgggaggcagcctccctctgaggagttgaggcagtataggtctgcagctccgcagctttagattggagggccctgcagctgcttcccttaggaggcatgtctagctgggcagggtgcgtttataattgggaatagtcaccccaggaagcggtgctttggtgacctgtaggggaatcttaaggcttctcccagtaggggaagagtagcatgatgccggatgggcctactctccctgaatgctagggacctggcctagggacatttgttcagccagttgagcaaccacagtggctatttcttcagcatgggaacagagaaattattcctttttgccyttaaggacactgctcagccgactacttctcaagagctaaggactctcacttctggttctaaagaactttgaccttgagttctgtttgtttgttactggagtaagactttttatgcagttgggctatatttactctgtttcaagaatatcacccctaaaaacatgagttatactcatgaaaacacaatagcttatgctccataccctaaaccggcattctccacagggtagacggtgcagacgagccatgggtaatttgaagaaacaaaaaacatttaatgttacataatttttataattggacaaccatttaatgttacataaattttatagtttactctctgtggcacaagataaaagtcaacaaaaatgatgggggacagaggtgcgtgagccttgtgtttcctcaaagcggacgtggttcccaccagtgtggaagcggtacagggagtggcaggctcctggyggcagggacctgaattggtttgtagttatgcttgtgcgcgtcctcataaccccagtctcgccctagcgctgtcccctttcctctccctccagcttttcctggactttttcacctgagggtcctgcagtaatggcaggtggcctgcccagaaccatgcccttacctgctkcttctccccattttgtttaaaggcagtgacagctaccagttactcaggcttgaggctttatccctgaattctgcctcgccctcgccttcctcatggggttcttacgggtctgagcctctggatgctctctcagatttctgctgtggatgaagggactcagctgctcgctgcaggtcacctgacctccctcatgccgtcacccatccactctgacgggtgggtcatatgcagaagcttctcagcacctggccaagttgtagctgatggtctgtccgaaaatgctggttcactctccactggccaactgtctgtctgcactgcactgccagttgcctcttgcctgsgccattgcgctaacatctccacttactgttccacctgcttcctgtttctttgccgtttccagaccttccactttgccacgcaagctatctttgtaaaacagctcatgacatttctttcccggaaatctctaattgttccccagtgcctccagaataaaaatccaaactacttaactggcactgagtccttttattttgcatttgtctgtccattactcttcccagactggccccctccttcaggagcccccttggtgggcaccccatgctctaggacaggacatcttttcyttgaattattattattttttttttagagatgggatcttgctatgttgtccaggctggactcaaactcctgggttatagccatccttctgcctcagcttcctgagtacttgagattaggygtgccaccataccyggcatacaggacttgccaaaccaccatcttgctctcattccctctcactgttctctctccctccctttttcctcccacagttgtaattgtgtgagacacccttttgtcctccctctttggtgaaatccccctcatcctcggagctctgggtctgtacagtctcttcctcttggctataattttgccttttagtgtttgctccctcctctgtgcctgcrtagcgccatgcaccatgtgccattgatggcactgggctgtatttgcctgcctcttgcccagtgattctgagctcccaaaggtgagtgctgagctgtattactcaactgagaaacctcagggcccatgttgtccttagaatacagccagcctcatcaaatgttcactgtgtaaatgtttaggtccctgatgtcttgaggcccttctaactgggaggtgttttctaaactttttggcagggctcctgcctctctgaatgatacaagtttgctccatgacccttgtctgggtacgtttggtggaccagtgttcccgtggcttgtgttgggaggctatgatggtaagtaagagaagctttgacttttccttttagataaagtcatctcggttttgtcatyagcatcaagtggtaattatgaagatttcataaattgggcagttttgttaatttcttacctcttgaatcccagaatagtatctcctttggctttgggtttgggtttcattccagatttaaaagaagtggattgggttagccatttttaggtcacacatgcctttgagaagctgtcgaaggctaagtacctttccccagaataatgcaattgcaaacctctgcattgttgttcagcttgaaggtcatgggcctccgaagttcatttatagaccctctagggagctcatggacctcaggtaagagcctctgtgatagagaaaagatagtatgtgaggtatgtggaaaaagaaacaaagttgatggattttttttcttctaagccagtcagttgagtatttggacactcttacagtgtgaagagcagctggtttgctctttcctggttcctgtagcactttagaaccaattgtacttgacaaaatgaggtgattattcatgtgacacctttggcatcttaagccaaattacaggctcaacaggttttgcccaaccagttaagaatccagataggttttcttctcctcacttggtggcaggggagaagttgcaatctgtatttaaaatttactgtgcatcagagaggaaaatgccatttctaattgttggagaagggatggtgtcagcaactgactagccataggggaaacaattgactttgatctctgacttgttcatttcaccaaaataaattccagatggataaaagattgaaatgtaagaactgggccaggcgtggtggctcacgcctgtaatcccagcactttcggaggccgaggcgggtggatcacaaggtcaggagatcgagaccatcctggctaacacagtgaaaccctatctctactaaaaatattctttaaaaaattagctgggtgtggtggcaggtgcctgtggtcccagctactcgggaggctgaggcaggagagtggtgtgaacccgggaggcagagcttgcagtgagccaagatcaagtcactgcactccagcctgggcgacagagtgagactccatctcaaaaaaaaaaaagaaatgtaagaactggaagaaaattcaggaggcatttttaaaaataatttttaagtggaaaagatatttctaagcaagacacaaaactcagaagcccgaaaaggaaagactgatgaagttgagtacatgttcatttgtggagaacaaacatacagttaaaaaaacaaaactgggccgagagttattcatgcctgtaatcccagcaatttgggaggcagaggcgagcacatyacttgagctaggagtttgagaccagcctgagcaacatggagaaaccccgtctctgcaaaaaatacaaaaattagctgggcatggtggtgcatgcttgtagtcccagctactcgggaggctgaggtgggaggatcacttgagcccaggaggttgaggctgcagtaagcgagattgcaccacattccagcctgggtgacagagcgagaccttgccagaaaaaaaaaaaaactggacaaaaatattagtatgcatggcagtcagcattttcttaataaataaagatctcatctcagcctggccaaaatgtgaaaccctgtctctactgaaaatacaaaaaawattagccacacgtggtggtgtgtgcctgtagtcccagctactcgggagactgaggcaggagaatcacttgaatcctggaggtggagtttgcagtgagccaagatcattccattgcactccagcctgggcgacaagagcaagactccgtcttaaaaaaaaaaaaaaaaagttgtgaaaaaaagatcaacaacctgaaagaaaagtgggtgaggtcatgtgaaagataacaaaagaagaaatacaaaaaaaaaaggtttttattttatttttcagagacagagtcttgctctgttgtccaggctggagtgcggtggtgtgatctcggctcactgcaacccctgcctcccaggttcgagcaattcttctgcctccacctcctgagtagctgggattacaggcatgtatcaccaggcccagctaatttcttgtatttttagtagagacacggttttgccttgttgcccagactggtcttgaactcctgacctaaggtgatccacccaccttggcctcccaaagtgctgggatcataggcatgagccaccacgcccagcctcagtaaatattttcttgactaaagtaatgaaaagggaggccaaggcaggaggattgcttgagcctgagaagtcaaggcttcagtaaaccatgattgtgccactgcactccagccagggcaacagagtgagatcctgtctctaaaaaagaagaaaaaaaggaatgaaaaatagttaagcttctttggaaggcagtttgggagaatttatcaaaattggaaatatacatagtttttgattcattgattatgctttaagaattgattctagccaggtgcagtggctcatgcctataatcccagcactttgggagggcaaagcaggaggattgcttgagcccagtagttcaagtccagcctgggcaacatgacaaaatcccatctctacataaatacaaaaattagccagcaatggtggtgcacacctttagtcccagctactgggaggctgaggcaggaggattaattgagttcgggtggtcaaggccacaaaaagccgcgattgcaccactgtacttcagcctgggcaacagaacaagacactgtccccctgtcaggcccccaccccaaaaaaagaaaaaagatttatttctacaagtatgtgttttacacattaaaatatttataggctatttatagtaactttgtaatagaaaaaattgcaaaactactcatcagttgggggggattggctaaagtataccagaaaatactgtaggaaaagaataaggaaactctttatggagcagtctccaagatacaaaattttaaaatgtaatgtgcagaatagtattttactgtttgtgtggttaagagggaaaggggaagaatctgtgtgtttgcttgtgtgtgtgyggagtggctctggaaagattcgcagatggtcacagtatggggaggagaactaagacaatgaaacagatgttggagaaggagagaattttcgataaacacttttctgttctgtttgaaattgttaacatgcatgtactgtatcctttaaaaaaaaaaaaaaaaagagttactcttcctgaatgataaccatgcctacctcagataaaaaatcctttttattcattaactgaagtacataaagactatttcagcaaactcttgtttaattcttagagcccagagatacagtccatagctccagtgagaaatctgtgttgtgatttttcccctggtatgtgtctaattttctgcatgcttgtaatctgctttttgatgtcacatttttcctttctagatcaaaactacaataacgccactgcccttgtgattaccttccctgtcaataattactataatgatacagagaagctccagagggcccaggcctgggaaaaagagtgagtcactcatgggtgtgagcagactgtccttgcattgtgggaagctagacacttgcrgcaagcacttaaacttcattttctaaattaaccaatggcagatctgagttacgtagttttgttcacttggtactaatgatgctaagaagaaactgtaaacacatttacctttgagcaggtgctttaaacagctctccctccacaggaatgcaaaagtgtgcaaaaaaaggttccttgcattgtttttacttatttcatttattttttgagactgggttcacttttgcccaggctggggtgcagtgactgaatctcagctcactgcagcctcaacctcctaggctcaagtgatcctcccacctcagcctcctgagtagctgagactacacgtgcatgccatcacacccagctaatttttgtatttgtttgtagaaacagggttttgccatggtgcccaggctggtcttgacctactaacctcaggtgattcaccctcctcggcctcccaaagtgccgggattacaggtgtgagccactgcacccagccacctgcattgttttctaacagcaaaacttgggagcatgctgaatgtatttaataaggaatgaatacaatagaatattgtgctgtcataaaagacagtgaagtaaatggtccatgatgtatatttgtataaatatatattgtttatgctgctgtccatgcttagaaaaaaatatcaagcaaatgacctcagaaattaactgtgtttgtgacctctagagaatgggaagagaggacttaggaggccaggttgcactttatgccctccagtacttttaaaaaattgttttactgagatatggtatatgtatcatgcagttcacccacttaaagtatacagttcaggctgggaatggtggttcacacttgtagtcccagcactttgggaggcccagacgagaggctcacttgaggccgggagttcaagaccagcctaggcaatgtttgcatgtctctaaaaaaaagaaaaaagaraatttaaaaagaaaaaaaagcgtacaattcagtagctttactatattcacgtgtatgtgcagccatcaccacagtcaattttaggaacattttcattactccacaataaaactctgtaccctttaactaacaccctccatcttttcatcctcctatccacagccctaggcaaccactaaaatactgtctctggagattttcctattctggacttttatgtgcatagaataatatgtggacttttttgtctggctatcattgaacataatattctcaaggttcattcatgttgtggcatgtatcagtactccattccttttcattccattgtatggatataccacattgtgtgcatttatcaactgacaaacacttgggctgtttccattttggctattatgaataatgctgctatgaacacttgagtacaagttcttgtggatgtgagttttcatttcttttgggtacatacctagtagtagaattgctgagtcatagggtaagtccaccttgaatagtttgaagaactgccagactgttttccaaagtggctatagcgctttacgtcaccaccagcagtccatgaaacttccaattcgttcgcatcctcgtcagcactttttattatctgactttgtgattctagctatcttcatgggtgtgaagtggtatctcattgtggttttgatttagtagactgaatgcatttcttttttttttttttttttttttttttttgagacagagtcttgctgtgtcatccaggctggagtgcagtggcatgatctcagctcgctgcagcctctgccttccaggttcaagtgattctcgtgcctcagcctcccaagtagctgggattacaggcacctkccaccacgcctggctaatttttgtatttttagtagagacgggctttcaccatgttggccaggctagtctcgaactcttgacctcaggtgatctgccagcctcagcctcccaaagtgctggaattacaggcataagccaytgagcccagccctaaacttactttaattcagcatgtatggaaccttagctgtaatctgatagtctccagtgtggaagaccctaatgcagtggctgggcatggtgcctgtcatcccagcacttagggatgtggaggcaggaggaatgccttgaggccaggagtttgagaccagcttgcacaacatggcaaagaccccatctctacaaaaaatttttaaaattagccaggcatggggatacgtctctgtagtaccagctactcaagaggctaaggcaggaggatcccttaagctgaggagttcgaggctgcagtgagctgtaatagtgccactgtactccagccgaggcaacagagagagactctatttcaaaacaggaacaaaagcaaacaaaggatcctaatgcaggataaaggttaagaaaacatggcctttgagccgggcacagtggctcacgcctgtaatcccagcgctttggggaggctgaggcaggtggatcacttgaggtcaggagtttgagactagcctggccaacatggtgaaaccctgtctctactaaaaataccaaaattagccgggcctggtggcgcacgcctggagtcccagctactcaggaggctggggcaggagaagcactcaaacccgggaggtggagcttggagtgagctgagattgcgccattgcacttcagcctgggcgacagagcgagaatcagtctcaaaaccaaaaaaaagaaaacgtggcctttgtatcgtgaaagttagggagaagtttcttacttagctgtcagttagtttaactaaaaatataacattttgcttaccttttaggtttattaattttgtgaaaaactacaagaatcccaatctgaccatttccttcactgytgaaygaagtattgaagatgaactaaatcgtgaaagtgacagtgatgtcttcaccgttgtaattagctatgccatcakgtttctatatatttccctagccttggggcacatsaaaagctgtcgcaggcttctggtaagccggggggggggtggtgtatgttctagaggttaacagcagtgcacagtgtaacgtcatatttttgcctctttattcttattccatyatgtttaaaactgccataaattcccccatgttktaattgtatgtaacgtttctgttgcctacatctattttcttcattccaactttttgktttatcttaaagtttatttcacataatccagttttttcttatttgtccagtccatcacctaagaatgcaaactcataacatgtgttgccsgagcagacctagaaatgtttacaagtcctctctgaaacacagaattgtacattcaactctaggtttaatacagccctgtaaagtaaaaaggaggaccttttagtaacaagtgggacagacaaccctgtaactaattggtgattgtgtctgtcgcctctctcaggtggattcgaaggtctcactaggcatcgcgggcatcttgatcgtgctgagctcggtggcttgstccttgggtgtcttcagctacattgggttgcccttgaccctcattgtgattgaagtcatcccgttcctggtgctggctgttggagtggacaacatctycattctggtgcaggcctaccaggtatacttccatattctcacagggctcagcatctgttcaagtttcagggactgtgaatggctcctgggctccgcattcgtgagtgtgacctgtgagggtgttttgtttcctttccctgtgtggctcatcggtcgtcttgacttgctgtggacatcttaggaccaagaatttcacccctctttttggttgttgaaatagtagatataaagtaagaattgtgttttaaattgtatctttaaatagtgtcttttaatagtatcttttcattttaaatagtatcatgtgtacaagaagggctaacacacttttggaaaagattttgggtacgactgctgttaaaatgatgttcagcatagtatagaatgttagattcattttgcccaaaggtgccactaaaaaggcaaaaggtcaacacgtgtcccgctgctgtagaaggtggtctcagtcgtcctgtagacccgacgtgggyggagactcagtgcacgtgagagtgatgttcactggtccagtcccctgccgcctgtgttccgagtgttttcctgataatgtggctggctcagctttccctttagtttctcacttggtacctagctctgtagtgcagaaatactctgagaacattggagtcccccaccgaagtttatatgcttagaagacactgctaatcgtctactaatcatttatttttacccttgagttaacacaaggcagcaagaaatggcgttgttattgagaaattttaatgtcgcataatttttttttttttttttaagagagatgaacgtcttcaaggggaaaccctggatcagcagcygggcagggtcctaggagaagtggctcccagtatgttcctgtcatccttttctgagactgtagcatttttyttaggtaattatgctttcaatcctaccagtcctgtagtctgctgagcctggagaaagaaggagctggctacctgaacatgtccctttgtgttgcttcctttttttttttttcttttttttttttttctctgagacggagtctcactctgccacccaggctggagtgcagtggtgcaatctcggctcactgcagcctccgcctcccgggttcaagcgattttcctgcctcagcctcccaaatagctgggattaaaggcacgtaccaccatgcccagttaattttttgcatttttaatagagatggggtttcaccatgttggccaggctggtctcgaactcctgacctcaggtgatgtacctgcctcggcctcccaaagtgctgagattacaggcgtgagcccccgtgcccagcccgtgttgtctcctttttttaagctttgttctgcactgggaaagtatcactggaccacagaaaaattggcagcagtaacttaggtgtgattttgcaagtggcttccttctcatttaactgtcaggacagcattgatgttggggttcagggtgaaagagacctagagttcgtcttgccactttccccttttagtagccactgggaatgttgatagttgaaaatggcatccttgagtagccactgaatccttctccacatgacactctaagcagcagctcccaaatccacaggcactcgcttacaaratgtttgccgttgttttcaaaggcagtctttctcttctgtgcacacaactcattggggaagcagccttgttaatgaccagaagctcttgactcaccacattacaaggagccagaataagctggaacaaagtcagcacttctgtgtttctttcacatagagaatcatcaaatagacccactagtggggckgtctgccccatgtctgaagtgtagtaagagcaaagtgactctgtccactataggggaggctggactggaatcactcagtccaaagaagaccatccacgggccacaaactgcaatgcctacatggctgggaggtcagcttaatcagggccattgtaaggtcattgtaggtggtagtctttcaccacagatacactgctagcttgttattcttcatctccacaaagccatgtgcttttgaaacctgtagccctgtagttccttttgacaaacacaggtgcagaaaaaaaaaaaaaaaagaaaaaactttctttttttcactactattataagaaaaccagtgcaagtgtgatgataatagcagcagagactgtgcctcaaggttggagtgaccttgggacagtaggagtgagtagggattgtggcaccccaactgcacgtgtcctatctaaaaagacagttatgtgtgtggccaacccagtgctacaaggtctgtgttgttgttgttgtttttcttccaagcaaagctgtgaatctagatttttgtgtaaaatgccattgttaaatattggcaacttataaaaaaaagttttttaatcttaagatgggttgatacagtgtgggctaaacaggaaccatctgattcatgggctgccagtttgcagtttccaagtcttaccctcatgcctttgatcctcactcgattgtagattacctcttaactaaactgggaggctagtagtgttgatgtaataaatggaaaatactgtccatttcttacagtgaagcacagaaagtactataagaaatggcctgtattagtggttctcaaattttaatgtgtgtgaatttgctgtgaacctgagtatagtagaattggggttgaattcctgtcataactaggatggggcttcccaaatggtctggtgctgagtgtgctttgaaaagcactggcttatcacctcctgtcccacttctggtgtaatgtccagccgcagcatgccttctcatgcgtttggcctgtgctggctccttgtatctgtacatgcacatgaacataagacctgcagagagcccccggctgtaaacagaagtgacgcagagcccttctctccccgacaggagcattgtccgtgatgccagccgtgcacaccttctctctctttgcgggattggcagtcttcattgactttcttctgcmgattacctgtttcgtgagtctcttggggttagacattaaacgtcaagaggtaagttggtgccaggattatagtctatttaatttgagtctagaatctagaggaagcagctagcgggtataacctttgtttccctctgtcccctcagaaaaatcggctagacatcttttgctgtgtcagaggtgctgaagatggaacaagcgtccaggcctsagagagctgtttgtttcgcttcttcaaaaactcctrttctccacttctgctaaaggactggatgagaccaattgtggtatgcgcttatctgtggtttttctctttcctctcactgaaacagattatcacatgccttctaagaagccagacagcctgggaaggagattcttaaagctgttaaaatgtatctaaaaaaaaagcaaaagcaaatgtggaacagtagataaaatgtttttccygtgagcttttatcagtccatataaacaagagttttmagttttttattttgaaatagtttcagattcacagaaagttgcaaagaaacttttatttttcctcttaataatgaggaaatagaagccaagagaggtgaagtggtttgccccaagtcactcagcccgtaagtggcagagtcaggatttgcacccaggaatttggactcctggtgctgtggtctcacccactgccctgtactccctattagcctgtcatttaagcttttccattttaaaaaatcctgctttttgtgtgtgcttaagattttatttctggtcgtaagcttatttactaagcagtctctgtcttatgattcatttgttgttccagatagcaatatttgtgggtgttctgtcattcagcatcgcagtcctgaacaaagtagatrttggattggatcagtctctttcgatgccagatgtaagatgacttccttttttttttttttttaacttctttagctgatgatgaatacatttttcaaaacatgcacgtaggtgtttcaagcaagtgcctgcttctaactgcaaatggtgacagggtttccagggttaggagaactgtcgcagtgcactgctggtgtgggctgtctggcattctgactgagcccctctgggcacagctgcagaacacgaataactagtcttatgaggttactttatgagatgctctcctgaytgtgggkctagcaggaggagcaccctggggccctggggggaagactggtggtgttaggaatcatgagtccagctggaggcatctcagccaggaacctcctggcaccctcttattctccrtgatcctcgccttgcttagttactatcagagtgttcacactctctcctattcttttatctttctttcaggactcctacatggtggwttatttcaaatccatcagtcagtacctgcatgcgggtccrcctrtgtactttgtcctggaggaagggcacgactacacttcttccaaggggcagaacatggtgtgcggcrgcatgggctgcaacaatgattccctggtgcagcagatatttaacgcggcgcmgctggacaaytagtcagtaccaccttgtctygtacttcagaagcagcggaggaggctctcagccaggcagtcagctcaggcctgaaatgtctcactgaaaatagactttcttggaaaagttgtttttatgcaaaatgtatgttaaatctggctttaccttaaaaaacctttgaaaggactaatttaccacctaatactttgaaggcttttttcattaagtgctcatgtagtttttcttttgactgttagcagtataaaacgtagaaaaggaagttaggttttaagaaaaagtactgaaactaaagacttcctccctgtggagcaggtcagtaaccctgtctgtcctctctagtacccraataggcttcgccccctcgtcctggatcgacgattatttcractggrtgaagccacagtygtcttrctgtcgagtggacartatcactgaccagttctgcaatgcttcaggtaccttctcctttaccaaatctttccygttttgctgaaaaattttcaaattatcatttaaaaatcatttgcatcgtgcctcagtttatacctatttgtatatcaaagctgggtctccctgtgtcatcattcctttcctcagtcattcattctgaaattgtcatgttgttcctggctcagacagccaccctcggggctgcaagctgaacaaggtccacatgttcggagtgtggtttccacataaggtttctcatcctgttctaactccagcgattgcctctcaggattggtatctggccttagcttctcagaggagggcttttctttatcactttaccytgtggttttgtaggagcgtcgaggttgccctggaattttcttaataaaaacatagaagccccgggctctgaccagtcaaggccatacttgaaggaggagatctacttcagggcagaaaatgatgcatagtatgcctaagatgaaaatggtatttcagattcattaaactgtgaaagtgacatgtggctgaagcttttagataaggggaaagattatccctcactagtraggaaagtaatcgatagagaagaaagtaatrcccctcactgtcagtattttaaaatgttttacaaaaaatctggagacctattcttctaacagtcctccctgcatgtctccgccagtggttgaccctgcctgcgttygctgcaggcctctgactccggaargcaaacagaggcctcagnggggagacttcakgagattcctgcccatgttcctttcggataaccctaaccccaagtgtggcaaagggtaagtgctgctgccattgcagataagcatccactgcaactttaatttgcagtagaaaactaggagaggactgggctaagacagttgcatgggaacgtctcttctccgccccaccctgtcctggtcctttggtggaagcaggaaaaccgaaaacacctttttaagaaaatgcctcatagtgttcaactgattctgtcttagcgtgggcattcacatctcatgctctctctgtgtcctggccccctgggcatgagaatgaacgcagattcctgtgcacattccaagcggggctgagggagaggacggcctgctggtaatccaggcctgaaggaacttggcctrttcacttgtactgatggcagctggggcgtgatcttagctttagtaacattatcccacattaaggttgcgattcttttagcctcgtcatgctccttgccagcccatccatgtatagggttatgggctatctcactcccccatccagccaggcagccagttacccacggaagccagatatatggcccaaaaatagtgatgatgaccggaagtctctggccttgatttggaagctttgggaggtggaagatgagtatccccatgtatgttaggtaaaccctgaacttaggtttttcataagaacatacatctgaccagagtcatatcagtgaatcatttatatcatgcatgtgctttgagacctattcgaggtatcatgggatgactcctcctaaaagttaagtagaaatgaatcttgcagcttgatttactcactgactggatgctttggcctacgtaaaataagttgaagtagattcagtttttctgaaggcagtagccaccgttcctggggagcctccagggtgccagcgtcatgccaggcactccctgacattattccatttctcatcacgcagcctatgagtaggtggtgktatacccatttacagaagaggagactggggctcagaggtggtcattttgctcggggttacatgaccagtaagtggcagggctgaggttgttcccagggcccttgccctttcctgcttcctattacacaacaggactgagtaaaccctgtacmtttgattatacatgaaaccaggtggagaaacagcagctatgtaccaaagaacccagagcaatcgagaaaagcccatctggccaggcgaagtggctcacacctgtaatcccagtacttttggaggccgaggtgggcggatcacctgagatcacctcaggagttcaagactagccaggccaacatggcaaaaccctgtctctactaaaaaaatacaaaagttagttgagcgtggtggcaggtgcctgtaatcccagctattcgggaggctgaggcagggagaattgcttgaacccgggaggtggaggttgcagtgagccgagatcacgccactgcactccagcctgggctacagagcaagactctgtctcaaaataaaaaaaaaaagaagccagtctgggagagaacaagctaaacctttgsygttcccttatctgggggccttcttcatccctgaaatgtacagctgggtctgacctctgagtccagggtcaggtgattttgcttagcctcaagtgctcagattctgctgatattttgcaagacctggactctcttgacacccaggattctttcctcaggggacatgctgcctatagttctgcagttaacatcctccttggccatggcaccagggtcggagycaygtacttcatgacctaccacaccgtgctgcagacctctgctgactttattgacrctctgaagaaagcccgacttayagccagtaatgtcaccgaaaccatgggcattaacggcagtgcctaccgagtatttccttacaggtaaagcctgccctttttcaatggggtttacccagcaaagggcctacactgggtgggagtggggagggttcccttggcaagatgctgattttcaggttgggttctggcccctgctccattctgagcacagggcagtatatcaaaggaaatgggtgctgggcaaaggagttcagaatctaaagtctctgtgaaggcctgagggctagagacgcaaaacttgatctctgcgccactgcacagctgcaagagacacacactggaaaatggcttaaggcagggggcgcttggagagcaggcggctcagagcagggcccggcccacattcttggccaacaatgaaccagaatccctaactgctggttatttgggatgctgcctgtatgtagactttttatattgttaggggttttttttcccaggaagaaaagtattatgtatgaactactgaatttagaaactgtagaaaggtaggagaaacaagtgatttatttttcctgcctccccatgatctcgcttaaagcaggaaggcctggatttgtttggaagaagttaagagccggttagctctggcagaaaataaatgaaagcatgttttcctcaggccttgcacggaccccgctgagcctgaggtagtgtctcaggatagatcaggattctttgtttttttgtgttttttcagaatgctgtggaatgctctctgtaaatgtctataaaatagcatagattgggcttataaacagaaactttatcaaaaatatacattttgcatcactgctgggcccttctctgggtggtcagtggccatgagaggtcaagtgagttgctttcggtgagtcttgtagacagccagcaaggttttctgcaagggatgtttcccaaaggagtytgaccacttggcagtggtgacaggatgaacacgcagtgttygggagtgagagcgagctttaatgaggcctcccctctcccctccagtgtgttttatgtcttctrcgaacagtacctgaccatcattgacgacactatcttcaacctcggtgtgtccctgggcgcgatatttctggtgaccatgktcctcctgggctgtgagctctggtctgcagtcatcatgtgtgccaccatcgccatggtcttggtcaacatgtttggagttaygtrgctctggggcatcagtctgaaygctgtatccttggtcarcctggtgatggtgagtcctcatacagtctcagtttgtccctagctcctgtttcacttgggggaattggctgtcttagattccatgtaaaccctaaagatggagtaagataccaagtctggcgcttgctcttggcacacatggagaggcaggatgagtgctggaggagtgctggatggtggtgggacagggcatagagggagcgagcattgagttggacatctgggagcataggcacattacaggcaatttctgttcaattttttctcttgtcccattccttgcggctatactagtatacctgatggtgcctctgaccatggaaatgtgatttcctggcctagttctgggctagtctgcctgtaatttgttattctttagagaytgcacaagcctgtagcctgatgacagcaggatgttcactttttacttagaaaattgcaccccrccccaggagctctccgaccagtgccttttgcctcctatgtggttatcaggtacttttaatcattaaagatgagagcactygagaaggtattcatggaaaatagaacagtgtatccgtactctcagatatgagccctgcttcagataggggagcactgaggtccaagaaaagaagttgtgacaatgcgccagctcggtgcgggtggggtgaccttaacgggttccagcaatttctcctggtcaacacaaacgtgccacagaaaaccaggcttttggctgtgtgtagagagggccccaraaagttcctggtacagtaagattggtgtgatggaggccttgtaagtccaatgggatgcttggcctcctctagcacccagggtgccctgggtaattagcacccatcctcagaacggggtggctgcctagggtcttcaacaggaagagagccatcctaaaggaagtgctttatttcagagctgtggcatctccgtggagttctgcagccacataaccagagcgttcacggtgagcrtgaaaggcagccgcgtggagcgcgcggaagaggcacttgcccacatgggcagctccgtgagtaccctgagcagggccacgccggcagagtcgcaccacaaagtaatcctcctcagtgrctgaagagtctggatcctgtacttacaaagcagcttctaaggattgcaagctttcaggcaattcatgaattagctgccacatcgtggacagaacggacgttctgtggaactgtacctgttggtacggctcctttttaggtggcagtgtgctgaagcaggaaaataacagacaagttaaacatgagacagctggcagtctttcycatttaaaatgcaggggagcccgggccagaacccagcgtgtgatgtgcggttggtgcctggagagtcgtcttggttcaactctacaccctggcttagcctatctctttaccactgtagaaaatacctggtaaagagtaaaaactaaaactttgtttcgtaacacttttaaatatttaagttttcacctgagaatataaagaaagataatcaattgggagacacgatgcagtgtctgtgcagaatacacagcttttaacttggtcatacctctcccccaggatcataaggcagcaaatagtgttaggtagtagatgatgctacctgggttcagttcccattgctttgaaccttgaatattaagaaatccccataagggctggccacggtggctcatgcctataaccccagcactttgggaggccaaggctggcggaccacttgcggccaggggttcgagaccatggccaacatggtgaaaccccatctctactaaaaacacaaaaattagccaggcatggtggcgtgcacctgtttaatcccagctactcaggaggctggggcaggagaatcacttgaacctgggagaaatcctygtaaggaagtgtttttgttcaattacaggttggtaaaagtggtttctaacacagtatctcttcttttaggtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacataggtaagagttctcatcttaaaagggtggcacaatrgaaggacattactgaaagggaattctatcctgaggcattcttttcaagtatttgaactcatactaatggtcatttgataatgataaatgatactgagtaaaaaaatttcttctaaaagaaaaaacccatccaggggattcatgatggtgcagactactttattaggaagttgtcgatgttttttctggaggcctgatctgtctgcttcacaaaggcctggagccagtccttgaatggatctgagtgtcagcaggcagggcagctcctccctgccactgagatgaaggagtccatctggcagccagctctcacaccagcagtgctgcagaacagctttttatgtccctcatggatttcccgtttcttagcaaagtgcttgctgcctttcttcatctcgagactgtccttgatccttttacttctatggccacttcaccttgcacaaaaatgacccacggttgaaagarcaatactgatttgcttcatttatagctttgtcactaaattgaagcactgaagtagaagattaagaaaatgaggggctttttatcatctccgggggatagaaagtagttctattacaatctaatatactagttccttttaagaaaaaaaaaaaaaaaaaagagatgagcactttggaaggctgagacaggagaatcgtttgagaccagcctaggcaacatagtgaggcctccatctctacaaaaataaaattagccaggtgaagtggtgtgcgtctgcagtcccacctacttgttaggctgaggcaggaagcttgcttgagcccagaagggtgggcttaggatgcagtgagtcgtgttcataccactgcactgcagcctgaggaagaaagcaaagagcccatctccaaaagagagggagagagatgtggtctcactctgttgtccaggctggtctcaagcaattctcctgcctcagtcttccaaagtgggattacaggcgtgagccactatgcccagccaactagctccctttctcctgcagaaataagaaaaagtctctctctctcatagggccatcagtaaataaagccaaaagttgtgccactgaagagcratacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaagttttggggttaccctatctgctttgagagacaaatacaaaagctaaatggaagagattctatctaacctgtccttatggtaactaaatgccgtcttacattgagctagaaatagacctagaagtttcattagacagccctgatccttccctatcctaaagatgatgtcttaggttgtataactatttggagatgagaatgatcaaccagggccaggtgcggtggctcaaacctgtaatcccagcactttgggaggctgaggcaggcggatcatgaggtcaggagtttgagaccagcctggacaatatagtaaaaccccatctctactaaaaatacaaaaatcagccgggtgtggtggcacgcacctgtagtcccaactactcaggaggctgaggcagaagaatcgcttgaacccagcggaggttgcagtgaaccgagatcacaccactgcactccagcctgggcaacggagcgagactctgtctcaaaaaaaaaatgagaatgatcaaccaatgtatacttcataaaactgaaaccttaataagccccagaccctttaaaacccttagccaccatttgccgtcttattcctggctttaagagatattccaagatctgctataagagatgggctgtgcctgatctgggtcctaaatgtgtcttgactcaaaacacacctcctcggtgagttccagagcataattcagattctgtcagtatactgaattcactctactacaaataatgggccaagggctaggtgggctgttatcaaattgtgttgtttacaaaaatgctaacccagggtcctcgcccaccagctgccagtgccctctgctactctttgaggctatggttaccccaagtcttttcattgcattctcacctggtgtgaaattggggctccctcgcaaacgctggtttcgctgttcaaaaaagcggaatattgtatagaaaagcatgttgtcttcagtctgctttgcagcatctaaaaattttcgtgcagaaatgttgtcatggccaccaatgccccggataaaccttaaggcagctaacacttggtgtttggaaaggagaacttctactatttcatcatttgctgttgaaagtcgctagcagtaagggagagaagtccaggtcagtgcaaacaacaggaacagagttagtttccatagtctaaaacctcacacatcagagttaccttcagcatgtccagagatagctgatgagcaggaggatagaaactctctagggataacagcagacaagcctgaaagacatttttagacccacttcagttggaaagataacggttaaaattttccatttttaaccacaatggaagtaaaaatctggcaatgcataccaaaggtttggagtcgctgaggacgtggtactgcaggaactgatgcagcatataaaagaggttgtgctggacaagggttttgataacaagttcatgtagrtaatgctgaggacaaaagtaaaaagtgaaagaacacttccaaatcattcagctacaacagactagaggctccccaaggactggctattctaaccaacacagtaaaagtctgtcattacaagaagtggtttcgtcatgcaggtaaagaccccaacttgaccttacacttcccattccaactaataatgtcaggagtcactcagcattctgagtcagggaggcagacctgtcttagcatatgagtcatcttctaagacagtgactgtgttttttttttaaattccttctgttttaacttgggcccagatgatttgaaggtacctgtactgcaatctgaaactggttaagagaacgaatgtattccatcagcacggctatcacaaatttatgaggcatctcctagggagaaaaaaatgtggtcttacaaataccaacgaggtgcaaaagaggctgcatataactctctatccaacccccaccttgtttccatcttaaaatggcccagtgttcatctttcactggttttgcacacatcgctccagaaccacccgtcaacaattatgctttaggcctcagcattagaagccaaactaccagctctagggcctcacccaaggaaactccagtgattctaatcacttcaagtgactctaatcacatgaagtctcctcgttttcagcaacttccttgttttgagcattctcagtccagaagaggcggaaagctgcggcccaccttcttttccacraaggctgacaggacatgggtgtacacatctgactggtccagcaccgcctgggtccgcaccggcctcttgaggagcgggctgcttcggytctgccctgcttccacygcctgaaagaaaaaaaccacaaactatgatcttcggcatcttagaggaagggtgctgtttacagttcatccacaaggactgaattcttcgatgtggacccaggatatgagcggaaaacactttctctacttagatacaactttttcctgtgcgcatgcctgtaatcccagctactcaggaggctgaggcaggagaatcccttgaacccaggaggcagaggttgcggtgagccaagatctcaccattgcactccagcctgggcaataagaacaaaactccgtctcaaaaaaaaaaaagcagttcagatccgtgcagattatgcaatagctgtggggtgtagcctgagaacttgcatttccaagaaactccagatgctgctcatgtggctggtcagtggcccacactgctgagtcatgacggtttatggagcccagcagaccgtgtgggacggcacagaaactgccatttgggatcagacctactgattcccacagcccagaacacccacagcaatagagtccaaaaggactcagccatccctcacgtctggcagcgtaggaatggacactgtcccagcaactggccctcttcagtgcctgtctcagacctcttacccttccatgaacagctaaaggggagtggagttctggggcttttgttggtttaaaaccattttcagcctaggactaatcagatcctggaattgaaataattcattctccttgtcctaaacttttcttctggcttcagaagatatgatgtacaagtaatacagcgggaattggtggcgataagccatggttattaccttgactacaaacacgcctgctaagtgctaacactgaatcgtcactatctcaacaggattctttcccaaaagggaagaaaggtgtggcaaatataaatatttctaatttaattttctaagtcctcactctggcataacagaaaaatatacaaaatattgcaaagcagagactgatttttctcatctataacagtagaccaaggatctacaggcaagatcaaacacagatgggaaaaacaaaaacagtgaaggtatgaagtgagatgcagccgccagctcgtgggatgcagggaccctgaatttactactcctccactatcccccactactgccaccttgccctatggcaggcggcaaatctcagcgaccttattctaatatataggaaacaattttgcatcataattacttagaaaatacccgggagggggtgggggaggaggaccctttgtcatactccatgtaactcaccatcgcataactctgstcggcatccaggtactttttatactcatggttgagtttatcaaaaacagtggctatcacgggcagcgatgctctgtctgactcacttaacactggaaaggcacaatgttcacacacggatcaaaccaacttcatgtcagcttcagaatttccacacgttgctatgataaaaactaatctcaaaaggttaccaatgcaaaagtacctttaaaggacactctaagaaatacaatactttaaagacctgacagctagatgtcattcgcaacccctttctggttacggttaaaaaaaaaaaaaaaaaaaaaagctatagcaggccaggctcagtggcacatgcctataatcccagcactttgggtaggccgaggcagaaggatcacttaacgctgggagtttgagaccagcctgggcaacaaggcaagaccccatctataccaaaacaaaaacaaacaccaacagcacatattggtaggggattattattattatttttttttggatacagggtcttgctctgtcgcccaggctggaggtacactgacacaaacggctcgctgcagcctcgtcctcccgggctcaaggaatcctccctcggcagcctctggagtagctggggccacaggtgtataccaccaaactcagctaattttttttttttttttttttttttttgtagagacagggttttgccatgttgtcgtccaggctggtctcgaactcctaggctcaggcaatcctcctgcttcagcctcccagagtgctgggattataagcatgagccaccatgcctggcctcagtaggggattcttaaagaagacacatatgcagtgagtggcttggattttgaaagaggtgtgtgtgaaggccaggggtggtggcccactcccctcctgtgtgcccactttcattcagaaccatcccatttattgttcttttctaccagtatctctacaaatcatctttccatttagcagcctttcctagggggtcacatagccacccctcacataaagaatgaggctgtgggtcacagacaagacacaacaatgtagcccacatcccgataaaaagtgttgggcagcacaggcctcacactggaatcagagcaagggggaaggattcaacttactctgtgaacagacagacaggatgaccatcttgcattcctttctctggaggagaaagtccatgagtcttcctttgtctggtaagagatttactatgggctcaagtttcacttggaggttccagaggtaacctggattttaagaggcagcaaataaaacagtatgatgcaaaccgtaacaaaagcccaaaagtggttcccctaaacatctgcggggcgggtggcaggtggtgataaaaagccgcaaagtacagtcagtgtagcttttccttcctaaccaaagcagagctgagccattcaggagcaattcaggagcgtgtctaccacaggaggatgacagcccaaccaccgcacacctggctgactcttttccaagtaacctctgcattcaggggcacatcaaaggtgtagctcctagtccttcattccaaacggggacttccctagacctagcccctcttttaacgtttaaaatagaaaaagatgtcaacacgtggcatcaacttcagtcctgtgctttggtttctcctacaacagctcattagtttaaaaggtaactccagaggctctcaatggaacatcataactcatccattcatcgacccataaatgtactgatcacccacactgccagcatctggtgtggcctttcccaattgggatgccacaggagaatgaagtgccacataaaaaatcatctgggtgacccccttttcagttggcccaaggcaggtacagagcagctgtacaggaaaacaccagcgagatgcacaggagagaaatgacttcattacatacatacagtggatgtcacatgaggctatgggttacagacaaggcacaacaatgcattacatacagtggatgcctacagcatcagggctaattctctcctcaagagttcttaggaattccagaggaaaggcaggaaaatacacagaggattaaagagtaacataggagattctctaataaccagcctggcgaggtattagagacacaggggcaacatggcaagaccctgtctctacaaaaaaaaaattataggccggctgtggtggctcacacctgtaatcccagcactttgggaggctgaggtgggcagatcacgaggtcaggagatcgagaccatcctggccaacatggtgaaaccccgtatctactaaaaatacaaaaattagctgggtgtggtggcgcatgcctgtaatcccagctactggggaggctgaggcaggagaatcgcttaaacccaggagt

SEQ ID NO: 17763 - DNA, 26180 bp, Homo sapiens
cctattggagacacagttcccacagactttatgacacagggcttaagtttttttctctgtgcctcctgaaagagataactgtgatccataaaacagctgaaatattagaaaatatataaaagtcagagaaacccatgtttactgcaatatagttataggactaattataactaactgagcctgtttaaaagactcacggcttcaagagccattatataaaaaaatttcaggctgggcgcagtggctcacacctgtaatcccagctagcactttgggaggctgagacaggctgatcatttgaggtaaggagttcaagaccatcctggccaacatagcgaaacactgtctctactaaaaataaaaataaaaaaattagctgagtgtggtgtcatgcacctgtaatcctggctactggggaggctgaggcaggagaaccacttgaacctgggaggtggaggttgcagtaagctgagatttcatcactgtactccagcctgggagacaagagtgaaactctgcctcaaaaaaaaaattcattgtttgattaaggtgctatataatcaagagtaacattctaatcataatagaaagaaaaagaactgattctcaaagttgacctcaagcataattgtgaagcagggtttcactttcacagcctcatcaacattttccttccactctgccttcactccaaacacacacaacaccctcaaatattctgagatctatcattttacaggagagagggacaaaaaattaaatctcagataattcccattaagacgttagacatttgtcatattgttttccctgggccttaagagaaggcaatgcacactgagttaagttaaagcagagggatgactgcctagtagtaagattgcaatcattgcatgtgataggcagaggaagaatataagtcaggaccctcctgacttataccccacgattttggaggatcatgcctaggttatattaaataacttttagggtactgggacagtgaaactgaatccagcaagagcttaggagcagaaaagaagtccagaggtagaaataggagcacacttcattgtatcaattaataacaaaaatgaccctatacactccacagcatgaagaacgttgccattttgccattggactgtctattgggaccaattaaatcatgtggactttacttgtaagcaattttgccaattggctgaaccctttttttttttttttttttttttttgagacggagtctggctctgtcacccaggctggagtgcagtggcgcaatctcggctcactgcaagcttcgcctcccggtgaacccttatttttattgttaatagaactaattactttgaactctgatcccctgtacttcaaagacccattctcctatcatatcacctcttctcattgtcccattttgtttcagtaactaacattctttacttcatcacayrtgaacatgcattaaggacaccagaatgaaatacttttctattccttagagttaaackccacttttccattccttaggtggcccaaaggaatgggtaacmaagccagatacatttaaaagttattatttctggaattcttctactcagtttgtttatactttttttttttcagtttggtcttgacacacagacaagtgtgtacccaactgtctactttttatatttgggtgaatacctggaagtggtatgtggcagaaggctaggataagtagtagaagggaacacaagcacactgttaactttaaggctaacttactcctctcctccatttcactccaagtaaaaagatttctagttctgtatttcactctgttacatttcttaattactttttaagtatcctcaatgtcctaattcaacactcagagtgtattctcctttgtgttatatggtattctgttttctcaatcattttccccttacacatctccaactttccactttttaaattttattctctgtgctgttttgttttcaaaccacatggaaccaaagcacatacaaccattactctttaccaaaaaacaagctttgtatgagcttcttgagcctcaaacaaaagaatttacacttgaacctgattgctttgaatgtggcattactgttctggcttctgcaattcagaggccctgctttatggtttcggctttctgttttccatttatgtgaaatgtcctacaaaaataaatgtatttaacaaataccaggaacatagcattacaacaactttcatttcttggccaatgggccagacattgccatttaaagatttgatattgatgggctagaaactcaaaaaaagaattagcaacattccttcccttctcttatggcacatactgcagaattgttcacgagaagaaaatctcatggtcaaaagtgaaatcagctgtggatcttatcaaagcaaaaaaagctgtttgtatcttgatgtagccgtggcttattattattattgtcatcatcattatcatctcagatttgagtggaaaggaactatggtttctccaattttgtgaataatagttttgttattgaacagggaacacaatgtgtggctagattatctcccgcagggattgcaaacactgtattgtccccaaatgtggtagccacatgtttgtttttcagctgacagagtcctaagccagagagattttagaggaaatgaaggagagtgaaaatcaactaagcttttcattagcatgtgtgacaaagggtagtgtgtttttctcttttggtagtgtgtacatgttttaagaaaataaatattgcacatcattactgctctagtcagttatttatactctgataagaattttaaagtctgttggagcaaatctggaaaaaaggatcaacttcattcagctctaaacttttagtgctcacgtgtgcaagtcaccattatggtatactacacttcggaacatatatatgtgttcaagaaatgtttgtaaaacaaataaatatgtattgactttcactattggaaaatatgtagaataagaaaattgcagtctgcagattctaactcacacaaaatgcatccaatgttttaaactccaactaaaaaaatttgattaaatattaataatcataatgaacacattattatcaatgaatcgaaagtaattggaataacttgaatattcacaaaaatcagagattttaaaactaggaaaaatactttagaaagaatttggttaatccttgaatcctaaatataacaaaagccagagatagtaaacaaactgtccaaagagacacagcttttttttttttttattggagcactaggattggaaacagggcattttatctgggatccagtgtaaactttctaccctcccattaggggtgctgctttggtctgccattctgacactatgtctggcatagcagaggtcttccctcaggaaccygtggtcaagtaatarcagtttcagacttctctagtctagggaataagctgttcatgggcacatgcagagcctttttcagatgagggataattacattctttcgtttcctgcttctcctgtaatttggcctgtccattgaaattataatctatacacctgtttcttctttttcactccatctttcttagtgggtttggaggagttgagtagtttaattttaagcactgcagcaagtctgtaaaatgacagctagggatgtctctgacccttatagggagagtgagatgtcactgttgacttgccatcagtgggaattgcatttgaatgttcatcttcaagtgcaaattatcatgtaagtaatagatttgccaacacattggcgagcttccatgtgatatttccctgtgaccaaggatgctgtgcggtcatgggcaggggaaatctaacttgactcaaactgaaccaaacccatcaccctgaactgagaataatgtgaactgattaggtgacagaagcagccacaccctgctcagtgtcagtcagccttcttaggtggaaaacaacagaaattgactctgaccatgttcagtcacaaaggaatgtatgggggggatgggggggtgggtcggggagtaagaaagaaagaaggaaatgctgaagaaccaggtcttagaatgtactcacctaaagtagcttgggggacggggcaggggacggatccgtgtagcaagacataatgggcactttttcatttgtttgtttgttttttagatggagtctcactctgttgcccaagttggagtgcagtggtggatctccgctcactgtaacctctgcctcctgggcttaaggaattctccgggctcaagcaattctccagcctcagcctccagagtagtttgggattacagacatgtgccaccatgcccagctaattttttgtttgtttgtttgtttgtttgtatttttagtagagatggggttttgccatgttggccaggctggtctcgaactcctgacctcgaatgataatgatccgcccgccttggcctcccaaagtgctaggattacaggtgtgagccactgcgccaggcctgggcactttctttagtagtttgaggagcaacatttttgacagtgtccttctgctcaagattcagatcccagataaaattaaaccatctagagagatggcttgattggccaaacctggatctcatgaccacttcttgaagtgggtaagtctcataaatgctcagtccttccactatgcaactgagtggggtgggtgggaagcccctcaaaggaaaatccggttgttcttactagaaagaaaaggaaaatggatgtgaggcagtcaaaatcagcagaggtccaccacaccaccaaaatgtggtgattaaatatggagagacagagactaacagaggtatgtgaatattgaagtatgtctggacaatagcccaatgatgagaccaataaaatggttaccaaaatctggttttgagtagtagtgttaaatcagaccatttagtaaccattttttgttgcaaagtttctagcactgcccaaaccctgagtggtatatgaataactcgtccattatgtatctctttccagtcagcataatttatcccccacctatattcttttctgaccactcctacttccttctctttaccaaaatctaaactctaaggctgtttcttcagcaacttctttgtttagattggaagataaattaaacagcatgcgatgttttactgactttcagtatttaacagaggtgatttaatttttttttaaatccaaagtcaaacttctttataagatgaaggagaaaaatgtcttataaaatgcatatgtgaagatgccttctgagtgctttctcatgcagacttgttctagtctttaatgaatcttccttgtagacactgtggagatgaaagatggttctccacttctactcaaagtacaaatcaggccggcattttgaaaaagagacaggtttattcatagctgcagcgttagctggctttgttccctgtacaatttcacttttggttattaaaatattcactgtaggaaataaatttgtaacccatttctcatattacctacacacagaaaaacaaaatttgatatcctggggtttatttgctgagggcgcttcccataaaagcgagwgagtgtgcgttgggaaatgtgtctggttaactcttttatggataaactttagtcacaatcctcccccgcccccctctcacccccagcaccctcccaacctcccgacttcccgcctctcaagggctggtgacctaatagcatttttcttcgtgcatattttggcgtcgccccatggcctggctgccttcgcctgtctgagttttttgaaattcctgcatgttcgccccagattaagccagtgtgtctcaggatgtgtgttccgttttgttctttccccttaacgctccctgtgcaacgtgtctggggggaggagggcagggacgggagagagggaggggcagaggcgaggagctgtccgccttgcacgtttccaatcgcattacgtgaacaaatagctgaggggcggccgggccagaacggcttgtgtaactttgcaaacgtgccagaaagtttaaaatctctcctccttccttcactccagacactgcccgctctccgggactgccgcgcsgctccccgttgccttccaggactgagaaaggggaaagggaagggtgccacgtccgagcagccgccttgactggggaagggtctgaatcccacccttggcattgcttggtggagactgagatacccgtgctccgctcgcctccttggttgaagatttctccttccctcacgtgatttgagccccgtttttattttctgtgagccacgtcctcctcgagcggggtcaatctggcaaaaggagtgatgcgcttcgcctggaccgtgctcctgctcgggcctttgcagctctgcgcgctagtgcactgcgcccctcccgccgccggccaacagcagcccccgcgcgagccgccggcggctccgggcgcctggcgccagcagatccaatgggagaacaacgggcaggtgttcagcttgctgagcctgggctcacagtaccagcctcagcgccgccgggacccgggcgccgcsgtccctggtgcagccaacgcctccgcccagcagccccgcactccgatcctgctgatccgcgacaaccgcaccgccgcggcgcgaacgcggacggccggctcatctggagtcaccgctggccgccccaggcccaccgcccgtcactggttccaagctggctactcgacatctagagcccgcgaasctggcgcctcgcgcgcggagaaccagacagcgccgggagaagttcctgcgctcagtaacctgcrgccgcccagccgcgtggacggcatggtgggcgacgacccttacaacccctacaagtactctgacgacaacccttattacaactactacgatacttatgaaaggcccagacctgggggcaggtaccggcccggatacggcactggctacttccagtacggtaagtacccccaagtccgctggaagcacccgtgcacctggtccccagctatgtggcttctcgacgtggctgcctgggcgcggcgggccccggtcctcgcagatccgatccctcccccacgcgcctgcagtggcagccctggaatccagtgcaaaccgcscgtctggcccctcctgcttccttttcacattgctttgcagtcccgggcgtccccagttctcttgctgtcctccgctccactctgcagtcccggtgggcgaagggtgaggagtaagggacctagaggggtagggagttggagcggggggcgccgggttgtttcactgctgcgcccgtcgcctgctgacgtttaggtctcccagacctggtggccgacccctactacatccaggcgtccacgtacgtgcagaagatgtccatgtacaacctgagatgcgcggcggaggaaaactgtctggccaggtacgggctgatatgtctgaggccccgctccccggtctaccttcagggggcgctctggtgcctggttctgactgctactgcttcgcgcagacaagtgttaggaagtgggacaagagctgggaagtgggacgtgacctcctgggcatgctgacctggacggagagttaatatttttgaagatttctgtgggttctgtctcaaagtgcagcaggaatcacagaggtggaggaaacccttatcctggagactgaaagtctcatgctctttttccaagatacttaaacttgggagtcaattgttccaatcacttttcataaaacaactatacagtaattcaaaaaatttattgtaatggaagggtgtgttaatacccccttaaaagattcggggcaaatttgccatcgtagcctcattggtaaagactaagttttcctcttttgtttgagaccacgatgaacttggttgttttggtattacttcagccagaataagaccgtgagcaagagctttgtttttccactattctaaaataaaatagtaactctgggattggggttctctgggtttactgctgggaaacagcagagggagcaaaagatgttttaataaaaatttaaagtgtaaaataaggtcatcaataccacctgaacatatagacacactaaatatattagtaggaacacagtgatgtttatttgtacatttcttccactttgaccctttataattgtcaggctaaaggaagtgaagaaatccaagctcattttcattcctgagtcttgcatcactcacaccattgaactccctatgatgtttttacagtactgccattgttttgggatagtgaagttacaaaattattaatttaaatctgggtatgctcttttagagttatttcctcagtttgcagctcattaacttttttaaaagttttgttaagtttgaagtttgtaataaacatctatgaattattttttttattggggrattatttccacttcagtttcactcattcatatgatcaaacttgaattgattctaaagtttacttctgacatttagatttttaatgcttattatgtttttactgttaagatctgtggatttccataggtgttattcattcacttattcaccaaatattcattgagctctgactactccaagacggttctaggagctttggattcagcaatgaacaaaaagaaacaaaatgccttagactcttggaactgatagtctagttgggaaaggaggattgtcactactatataatggatgttttatttgtagttttgtctttagttaatattccatgaatataataatttttcttttttcaaaatcacagtacagcatacagggcagatgtcagagattatgatcacagggtgctgctcagatttccccaaagagtgaaaaaccaagrracatcagatttcttacccagccgaccaagatattcctgggaatggcacagttgtcatcagtaagtaaatgggcctcctgggtacttttgggttgcttttcatttctcaggtgatttttgatatcacaaatgcaagtcttatttcttacctgaagggagaaaattgctattacttatatttagaatttttctctatgtaatttcacataacccatctactacaagatcctgttatcttttgaaatggaaaatctgaagcccagcttattaaagctgttgataggatacagcaattgacttcaataaaatttactccaatgcattacagataggatttctttaaaagtccattacagccaagatcatctaaagttagttagcattrratagcatttcataaagaccacacgttttttatcacaagcattcagaaaccattctcaaagaaagatgtagatgatacatcccatcagctcagaaggaccttcttccatcttttaaaagacctgtatcaagcccaaggtggttgccttttctatcctaaatttaaggatttttgcataaggtaattctatcatttgccttagtaacttgcctgggtgtttattttcaggaaatcctcatgtgtggccttaaacttacttcctgaaatccaagccagtcctcattgttttttccttatgtgggaagatgaacagctcagcaccttccatttaatgaaataacaaaagtagatataagtcccttaatttcctgataaaataggaatattttatttctaaataaaagtgtgtactatttaaataataatggtggataaaacatgccatgagttctcccttgcttttcactaatgattttaaatatgtgagaactcaattttttaaaatctcatagaaaccttgaaaaagtcatgtgctgcttttcggaatgaaacatcagcagtggcagccaaggggaatacactagagaacacagggcaagtttcacttaagcacagataatttattgtccatttctatttaatattcaaagacaaaatggggtacaataagaaagcaaaatactgaactaagtcttttgtcctagtagcaaagttaaaccttacaattttgatagacttatgtcctggggaaaaaaaaaccctagcatgaatctctcttttagaagataaatttggtctcaattttaatgtgaaaacaaatttgtgaagccatgggggaagtcatttaatatcttcattgctttctctgtatgtaactgaccaccatctttttgttttgtgggacatcagacattaccacagtatggatgagtttagccactatgacctgcttgakgccaacacccagaggagagtggctgaaggccacaaagcaagtttctgtcttgaagacacatcctgtgactatggctaccacaggcgatttgcatgtactgcacacacacaggtatgttggcaccctgaaatccagaacctmamgcctcagagagaawcgggtcatctaccgttagttagcattaaatagcatttcatgaagagcacacacatttttatcaaaaggatacagmgactgttctcaaagaaaactgtagatgatataccccatgagtctagtattttctttcctctcacctctcttttataaagcattcaatttgaggtccatgttgtyaagatgtaaaataattgggaaaaggcaaatgatggcttgatgatccaaattacttttgaagtatttccagttatgcatgtggcccctattcatgatcacaggtcagtgtgggtccttgttacagtccacaatgaagaacaaaaatttactctctgaaaaagtctgaatggttgacaacatatgcacccattctgtattccttaaccggcttagtaaataactgtaaaaaaagatatctctgttttttcacctgtgaaaccattccttccttctgttttatgctgaaaatagaatagtggttgsggttagcaaatggaggaaaaataagtttctttaaaagcactttaaaaagttgcctcttttaataatgcaaataagagcagaaggacaccatttctttctccacacatatatatttaaatctacagyataattgatgtcagatgttgtttggatggatttttttaaagtagtgctgaactaagcagtttgcatgttttatcattggaaaatgcgtgtcagttaaaatctatgtcagtatttccatatgaaaccctaatttgtaaaaggacattataatttgactcccgcccagatcttggcaaggggtagtgaatgtacataactgagggtatgaagggatcagcagttggcatcttgggaagcaaattccagggctgtggcaggaagctgtttggtgacctaaatgttaccattgcttttttctctgagcttagaacatcatagcaattggagggggaaaggttaacttctacatgccccaggacagtacttacttaagaaagaggagatgtaacttacccacacattattcatgtgtgcatatacagattcccttttcagtgatctgcaagtcctgtgcaagggacctagagtttatttgcyccatttacaaaaagaggcactctggacagctcactctgaaatatttgaagctgggattgtagacattatagcacttctggttcccccccttctttggggtgaccccatttcattttatatggtagctttcttgttaatcatcttccatatatgttctttttaaccattattcaccaaatcttgcattgagcgatttatatatttgtttttttcattagatcaatgtctctttcacatggacttcatttaaaggaaaaaatagtctctcaatcacctaatgatgactcagattagtttattgtaatgctgcttaaatgtattcaagcataaaactaggtataacttctttagatttatacttttacatattaataactcttgtgttctgagacaaaaatttacatattaaatatatacgaaactaaaacagttgaattcaccttattaatttaatgtaacaaatagtatgtattgctaaaactcaaattgctgatttagagagcctcagctaacattcaacattgaatctgtttttatattttgactttgcctacatgaaatgcctatttgccttagtaactcgtttttgcttgcttgtgcaaataatcaaagcttatacttaagttctgccagcttatgaactcgagtgccaatttcagcatttttaaggctcttttgtctatttgaaggcaagataagcactgaagcattatgtaaacccatcttaaatgaatatctaatccagtgaatcctttacaatgtcatgaacattgtggtagtagtagaagtaataactagcacttattgagtatgtattatatgccagaatcagaattgtatgctggaatcagaccaaaaattcttcattttatatttactactcaacatactgttaagtgatgtatggatcaaggtaggaatctagataataacaacagaatatgagtctcactgctgtgacactgacccttctgagttgggcctgtctgtgctattgtgtgctctatgacagcacaattctcccctgctcttcccaaatcaagctacagctaaaccagcattggtagagcatgctaaggtgattttactgtctcttgggtgaccaaagtgatcttaaacagcaaagcaatattggttgctagaattgaatggcagtattgagttaaaatgaatctagcatgtactttgaatttaaattactattagaataaaaatacaagttaaaactttttgtgaagaactaatggaatcaagaatatacctacagactccaatctgaggaaacttctctagactataacattcttaaaagcaaggattgtatttgttatatttttctcctcccagcctgtagaaggcattcatttacttattgatgtgaatattttagcaagtggagtgatgtggcattcatcaatttagtcatgcatttaccccttcaacaaaatatgtcatatttcagtgactgtatgagagagagtatagtggggtagttaagaacagggactctggaccttgattacctaaactcaaaaccagcttagccacttactaggctggatacccttgggtaagttatttgatcttagtgtgccttagttttctcatctataaaatggagataatagcccctcatgtagttgtgaaaattgaatttttatacacacacacacacacacacacacacatataaatgtttacgattgttcctgccacatactatttaataaatgttagttattcaaagatacaacgtaaactctacccttagggaacttgcagcctctggttagctatattcttacatagcatgttataatgcagagcaaaaagggataaacactgtaaaagctatccacaataaaaagtatcatggacgttcaaagcacaagaaggtaatttccaaaaggggaaactggggaggrtttcactgagaagaggacatttgagctaagataattattatgtggcctttattcctgaactgttaaaattctagaactttggtagaggcctattttgttccttcagattgcatttatctctggtgatatatgacacttttaagaagtgaggtgtactactacttatattagtcctgtatcttttttagctggaggtgctataaggctgagtaataaatacttctcaagggagatgaaatataagtatagttttatgtcagactcttgtaagtactaacttaaaatttaatttgcaaataatagcatattatttatcatagtctgaccacataccataattttaaattttttattktgtttatcttagggattgagtcctggctgttatgatacctatggtgcagacatagactgccagtggattgatattacagatgtaaaacctggaaactatatcctaaaggtaaagacctttgaaaatatatcatatattgatattgcagatcaataggccctcttctctggattcaaatgttaaataatcatggtattggaagcaattatacatcctcaaactatttataaacaatctaatctaatctaatctgtcttattttaaagaacttcaggggaaaatatgcagtctctttccataacgtctccagagtttaaccamttacttaagttaaaatcccttccctgcttgatttagctaagtcctcattaacaatttccttattgtagccctatggaaaaagaaatactgaggaactctttgtgttgcccaggtcagtgtraaccccagctacctggttcctgaatctgactataccaacaatgttgtgcgctgtgacattcgctacacaggacatcatgcgtatgcctcaggctgcacaatttcaccgtaagtgttatttgcttagctaagtaattgttgtcacaaataatttttgttcatgccaaacattatacatagaatgtatctgtttctgctactacagcagctttcttgtaagcagaccaaaggcagaaaatggtatgcagtctgattttatttttttaaataatggaaggcaaaggagaatgtactaaggtttttagttttcaggagaagcttagttttcaggagaagacataaacagaccacagtgtttacccagaaggcatttgtgaaggcccaatatatcaaattgctcaatatgtagagtgggtgagcttgtagaagccccagtagttgcttcttggccccttcctcgcagtccctgaaagaattgctagggttcttcaaagtacattttgaaaaccactgccataaagtaagcaactgaagagttcagccccctctggtctgtacaaatcaagatgtcatatatttgagttctagaaccattgatactaggraaatactctgcaaaagattgaggtgtgtggaggtttcttcataatattcctactcctgagactcttcttagaatgaaatactggaagatatctattcacagggaggtgctctgatgaaaataatgaaaaaaggttgggtaggtttgactgcatgcctgtctgtcctgccccatctccttaagcactacctccccaagtgttgctgggtgctagattataattacatatgccacttgagttatgccttcccaacaatgagaatactatttccattggaatgatactcaacactcatcagctttgctttgtcactggagaaccaccagtgccactggatcatacagacaggtatagcagagctatactagaawctcataattaatagaaatttctgcctgatacaaaaacccaggactttctacataaagaagcagagactgtgctttacaagtgttgtcacaacattagagatagatgaagcctgtgatagcaaaaggatagcactgaaaaaacagagtcacatacattcttctgaacatgcccacagcacagaaaacctggcaggktttatggcccatattgtgtggagttggktatagtagaaccaacccccgacccccaccgccagaacaccattataatttaagctaaaataatttgcacttaaataaacagattagttttttcttaatttttataattccttaattwattcatccattctccatttatttattcatttgcactctcatttttgtactgtttgttgatgccctgagctagatattactgaataatgcaaacataaataggactactaatctctatactgctgtagccttattacactattttcagttaattacttatgaatttctttgtttaatgtctgtctcctgctctactcagtgatggctgtgatttagtctcttgtccactgttgtatacccattgtcaggtacaggtctgccaccttgcagcctctcactcactgcttaatgaatttctttctcaaataatttgagtaaaggcattttgagtaggggaagtgagagaattacacatataactgtaatagagatacaatatgagaagtttcatgagggataaaataaaatgtggtgagatcagaaggacctktgctataagtttggtaactcccaactatgtcttactgacttcccactagaaataggtctggaraggtctgttgcatagaatgtctcttgcttttaatcagtagaatccattgaattgggtattgctagatatttagaagaaataaaaattgttgtattgctccagcaatatgactgtacaagagggattcctgatgtggtcactcatatagagttgaattttttttttttttttttttttttactagttattactgactgtaacaaacttcaagagtggttgaagctggaatgtttataactaatataaaccagatgaaaatatgaaaagtgaaattataattagtgatcataataaaatgtcatacttattctgagtggaaatattggggaaagtatagaatatttgagaaaaaaaccccacaccttcaggatagtaatacttgcttcttacattttgactttcacatcaggccttccttcctaggaatcagagttcagacagaggagaggtctctttgggctgagtttcaggagtgactttaggatacatttgaattgagccttgaagtctggggaatgcaccggggagcattaaggaaaggaagcccagggcaagtcaacgtcacaggcaacttgcatggcaggaggaaactgcagggcatgtttggaaaaacaagtcttctagtttggctaaagcatraattttgtggagttacgagttggacaaaaaggatggaaaagtaagttgagccagatggaagacagccctgaagagcaggctaaaatttattctggaggcagtgggaggctgaagctttttgagcaggaagtgtaacttgcctaaggccatcaggtcagtctggtggctgtgtaagcagcagtgagtgtgactctgaagacatatcatgtatcagttcactgattgcttttcctgccagatatttaagagcattctgttgatgtgtaaaagccacccagtaaatagttgaataggtatgtgctgttaatgtaccctctctccttcattttcctcactgaaacaaaatgtacggaccaggtgactctgaggcttctttcagttataagatactatgtaagtttttttttttctcctcacagaatttactgtttggaaattggtagtttatgatttgaataagtgaattttcacttccttacatgaagatctatggtcacatttaaagacagtaatatttgattgattagctttggtccagtttctgcctattaatgtattattctacatccaaagccatgctggagaaggactaattcaagatggagcagaggccttgactctacttcttggtggacatgccacccttgttccatggaatgaattcccctggtcagggatgctggtcccagaagtcctgctgtactcttgagtgtttcagaagtggtttctttgcctctaaatgtgaagagtgtaggcatcaggcatctctgctgttgacatagtcactttcttcaaaccattattaaaatgatgtactactgcataatttcacaacatgattgctgcttaggtggagggaaactgttgcataaagtttttaaaaggttgactttaaatttgtctgttgtactcattcattatattatcaggttaataatttgtcttattttgtcttcttaatctaggtattagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctttcaaagaaatccaaatttctcatgttccttttgaaattgtagtgcaaaatggtcagtattatctaaatgaatgagccaaaatgactttgaactgaaacttttctaaagtgctggaactttagtgaaacataataataatgggtttatatatgtcatagcatagatgaatttagaaacaatgctcctactgtttaaatacatatggacacatctggtgctgagaaagaaacaaacacattaccattggtgtcaagaaatattactatatagcagagaaatggcaatacatgtactcagatagttacatccctatataaaaagtatgtttacatttaaaaaattagtagataacttcctttctttcaagtgcacaatttcattttgacttgagtcaacttttgttttggaacaaattaagtaagggagctgcccaatcctgtctgatatttcttgaggctgccctctatcattttatctttcccatgggcagagatgttgtaagtgggattcttaatatcaccattcttgggactggtatacataaggcagccgtgaaactggaaagtcattttgatgactgatgtgatacatccagaggtaaaatgcatttaaacatattaaagtatttgccaaagatacaattttcttgctgacataaaaatcacacaaacaagtcccccccaaaccacaactgtctctcaaatagcttaaaaaaattgaaaaacattttaggatttttcaagttttctagattttaaaaagatgttcagctattagaggaatgttaaaaattttatattatctagaacacaggaacatcatcctgggttattcaggaatcagtcacacatgtgtgtgtgtctgagatatagtctaaattagcaaagcacatagtattacatacttgaggggttggtgaacaaaggaaaaatatactttctgcaaaaccaaggactgtgctgcgtaatgagacagctgtgatttcatttgaaactgtgaaaccatgtgccataatagaattttgagaattttgcttttacctaaattcaagaaaatgaaattacacttttaagttagtggtgcttaagcataatttttcctatattaaccagtattaaaatctcaagtaagattttccagtgccagaacatgttaggtggaattttaaaagtgcctcggcatcctgtattacatgtcatagaattgtaaagtcaacatcaattactagtaatcattctgcactcactgggtgcatagcatggttagaggggctagagatggacagtcatcaactggcggatatagcggtacatatgatccwkagccaccagggcacaagcttaccagtagacaatacagacagagcttttgttgagctgtaactgagctatggaatagcttctttgatgtacctctttgccttaaattgctttttagttctaagattgtagaatgatcctttcaaattgtaatcttttctaacagagatattttaatatasttgctttcttaaaaaacaaaaaaactactgtcagtattaatactgagccagactggcatctacagatttcagatctatcattttattgattcttaagcttgtattaaaaactaggcaatatcatcatggatacataggagaagacacatttacaatcattcattgggccttttatctgtctatccatccatcatcatttgaaggcctaatatatgccaagtactcacatggtatgcattgagacataaaaaagactgtctataacctcaataagtattaaaaatcccattattacccataaggttcatcttatttcatttttagggaataaaattacatgtctatgaaatttcaattttaagcactattgtttttcatgaccataatttatttttaaaaataaattaaaggttaattatatgcatgtatgtatttctaataattaaaaatgtgttcaatccctgaaatgtctgccttttaaatataacacctactatttggttaattttgacgatttttttttttcaattaggaagctaaaaatactactttattccttatatgaacattcatccccctcctggcacctctaaacacacccaaataactcacaagtactgatttaacactctgtattactgaacttctttgaactattttgaactttgaatctcttctctgaataactgccgaaactcaaagataataattagttgatgaaggttatcaattaataaaataacacagaccagtcttaccaaactctaaatacattttaaaaaataggaactggcaatgataaaaagaatgttgagtactgacaggagattggcttttacactaaaaaagacagaaaatggactaaataggaacataatttcagagtttatgagtcagtttacaatatgccatattagcgatctcatgatgattcagaccacagtctgggttaaagatgtcttgacctctgaggctagcataacatatatgagaatacaacttgcctatttccagaaaatctgtatatttttatagaataactttatttacaatttctatcatccaattactcactaggcattatttgtagtactttttttctctttgaaatctcataggatagtcacacttataaacattcccaatattcggattctagaagaaatgcaattcattaaaattttcctggcactgagagttaatctttagcagattgcatgaaaatactgaattcctggtaaggagatattttgttttaaaaataatgtgttttgatacgaatcagtgtattaactgataactaaaaagtactcttttttctatatatacatatttttttgaactcatattcacaatcaacatattcaatcagtgagttaagtctcattcctagctaccaaaattcctgggccacttttaaacactaaacatttcatttatcctctaagctaaaatggtgctgagttatttaaatctgaatgtaaaatgcattaaatcttagcttgtggtatataaacatttaattaatataaaactgcttgctataaactaagtaacatgtcatttggtgttaggtttttagtgaagttttagcttctcccaaatttttcaggaatgttatttgtaagacgtgtaacttttttgaagaactcttattttaaatgctcagacattggctttatgttcctctttgcattctcatattcttttattatacatctatactatgattgcaagattatataaaaatgccttgaataaatgatttcaagtgtctatagtagtcatttgttgttatataaataaatcatctgattttcattttagttgaaatgttataagccatggatatggtgttagtttctcttaattgccttttgtactaaaaaattgtttaattaggtcacactggaaatttgtctatgatggataaaaatctagctgatgttttaagtagacactgtcatacataaacttttatcaccagtaccagctacttataaggacacagagcaggcattgcaagaacaatcacactgctttaattaaggtttacaagaaatatatctgactatagatataaacacacacatacacacacacacatctaattctagctacaaattatttgtataaagagacacattgctatcatagtaatccttatttaaatatgcaccagattagcctgaaatctggtaacatgagagggcaaacaggcccaaactttgggcaagtgttttgggggaacaactcacaaaattaacccacaaaaacaattcatccttaaggagtcttgcaggtaaaacagatgtagacttctggctggcaatttgcagatttgagttgtagaatatcagtgatacctgaaaccacaaatgtcctgcttctatctcctgctcaaggcaaagcatctgaatatgcttttgttattaattcaaagatgatttcctttgtctcatcagcatacagtgtttcaagcactgttcattaattagctcagtaaccaaagataggggtgtgtagatctttcctttttgtctgaaaacttgtctgcctttatgtgactcatttgttaatacttctactccttaccacagatattagtagaggattaacacacaggttgaataaatcactttcatcgtagtaatttgtagcttaaaatcagagacctttccccatactcctttttaatttggagagcaaataatatttatatagaattaggacaatattgatttcctaaagcatgtactaaagagttccagtttcacaagatactcagaaagaatccaatattaagtaagtatgggaaatgttctttcccatactttgggagattcacaatactttttagcatatataagtgtctgagaaatcctgcagtaaagaaaccactttgttatctagtgtttcttaaatttgttttgtcacgagtcttttttaaaatagcacttattatcctagtatacaatttttgcttggaaaactctgggatataccatcttaagtaattttaaatttgtagaaatgagatcatttggaatgtatttaaaataaatgtggcagcatttgagctataggacataaggatactggatatccaaaactcactaatttactgcctgcttcactttctaaaaaactacagaacatggtgaaataggaccttttcagtggaaaggattatttaactctctaaaccatgttctattttagaaaaaaatatgtctttcctatttgttagataacttgaatgcttttaggtaccgcttattaaaatctcttccctcacaaatcttagttgtttataacactagggtgaaacaatcattttcttcatggttcattcattttgtatacttaaaattatgttatgcataattgcataacttaagtaattttcagttaaagttttgtacttcccattgtgggcagagaaaaatgggactggaaataaatgacttggaaggatgtattcatatatttacaatttgctacaaataatttgtttgtttcttaattatgggaagtaggcacaaaatttggagagagaaaaaaatagagctatataaccaaaaagagaaccattaaaacaattaccaagaatatgcctgtgtcactgttagaaacaatattgccagttctcaatttacataccaagtcgaaccagagctcctaacacaattgtataagtaggggctaaagacaaatttaacgatagagtctgataagagatcgtttgtttgaaaaaaatgaatcaaataatgttgggtcttcatatatatgtctttagtgaattaatgcatgaatcttgagtctgacaatttggagccaatactaccagctagtgatctgcaaactgatgagctaaaccattgccacacagctaatattggagtcaagaattttcaattatttttgacattattttttagaatgatgatattagaaaaaacccttttaaactgatttattgttgggttggtgctggggctaagattcgtgaatgaaaaacaacctggtagctgtgatcacttcacgtttgttttaggattctggtttctgccgacaggcatatatcttaagcttgcctggtcaaaagagcaattttgggttcatgtaaccaaaggacaagggtggagtttgctgcaggagcagatggaaccaggaaatcaaacaccagcaagatcacattcttgctgtctattctctgtttctttgtgaatcaactttattttcttggtttcattgaggtttcatgaagatgcaaatctggttgcctgcagaccgggttacatatgtacacagcttattgaccagaaaaaagcggcattaacctgtgctccaatttgaaaagctcaggggaaggtatttcataagctcagtttgtgtcatttaccaatccttgacccagtcgttgtagatactacagctgatacaaatcaagtcaattgctcttattaatcactgaagtaaaaaaggtgaggtcaagtaagaggatgcttcaatccaaaccacatgactgcattttggcttatgtgtgggtgtgatgggaaagtggaggaaaggaaaatgattgcccagatgagggtgagttattatggatattgccaatgagaaaattaccaggaccatcaagccaccatgtttacgtccagcaaaaagattaataaaatcaacatctacacaatccaactcaaaatatttccttccaggctgctcacctacctgatttctgttaagaacccccttattcatagtatctaaggcctgactttctctccagaaagaactaatgccaccatcttctctacttccatattactttcctccccgtttgcagatctaactagtctgctcattcccacctcgtcttctgtgtttcatgaagtcttagtagggcattttaggaggaaagcccattcttaacaagtgagagaagatccaagttccttcttattcaacatgtcacactggagttccaaaaaggagggtcaaggcaaacagaaaaagaataagagcaagagagaaccattctttcaagcttttgcttctacaattgctactctttcccactgaccaccttcaccatccctctatcctgttcttggtctttgaccattagtgcgagtctccctctggaaggagcacattagggtacgttgcactctttacttctgttagttatagtgtacttttaacacacttacagacactatagaataagtacagtccaaaggctgggtagaggggaagggaaaacttcagagaacagtgcagcaaaatacccatgttcttcaagaactgcagagaagttgaatgacagtaacatgggaagcttgaatgagagtaacaagtagtcagctatatccatccctctcccaatattatctcttgctactctcaccattccttttaattaggggtatagaaaaatttacacatagattttgctggggtaaggtgggagatgtgtgcaggagtgacagctcatcccaggggttcctaaacctgagtccaagaatatctgtgactacattaaatttgcattgcagatcagagatgtaaggggatgaggtcagagggatgggataaaaaacacatacatggtacagtttcctcactaatttaggcaacctgctctctgggaaataacagacctccaacctcaagaaaataactttctccaaggtctagactgaccagagatgccttttagtccacagggagttaccctgttattctttcagagtttgagaaggcttgtcaggagtgagtctcacaaagccttgttgccccatctcctaccattttctctgggggaatacttctgagtaaaagagacttggaaaaaaacgacatactcttcttttctctgtcctcatgtttaggttttcacaatttaactacaggggatcctctggcattctttctctttcaaagacctgacaacatgaagccagtgggaacgctttaacctcaatgttggtctatttgaattttctagaaaaatctaagaattggattttccccatcagaatatttcagatcttcatcctggtttcactgaaataattttagttggttggcataaataaataatgctcatttcactgaggtaccatgctaccagtgcttcacaaacacagtcagttcacagaatcacaaatttaccactgctttggggcttatctaaaaaatattaaatcaaatgccccaacaacatgagaggccaaatttctacattgcagtcccatttaaaataacaatgacaacatttttagaagctagttaaggggaagtgtgttagcttttgtgagaaagcccagatatataacgataggtattaaatatttaatgagttgttgctacgttctagacatagggctttatacacacacacacacacacacacacacacacacacacacacactatctcattgtcttctcacagctatgaagtaggatctattattttcttcattctacagatgactaggaggcttcaagaagctaagccattgcccaagttatgacaattccaaagaaaacccaaggaaatcaatcaaatatcttagaatgaatataaatccaaaaaactaattatgtaaaagatacaaaaattttcttaagccagtaataaccaattaaaaactgtacttttcaaaagattttgtttataactagaaataatcttgacatggtgctcatgtgaagaaaaccccaaatatttgttgaatagagaagtgtactatgtcattctataggaagactgaa

SEQ ID NO: 17764 - DNA, 18913 bp, Homo sapiens
tcactgttattttaggatagctctctgccaaagaccttttattatacaaaagttgagaatgattgaagttattttgcttaattttttgccactaaatttgatgtgccaaagaaacttctaaaaaacaaaaaagaaatgcataatattcccagctactcaagaggctgaggtgggaggattgcttaagcccaggaggtccaggttgcagtgagccgtgattgcactccagcctgggtgacagagtgagaatttgtctaaaaaggaaggaaggaaggaaggaaagaaggaaggaaggaaagaaggaaggaaggaaggaaaagcaagcaagcaagcaagcaggaaagaaagaaagaaagagaaagaaaggaaagaaagagagaaagaaaggaaagaaagaaaaagaaagggagaaagaaaaagagagaaagaaagaaagaaagagagaaagaaaggaaaggaagaaagaaagaaggaaaggaaggaaggaaggaaggaagaagaaagaaagaaagaaagaaagaaagaaagaaagaaagaaagaaagaaagaaaccatgaaggtagctgccgtatttctatgaaaccttccctccagaattagttccttttagcatctcattcagacacatggaaagcttgtttaaaatgacttcacaaattagacttaatgaagtgacttgactcaactcccctcaccctcaagtggtctttccctgcatcagagtccctttagtttcggatgtcactcatgacatagaatgaacatttaaaagatgaggaggcagccactggctatcacatttttctgagatgtgtgaaatatgattctaatattaataataataattaacaaacaataatatcctaatataattattaatcatgaattattaatacataatcatatcattattttctcttagtctaatttataggttcagatgtgtgcatgcatgtgtgtcagtggcactcagagaggagatttaaatagagagtgggaagggagataaaagataactgctgcagcactggagcaagaagccaaggggaggtatccgttaaaaactttttgggatgtgaaccttttgtttttctagattctggatgccggaacatctgttttttgagatgcatctgtaggagcatttttgtgtggaatatttgaaagttatcttgaaagtaaaggtcagagacaggaattgaaacagggcttaattcttaaacaagaaggtataagatattgcagttgatggaactgtggtgagcatgttccccaagggtggtgagcatgtctgtgtgggcatagaagatacatgtacgaacatttttattttattttatttagatggagtttcactcttgttgcccaggctggagtgcagtggcgcaatctcggctcaccacaacctctgcctcccgggttcaatgattctcctgcctcagcctcttgagtagctgggattacaggcatgcgccaccatgcctggctaattttgaatttttagtagacatgggatttctccatgttggtcagggtggtctcgaactcctgacctcaggtgatccacttgcctcggcctcgggattacaagtgtgagccaccatgcccagccaaacatttttatttttaatagcttaatgaatgtataatgattaaatgtttagcatgtattaaactatgatttcatgtagtttttttaaccataccaaccatgatttcatatggattatttaagcataccaaccataatttcatgtacattattgcttaagatagtaatgatataaaattttcttaaaattattcatgtaaaagaaacaagtcagttaaaaggaaaatattaagtaaaaatgtacaggtggcacccaaatatggtaaaaattgtgaagcagtttaatgaataactgaactttgggaaatgctagattagagaattggaaatactcttttaaataaacacttgctatctatgattatcctatggatgagtgtccaagaaatagagatgcatatgttgtatgtttttaaaatgtacaggatgaatttacattgaccatcatatttcctgtgctaaatcaaccattattttttggactatagggagaagctgtgtttcttcatagctcctggagatgtgtgatgtgtcacaggcctaataactatattacacattttttcacaaaagtgctacatagagtagaaatgtataatagttaccaacccaagactaaatcaggcctagtggtgtggatagcttcactttgcctatgataaaatacttcctcattctttgtgtgattttcaagcaacttaacgactgttagctttgctgagctaaatgcaacatctcataccaartttattggcttggcaaagttacaaattttattacgcaaaagttgagaaaggaaagctggagaatgctaaaaacagtacaatttgctactgtgtagtatctgtattgggggctcagcatgttttatttatagatatctattaatacagagatacagaaagaaatacataaaaaatagttttatcaaatactttccagcattcaagtgtagcctcaaaagcaagaataggccaggagtggtggctcacgcctgtaatcacagcactgtgggaggccaaggtaagaggattgcttgaggccaggatttcaagaccagcctaggcaacatagtgagatccctatctctacgaaaaaattttaaaacttagctgggcatggtggcttgagcctgttgtcccagctactcaggaggctgaagtaggagtgtcacttgagcccaggaggttgaggctgcagtgagctataactgcaccactgcactccagccttggagacagagtgagaccctgtccccaaaaaaattaaaattgagaaaaaaaaaaaggcaagaacagccacagcaaactttctattggggaaaaaaaaaaatcctcctctttacatctctcccttccttcccttccctttctgagagtgactgtggccaaaaggagcattttccccctgcagtcctctgaggggtggggtggggctatgaagctatccttcatattcactcctttgtccagctcttttcacctctagttcttctccccgcatctctgtctagcagtgccttaagtggaggaggggtgggggcatcaagcttgtaaaactggtttgttggggttctccttctcccctcatttcttgattcttgggaaaatgtcttgctgggaggctgcctggcagtgccctagctgccttctgtgggcttgaatggggcttccctctgcccctacaggaggaaaagggagctgctgccagagggagaaatggagagatggacagagaaggcaggtgccacccctcgcccctgacacacaaagaaaaagacacggaaattctctctctctcttctcttctcctatctctctctctctccctctctctctctctctctctctctcacacacacacacacacacacacacacacacacacacaggcgcgcgcgcgcgcgcgcaggcacacgtcttgcaaattcaggattcaaagagacaggggcaccattatatttggcacggtggggcccttccaggtctgaaatcctgcattcttccttactatttactttccccgagctcgagaagggccaggtgtgggcggatggctggccacgttttgtgtttccaattcatattcacgggatgacacagacggggcgtggtgagtgctgttggaggcgcttgggcagtttcattttgccccacttctccacctgaaggctgggcgttgctggaacctgcaggggcagcctcagcaaggtggggtggcgtggagtggggtgggagaagggactccagctgaagtagaacccaggctggacctgagaatattggggagggcatgggcggtggtttccgggtaggggccttgaggacatgttggtcctgactgttgtcagtgtttggtcaaagttgccaaaaggttaaaaaaaaaaaagtagggggagtccctgccaagacatatttcccaggccacctttcttccgcgggagtgttgggggggaggcgctgcttggaacctgtgaatgtgacatcagctctcctctcctctcccaaggtcggctttggagagggaggtcagggcacccttgcctggcacaggcggcagcgctggcttccggctcagtgccgcctgyyctccgggagctgtggcctccctgggccccggggctaggctgaggtaagcgcacagcggaggccaggggccccggcagaggccckggggatagggtggaggcatctctgggtgtgggtgtgggtgtgggtgtgggagggagagttcttgcctctctctctcccatctccaactcttgcttcagtggctcttttagaggatgcatgtcattatggacctgtcgctgccactgtccctgttcccccagctgtgacttcgagggaggtctggggatctgagtctgtccaaacccacggctttgctgttgggataaaaactgtccttttgattttagaaggaggagggaaaaaaggtttcccagcatgtgtgttgtgccagtcttggaaattcatccgtgcttgaattccaccctccatccccagaaaaactggagtaaaacaaaaagaggagatggacaaagtgtgtatttgatggcatcccctgggaagagactctaaatttatcccataggtcttactgggccactgtgagcgctttggtggagaacaaacaaaaattctgggtgctcagttgtctaacctgaaaaatgggactagcggaaaaagccaatgtgttccatgcaccttttgctttctttattaaggcatgatgtcacctgtacagtaactgccctgtgtgtacttcagggggggatttcaaggttagatagacaggaaattgttttgaaaatgtaaacacattattaaatgtgaagtattatctgattccttgttcgaatggcatttccttctcagcaccaccttccttgcatattcacttaaccttgtacaagaacacctttttgccctaaatgaagacacccccccaaaaaaaagagtcccagaaaatatgtccctgcttgtgcggggaataaatagaatattctgaggtgcattcctccttcctatgttaggcaacattccttgaccctcctcggcccccaagccaggttgcgtttttttctgccatttagaagggttttcctttttgtcctagtaaaacatcagcccctgtagctcttcatctccccctggtgttcttctcccgccatgtcttaagattggtggcaccgaccaatcttaagatttaagttctgtgtgaaaaacacctttgcttttcaatcagtttatcagcctcctccgcaggggaagtgtggacacacaaaagaacttatcggggcttctcatcagtgatagggaaaagactgggcatgtgcctaaacgagctctgatgttatttttaagctccctttcttgccaatccctcacggatctttctccgatagatgcaaagaacttcagcaaaaaagacccgcaggaaggggcttgaagagaaaagtacgttgatctgccaaaatagtctgacccccagtagtggggcagtgacgagggagagcattcccttgtttgactgagactagaatcggagagacataaaaggaaaatgaagcgagcaacaattaaaaaaaattccccgcacacaacaatacaatctatttaaactgtggctcatacttttcataccaatggtatgactttttttctggagtcccctcttctgattcttgaactccggggctggcagcttgcaaaggggaagcggactccagcactgcacgggcaggtttagcaaaggtctctaatgggtattttctttttcttagccctgcccccgaattgtcagacggcgggcgtctgcytctgaagttagcagtgatttcctttcgggcctggccttatctccggctgcacgttgcctgttggtgactaataacacaataacattgtctggggctggaataaagtcggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacaggtaggcaygctcgttgacttgtaagtctcggaattacaagttagtgtgttcttatccaccttcatgcttttcttgcttctatttttccccgttctttttatgactgcagcttagagagcaagtgtctgagaattattgctgaaasstactttaagtcttctagtgtaaaatgtaaaattcctctaytgaatacaattaggtgcaattgactataacatgacattaaaataacttatcgttttattattattattccattatrtgtttccttggcttttaaaaaatgagaagagtatggacatatacaatttagtcaaatgtatgtttgtaatatatgtgtttatacaggtacacaggccatataggaacttaaatcttatttaaacactattttaatagtgtgttaacgtgtaaaatatttaagcattccagcttgaagccaaggaattgtatccagtcgttcaagcaatgtatgttcagtaaaatcacctgcagagcaaaagtctgttgactaactaccgcctccccsscccccgccaccaccccccgcaggcggtttctgggtgaagcagatgttttctttaaaatttgtcatcattgactttaggtttcttttggcaggtttttggcacccaaaacagtgtgagctctcttttcagctttattcacctgtgctgggaggggagctaggataattcttggctgccgaaggatttaggcagtgcgtgtgcatctgcccgggtcccccccgtttttagggtcagtgcactttttttgtcttttcgtgaccctgactaaagagaaaggatgtcaagggaatgaaaatcctggaatgtgtctgatcatttgaaatgtacaaaattgggcagataagctgcatggctaaattgttaggaggaagaggcaaggcagtagtggagaagggggaggcagtggatcccacacaagcctgatgcccagggattcggaattcaaaatccccccagcctaccttcagtcccctgacctgcttctcagccccaccttaggtcactggtttctatggagttaccctmctgaattgaatattgaatagttaatttctctctccaatcattttccccacctaattttgaaagatatacatcatctggggtaccctgtgccctacacagcatgtgaagtggatgggtaccccctaaagagagggtcatcctgaatggggaagtggccccaaagctaggaataactgtgatttcttgtctttagtcatgtgccaatgttaagtaagcttcagtggatagtgctgtcctaccaagttccttgtagaagccagccggattttcaacaggcagcattccacagcatttccctgagcctgcttcaagaggggtgggggaagtcccttttcaggtgtttatctcctctgcatttgtgtaatctccctgaaggtggataagccaagggcatgagggggaggcaaaaggtgaactcatgttaaggagggaaaaaaataaagagcccttttttctgtgtttcttgctgatggcaggctgtgtgcttcatctgcttttatctgctctgctagctctgmctctactgtgatccagcatgtctctcgrcgtttgaggagacatcccccactgacctgctctttctctccccagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagtaagtctctagagggcattgtaaccctaktcattcattagcgctggctccactggagcccagttttagagtttcttttctagggactctgaaggtagtccttctaacaccatccaagtgcctcagtggggacagtttccctctattcctgaaaataacgacagcttcgttcttagcaaccaaggggagggtcttctgaggccccgtagctcaggctactcatgatgggacaagcaggaggccactgcacgtttcaaatgaggaactttcagtgagagggcctcagggggacactctcacagtggcatctgatggggtttcgggaataattgccgaggtcagatgtgggttagtgcaacctgtgcttctcatgggagggtggagactgagaggcagaagtgatgatatagagggttagaatcacttaattttasttacagaaaaacctaggctcaaagtgttgaagccatttgtgcagragtgagtttgtagcagagctagaactggagcccggatttcctttgctgctatattttccctttagaaatgcccatttcagaactgaaatagaaatactgtccataggcttctctttcacctacagagaagaaaagcagatttcctccttctgccctggacactagttcatcatctgtcggaagcagtcataaacaagcacacatttactatgcatacaatgtaccgttatgacaaaggaggaccaaaatccaaacaatatcaaaccacaccaaaaaccacaaggagcctaataattactaaggtgatacttccaaagggaggactttatttcttagatgagaatgaaaatggacacattggaaattattggagagccctctggctatgagtccttccacaaccatatggtaccaccgactggcaggagaaatgtgtgaacatgtgcctcctcctcccccaaccactggggycggtggggtgayggtggcacttttagcagtatcctccgtggtttgagttgaaaataagttttaaaaatcctgtgagtcatggttttgcattgaaacctcttcccactgtgtacccacaaatagttaactaaatagaccattagaaaaggaagaaaatataaagcagatgccaagcagagatgtcctaatttttgacaaaaaagcaatgttgcttgtgtcaagaagaaactgaactttgtgaagagttgaaatggaattccactgaattagaaaaacttgttttctcctgcctggatacatacagtcagggccattgatgcacaggtgttcctggctgttgttacactttaccctctgaaatgatgctcccaagtgctatgtgatgagctccttgtgtgcccagtggaataggtgtgtccatgtgtcattttaaagactattaatyacactaatatagtttctttctctctttggataataggcacgttgttccgtatggacttggaagccctaggtccaagagagccttggagaatttacttcccacaaaggcaacagaccgtgaraatagatgccaatgtgctagccaaaaagacaagaagtgctggaatttttgccaagcaggaaaagaactcaggtgagcagaaacacctttgcttttcaatcagtttaacagcctcctgaactccttcctatcatggtactgccttcctgttttagagagactaacagagacattgaaagtcagggtaaagctgaatataacattgctgaaatgtttttccttgtgtattttaacagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtaagagggaaggaagaaaaattaggtaagaggttcacaagaacaactagccccagtcagtgatgccagcagcctgttcctccagcccttcttacccgggcaggtgaaagacttagaaaacagtagcagaggagatctatgcatcctatagattaaaaggagcaaaagaatccctcttaaatatttccatgaagctctggaatgcaaaccgatgtcctctgtacytttagcacataccatttcatctacaggtagatttcccaaccaaaatatatccagagatgcctttgtcattgggttatatacagcctttgcctctctgagtcaatgtatttaccactttccctgagaaatcraaaatcattttggggagcggacatttagaaaaagaatcaaagtgtcatggataatcaaattcttcaataagttgcagttattcagatggccaaaggaaaaataaagtcattagatagggttggtagaatttagaacatgctgtttttcaggtttatggtctttttttttttttttttttttttttaaatagggaaatgtgtttggtgcagagccaatgtcattccaaaaagctctctcttttcctggtcagtcatgtgctgggacagagaagggatctggattaggcaacatcatagagttgctctgagctgctctttggtgataacccttccaaatcctaaactttttggaattcacaagctcaaaggaggaaacctactctctgatctaccacatgttctgcatttttctatcatggtctatggaaacttctcttagaaatccagtggcaagaagttctatgattaaagtrttctgagctcaggccaggcagtcatgaactacttctgagttrtttactactgatttgtggggcagcctcagctrtcggtttcttcacacctgcttatgagagtatccatatttatggtcgcaggccagtaatgctccccacgagatcagtttctgaactaacctggaattttttatgggtttttattatgccaactattaaatcaacattacagttcttccctctgtatttctcctgtaaaacattaggcctgcaaaaaaaaaaaatctttttaaaaataattgccataaagtatttgctctgggcctactgtatgcttcttttctttttctctcttttcaactaagtcaccrtcaatttattaagatggccataactattcaaaacctatgctgagttcctcaaggcagggtcrcatagtgatgaaggttgggatggggctacggaagaaaccagaacaactctagtttatttaaaacctgtatttactgcccacttccccttagacttgaccatatgacccctygctcccattctaagcrtaggggcaggctttatttttacaatggtaatagatatcacttgaggttttatcaaagagttgcggcgggtggtgaaagttcacaaccagattcaggttttgtttgtgccagattctaattttacatgtttcttttgccaaagggtgatttttttaaaataacatttgttttctcttatcttgctttattaggtcggagaccatgagaaacagcgtcaaatcatcttttcatgatcccaagctgaaaggcaakccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacakgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttaygctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatgactttagaaaataaatatttttttccttactgtactgatttggaatcattactgaaatttgtaaggagtgggccaacgtgattaagtaccataaaggcaaataaatggttaaagacggtttcatagaaaagtgacaattagaaggatattacggtctaagctaattatataaagaattttatctgtatcttaaatgttgattttatactgcattgaggtaaaaacacaaaacaaaaaagcagctttaacacctctgtcttctcttgggtagcagcctcctgcttctccttcacctgaaaaattctccagggacttcatccattaacttggctcaggctattaggcaggattcaacagtttaagctgatggtgtggtgagagatgctttatccatattaatggactgaaggaagtaatggcaagacaaccccccaaaacatacctaattatacaaagttatataccaaagttgcttttagaaaatggcctgctcagagcaagtagaggtttccaatggctttttattttctcacattaaggatgttgtttcttaaggaacattgagtaccattgcttcttcgtgatagcctaggactggccgtgtgcccatggaggtagagacaccaggtactgattctaggtcctctgccacaaagcaccacttcctctccactttgccttggctggccttgtcagctcactggagagcacagtattgcaattgcagtattgcaaatggtcactactaactgaattctctaagagcttgattagccctcgagaatcttccttgcccttctctaatagtgtctgaaggaattcctggcatttaacaaatattagcatgtagtgatcactgtcgtcctaacagtgacacatcagaaggatttcaaataacagtcttcaggcatgcgtaatcaatgtcctgtgcagagtctccgtcctcattgatcctcatttttctctttaaggcacagtccaatgtctttggggaattgtttataaagcttactttatccataaactgtttctcagtgcgtgactctgaagaaaattttgaagttttgcccatgttgacaaggtgcttggtctgaacttggccagtatttaatcttgagcaaacgattcaatttccttctatcgtgagttttctcatctatgaaacaagggagttgaggggagtttctttcatacctctgagaaagagtttgagattacataaagaagttgaagtggcatgaaaaaaaataaagatctgagcttagaagacatggatctaatacatttaagaggaagtcagaatcagagaagccactgaacaaaacagtccaaaggacagcatagtaagtcagattgatgagttttggttgggtttttcatcagtcaaacccttgagcccccctttcccatgcttcctgcttcagtatccagtaggaaaaatgaaagggatgatgtagacactctagggcatgaggatttgcagtaaataagttgggagactcacagaaaattaatatttttcaaacatgaagacgaaacattcaattatattacagtccacatcagcttgaagggtaaactgatgggatggtctgtcacatttcttgctctgtttccagtaaaagcatggtttctggaaacccacttaggacagctttctctctttacactgatagcccaggcaagctttgatctcagaactccagaaaccagagaactctaggtggaatgtggtaacttttgccagggcagagggaacacctactaataggtacttcatttgcaccaccagagattggcatcttttttgatggatccactggctttgatactgcctgtactcccccaaaacacagcttgggtattggactaatctagagctccctcaggagaactcttgctgacattaagaaagagcaacattttgtctttccaggtgaaaatccaaggcccaaaaagggaggtgactcacctaagatcacagaaggagctgtagcatctctggagcctgaacacttaagttaagcacgactatttcagccagagggcccctggaggtctgcagaaacagatgcccaggcaaaccttgctagaaggctctgggtactaaagccaaaatcagtctttctgaaagctttgcctcccagccttgtagacagtgctagcagacccatcccctcaagaggaaagagaagaaatgcaggggaagaaaaaaggactataaggaggctatctcatggcatcgttaagtaaatgtctataggataaaatagaatataaccaagaatttttaattattatttttagactttactcaccaaagaatctatctgagtgaagggggaaatctctcggtcagttctctttttttttttttttttttttttttttgagatggagttttgctcttgttgcctaggcaggagtgcaatggcgctatctcagctcaccacaacctctgcctcctgggttcaagcgattctcctgcctcagcctcctcagtagctgagattacaggcatgtgccaccatgcccggctaattttgtatttttagtagagacggggcttctccgtgttggtcaggctggtctcgaactcctgacctcaggtgatccgcccaccttggcctcccaaagtcctgtgattacaggcgtgagccactgtgcctggcccggtcagttctcttttactctacaatgcaaggcagtggtctgcttttttttttccccctctctgtttctaaggtcttgaaaatgcctgttttcacatttaagttctcaatgtgtaaaacactgctttcaagcttatgttcttaatagagtcccttctgcattggctttatctcacctttatactcacagttcctggggactttgggtctggagctcagaatttatctactgcaagtgaatgttacacatttcacagtaacctctcatctttgtagataatttggtttcctgtagcttttcacatcctttctctcattcgacccctaccctcacacaacaatcctttcgggaagctggaaccatatcatgtatccatcagccaaccaaggaaagagacatatcgagagggtgagtgactcatccagagtccaacatcaggcaaatagcaagaccagaacccgggacccctgaccctttcttcttaaactcctccagagccaaggggatacactggacctgcaacttggactaacgtagattatttccagcttgtgagtgaactgtgagtggaatgaacttgttcttattctcttaggaagatcaaagctccgtatgtaccctgagccctagttttgaacgtctctgtcgtatgattatttgtttactgcatcattcttgttatgacaatgcatggttggcagaaaacttgctggcatttacaaagcttgcctcaaatctggtgccatgaagccatgacaacttcattgacaactactggccacagagccaatacatcggaggaaatagagtgatgaatgtgatggcagcggccatcaaatttcctcaaatcttgggcagtaatcagagagagagctagggctggtgccactaggtagtaaaaagagaagggcttcggccttggagacaatgaatgatggaaatgttgggtcccagggatgacaggctgcccgtagctcagaaaggcagcacatcgggagtccggcatgcagttttgcccgtttagagttttctgggtttctgcatcctattgttatttttcacattccgagtcattccagtccccttctgtgtaagttgctgtggaagtatccagggctaataatcacaatattaagcggccattgacatggcatgggcactgaccaattagaaaaagctgggacagagctgttgggcaggctcctgatagactctggctgggctaggtcttcaacctcctgatgttggcctgtaggggaccttgtgatctgggacaggggtgggcagccagggtggaatttccaagcttcttgttgctagggctatttactaaccaggatgaaatcatttcactgttttacagactagaatagtctcactggtatgtgctcctgtgtacgtcagatttaaaagtatcgaaaccattctctgcttgataaattattctctttacagcttcactgagtgagatgacattatcttcatgcctgcggaggtttggcaccaaatctttctgctcatgcacctttggtgtcctgctgcacagtcatctctgggcaatgcccctctctctgcatgttcccctccctcgtgctctggtgccctatgggagaagtaaaaagaccttaagggtctccttgtctccttggagattttactttaaattttttttttattttatgtgttttctatttcaatagctttaagtggtacaagtggtttttagttacatggatgaattgtgtagtggtgaagtctaggattttagtgcatcccttactcaagtagcgtgcactgtacccagtaggtagtttttcagccctcaacccctcctatcctccccaacttctgggtctccaatgtccattataccattctgtatgcctttgtgtacccatagcttagctcctacttataagcgggaacatgttgcatttgattttcaattgctgagttacttcactaagaataatgacctccagttccaaccaagttgctgcaaaagacatcatttagctcttttttatggctgaagagtattccatggtatatatatattacattttcttggccttctcatcagttgatgagcacttaggttgattccatacctttgcaattgtgaattgtgctgtgataaacatactcacgcaggtgtgtttttgatgcattgacttcttttcctttatgtaaattccaagtagtgggattggcggatagaatggtagatctactttttagttctttgagaactctccatactgttttccacagagggtgtatgaatttacatccttcttggagatttttagcagggcaattttgtggttgccaaagtcaagatctgccttagaccaggtcttcctagggccctagctctgcaataggaaggagcaagagggacgagctgcctgtaagattaaatcttgccctcttagattaatttgggactaggaaagggtggccccataatttactatttaaactgggacatatttgacagcacttagtgacattcttaacaattctcacggagctacacattggactgttgtggacaaacttggacatatggtcatcttagatcaaaataagccttgaatcagttcagaatttcagaaccgcctttgcttcttggatgtgcttggcactgtgtaagcacacgcaatgtctgtatgcctttacctgcagaccaggctgcagcagagcacctcccccttttctggtgcctacagcctcaagttcagagcttagggcataatatatcattcaataaatgcttattcaatggatgaataaatacagaggtgagttccactgttcagtaagagcggggtgaaagtgatactcttctagccagaatgcgactagacaacagaagatttataagacccatttccagggctctctttgcagagctgccatagctgaaatcttcttttattgaggctccacgctagtggtaaattatttgacacaatggggtattctttctacttctttctactccaacccatcctgcatttcaccataatcataataacaataatcttctccaaatgctttaattataatttcaataaatacagagctagaaggaaattaaaaataattttggctattaccctcatctcaaaaaccttccactgccactctgcctatacaataaaaatatgctatctactgagacaggcaccagactaggaagaaaggttgggaaatgttacaatttcagtattgagcatattaagttttaaatttttcatcatagtgtgaaagttgtcagagtcaaatgaagtcacctgtgttaggaaccctgacaaatgga

SEQ ID NO: 17765 - DNA, 317129 bp, Homo sapiens
  misc_feature (1)...(317129): n = A,T,C or G, or insertion/deletion polymorphism (see Tables 1-2)
aacagaaaaacttgattctatttttatattttttttccttttttcctttacagaatggggtcttgctatgttgtccaggctggtcccaaattccaggcctcaagtgatcttccaccttggcctcccaaagtctgggattacaggtgtgagccaccatgcctggcccagactttataatgaaggaggatccaccaaaatgcataagtagtactttatgatagcgtggcaatttctgcttcaacaataggccagacatacggtcaactcttcattcattcatccatgaagagctattccttggtaagtgtgaacaggaggattaggagtccctaaccaatcccaaaatcgagatcctggtcatcagcaggtggttcttagcagccccctaggaagcagctgagttttagggtagaagctacaactctttcaataaatcatgagcaccttcctagaaagacatacatgtttgcatattcatattgccaccaccaacatctcactgtggccttgttttgaaataatagatttcaaaatctatagatttgcctctatcgagaaaacttaacaaatctgaactttaaaaagtggtaaaccaacaaactaagacattacttttattttgaatatattaacagaatacttgttccttaaaaaaaaaaagttttgagaagcatcacaaacaaaagaaagacatagaggataaaacatcaaatacttatgtacatactccctgaatataacaaatgtcatatttcctcaggcttttaaaaaggaaattaaatgttagatatatttgatgttccttgtctacatctttggcttccattttcttccctaatttctcagagattatttctattctgaaattggtatgttcttcctgtacatgttttttatacttttactatatgcacctaacccaacatatattatgtgctattatttcatgtgtttataattgtacatatatggtataacattgtatttatcattctctatctttattttatttaatttttttgagatggagtctcactctgtcactgaggctggagtgcagtggtgtgacctcggctcactgcaacctccacttcccaggttcaagtgatcctcctgcctcagcctcccaagtagctggaattacaggtgcctgccactatgctcggctaagttttatatttttagtagagatggggtttcaccatattagtcagggaggatcttgaactcctgacctcaagtgatccacccgcctcagcctcccaaagtgctgggattgcaggcatgagccaccatgcctgaccttctcttatttttctataccacgacatctgcccatccatcctgccacaacaggccatttaagttgtttcgtttttctctggagtgaacatccttgtacatgtcctcctgtatgtgggggcttcactagagcaccttaatagatgtgaagttgccaggtttcatgaaatgtacatctttactttaactagagttgaccaacttattcctcgaaatggttgctcaaagttacgtcccccttaacactgcatgagagttcccgattccccacacttgttaaacatttttggcacctaacgggtgctttcattttcattccctgataaatcgtgaagctttattcaaaatatccaagctcttgtaggtcacttagaagtttgtcatcaatcaattaatacagaatcttctagaagggaatgagtcaggcagggaagattaaagctaggacaataagctactgccaaagatagatcaatccaagattaaaataaagtatacttggagtatggtcaatgggaaagcataaatgattttaaaacattgattcagaacaactttacaggtatatggcagagagccctttagtaagcaccattcagattttgtctcattcatgcataaagatcaataaagaactacaagggattagcaataaaactataatcagaactattgcctggatacaaaatggaccccagggtctattttggcaaatagatgatggtaacttggggtcatttgtagtacgtcctttagtgttcacctaggaaaagacaacatgtatttggtaaaaggcaaaaatgttgaaaactgtagttcaatttatcagtttctgttggggaaactgtgtggactcagataaacccagctctgccatatactaccagtctctatgagtctgttgctttaccgttaaataaggatatctctatcttcttcccagagttgttaccagaatgaaagtaacaactatttctagtatagtgactggtgcatataatttatcatagtaaattcatgattgcaacaaaataattgagcagctactacatgccaggcattgctacacatcctggacacatagcaatgatgaattagaccaagttccagttgtcaagaagctcaaattctgcctggcatggtggctcatgcctgtaatcccagtactttgggagacagacacaggtggattacttgaggtcaggagttcgagaccagcctggccaacatggtgaaaccccatccctactaaaaatgcaaacactgattgtttcattcatttctgattctttttaatttttttgtaaatttgaagttgaactgtaacagttttctttttagacataggaatctcctttgcagtaaagcgtactttctatttcttttcagtatctctctttttctggaaatgggagcaagttagaaaattttaatagcccaagtgctcccagtactttgaaaaaggcttgaataatttctttcctatgatttcctcattcctcatttctggcgacagtcactattttgggtatgcatgtaaaattgatcaataatgtgatattattggaaaataaccaagtcatctcaaaggcaaatataatattaaagtgtgctaagatttttcctgagacatactttttttccctttcgatgctcttgatataatctgttattttaaaaattgcattttcccaaacacctttatttcaacttgtcaaaagaaaacagatgggccttaaaaacaaaattttttaaaataatattgcttaaaaattgtttcagcatgtctagtagtttattagtgttgttttttgttttacattaaacaaaaaaccttgctttcttgaaaactttttttcactagatggccttcatttttgtttctaatattattgcaagcacaatcagatggcaaagtaagctgacgcattgccttgtacctatttgaatattctccagtatcaaatcctaagagaaaatagtccagcattctgcagacaaatttcttttctgagatgctgaggtgaagtggcctgtgagacagtattgttattacccaatgagtgcagaccaaaatgcccatgattaatgctagcacttgcaaaataacaagagcatttgcctttccaatttcgtcttagtgttttaagttcttcataaaaacatgacccacgacagggccttgaagccacctcagattcttcaaagagctgaccagctagaacatgaacttagaactactgccctcccaatcacctgtttatgctttaaccttcactttctacgattaacagatatttactttacttaatctacttgttagtgtgtataatatctatacatgttgatggcaccaacttgagtatattaaaacacccccttcatctcccttactgatatcagcctcattgaggctcttcttacctctctcttcaatctctgtccaaacaccttccacggggcgtcaacatctccaagttgtcccatcccaacctatcctatgacctgctccaatattctccttccctaaactcccttgcattctgcagcttccatactcaaaacctttaagatctcttgaatgtttctacgataatctccggtcctcttagccagacactcagggccctccacaacctgatgacaacttcatagctccaatccagtccaaccaatccagctccaacccaaccttgtgctccacctcattgtttctttcccttggatgctctccatccagcttttaccacacttccacttcaagccacactttcaaaccctgtcaccttcctggaccattttagttcagagtgattttttcacccacctctaaatatatagactactcatttatttgggctctaagtcatacactcatacgaaaattgttatgtgtaaatacttaattgttaacacttgacaaatgcaacaacagaaatggaatgaactttagacatcatttaattcagcatctcctgacatgcacgaaaatccccttccacatttctcctttgggtgaatatcaattgacagggtgccgagcctcaaatgtggccatttcgcctctgaattgttcttagactgagaggcatctgctttttaagaaaggaaaactccattcatcccattccaaacaggtgagaatctaatgccatcagggaaaaaaaaaaaatattttgctatcccgtctgaattgagagttccctgtgtacagtttacgtccctgtgagcatctaccactcacagagccaccctaagcacgctctgcagtgtcagcatcacctggcagtatgctagaaattagaaatgcaaattcatgagcaccagcccagacccattgagtcggaaattctgagggtggggcccaagaatctgagtttcaacaagtttgagaaggactgcgtctcctatatgaaatggaaaacagctgctcatcctctgtatccttgcataataaaaaatgattagtgtcactatgccaccatttcctcagcgaaataatttccatccccccaccgcctccgagggtcttgcactctcacccaggctggagtgcactggtgcaatcacaacccacagcagccttgtcctctcgggctcaagcaatcctcccacctcagcttcctgagtagcttgggactgcaggcgcaaccaccacgcccggctaatacggctaatattattttttcattttttggagagacggggtctcgctatgttgcccaggctggtctggaactcttgggctcaagggatccttgtgcctcggcttcacaaagtgctgggattacaggcgtgagccgccgcgcccggctctaaataatttcttatcgccctccctcagtttgtttttcctgttatcgggtcacccacacattccacaattgtcaaataggtgagggcacaggtacggaagcgtcccgcattccctccagattttatcacgctgagacacaaagagaaaaatagctcctggcgaccgcatgaaaaccccgatttcaaaacagccacatgcagtttaatttccttaaaagcttagccggaaaaggtttctgtggcttgcgaccccagctgggcttgagagaaggctctgcacactggggcgggggcgggcacaaggtgatcggagggagggggatgactcgcagttgtgttttgagtggttgccttgggttatcttgttcctccagcacacacacactcagtttcttgtcataaggggaaccctgttattttgtagacaaaaagtgacagaagcaactttcgaagcaaaaaaaaaaaaaaaacaaaaaaaaacaaaaccaaaaagacgaagaagaagaacaaaagtcaacgtgaaatctccccagaggaaaaggaacckcgctgtttgtccctcagtaactgagcaacaccccggacacgaagggctccctgtgacttctgcggtttttcttgcacttctccgcgttggttcacttccaccctcgaaactctccagaagcgagaaataaggcggggtggccgccacccccaggccaccagctgtgcgggggccccagctgcagggggtcccggcccagcgtccctctcggccccttccctctcccccgggggagaaggggcgggtccacgcggcctgggcgctgcgcccgacacgcggtaggggtcgctgcgtctcggcgcgcgctcccaccgcggtgaataacggggcctggctggaggagaaaggaaacctgctgcgggaggcggcggcgaccggccagggagcgagggaggagagttcacttttacttcagtgtcagcgcgcggcggcygtggctggctctggcgagagagcaccgagggagtgggtcgcagatcttcgggcggctaggggaaatcggcgagaggcgggatccgagcgcgccggcggggcgcagagcccgcgagcctggccagcgagggtagccgcggggggcgcgccccgggcgggcccccggagacgcgcaggatgccacacgaagagctgccgtcgctgcagagaccccgctatggctgtaagtgcgccgggcgcgcggggttcctgctggccttggggagctccctccccgaggacggcgttggagaagccgagggagccggttgcgcggcgcagaggaaattggaaggcagcaactgcgcggctggcaaagttgggagctggagttgcaaagggcagtgaatcgcgtccccccgctcctcccgccccccaattcctaatatccagctggcaacccagaccctccactccgcatacccaaacggggtgcgcgggcagtgcggggattgcgctctgggacagaccaggttgggattttaggggtatcaggtgaggagtccgcggagctccgggtcgccgccggcttgggccagggggtggcgtaaggcaccggattcttccaacccagaaggggaggaaagtttgtttgctgtggctacaggtgggcaccgcaagtagggcgccggcgcactctgctagtgcaaagccggcttgactggaagggcgggagtctcctcctgtcccgcgccctcgaacttcacctgacccgctagagccattggcctcacaggtgtaagtccctcccctctgaaaccccccaacccctttcccccccgctcccctcgcgcgggaggattgctgtgtggagaggacgcggcactaggctccggggaatccggcgggagcccgcgtgacttgaacgagatggtgtcgattacccagccaggggctgccctcggaaataggttgctttggccgatcgtgagtggatggagccagattaacaccaaccacgtggcttcatgtgcagagttcagagtcctaaacatgtgccaggaagcatttcctttaaaacaaacagaaagttggcctgctgtctctccaaggtggccctgtcagtgaacccaaggccgaagaccacaggttaatctttgcccaggctggccttggtggcagaggtaccaggtttgggttaaggtggtgataccttcagcagggtgttttgtttgtgtgtgtgtgtggttttggatggtgcgtaaggccactgacttgcttaactgaaaaagggctcctcaacttgtgtaggttctttcccctcctccccgctggcgtgtcaaagatgggaggttatctttcctgtgttacccttgcagtgagggggaggcctgaggactacagcctctgtactctaatgcattcagcagttgactgagacccagctttttgccttttggtaaaccacacagacagcagagcctcttgggttcaagagggaacgctgtgctcattcagtgtttgcagtgccaacctcaggtgggacccagctttttgccttttggtaaaccacagatacagcagagcccgttgggttcaaggaggaatgctgtgctcattcagtgtttgcagtgccaacctcaggttggtggaagtactttaatgtgaccagctctcagaatatatggtggcttcactgtgtcaaatgataagataaccacaaacttctgcaaactaggtgaatctacatgaacaaatgatttcttgctatcacatgattgatgtcggccctcatgagcaataaatagtgcaaaatttccgtgaatgtggtacatgaatgcagcatttctgtcagtccctgcatgtgcatctgtgatgctgcttgattttcacggaataaatctgtgttttaagtgcactccagaagaagctatcaagggagtccagatctggcaagcctgaagcccactccacagggccgctttctttggaaatcttcatccagctttcttcaccaatgtggtgtaagggggtggtgtgccatcttgttggaatcactcccggttactttccctccactcatcaagtgctggcattcaagttggtcacttaacactgtcaaaatggaaaatatttgcctatgtttccagactttcttgtcaccctgaaatattaaggctttaatatgacagttatctcattaaaatgaacacttttataattttggtttatgaatggtgtattttcagtgtattcagaacatgatatctagcagaatagattttggcgttaataggcattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagagggctatttggtgtgttagtgtaatttctggttgttgttggctttctgagcctcctatcaacatgagactgaaaatcgtgctgtgagctcttcatgggaaggctagggaaggataacacaggattgtccttgctctgttgtgttctagggctgtgctttttcttgtttattggtttggtaaatacagtttcagtaaaacctcaaattataagaaacaggtgttacccctagcatttaaaaataaagtagcaatacattgtaatttcagttctagtgctgaacgttctgagtataagatgtttgagactgggctttaaacacaactttttggtagtttgaattaagttgtctattgcttattttgggtctgagcttctgttctgctctctctcctacccacttgactcctcatttaattcagtagttcttacacaaagtaactaactcagctcagggctgctatggtctttctcctctgtaccagactgaatgtctgtaaaaggccacataataaattgtacttgagggatttctcaatgagttctccatgaggcctctgactcttctcaggtttctgacagatgcaagattgctgaagtcgccctgatttgcacacaggagcactggattgaaattaaatagactattttctatttaatttccactgttattggccacatcttcctgcaatctgtgaagctatttttgtataatgttaatactacaaacaaagctgaaacaattcagtaacacaattctgaagggaagaggtggaagaaggaagtgatagtaggtagctgtttaaactaatgcagacatagacatagtatgtactatatattgtatgtatagtatttttctatactcaaccaaattaagatgacacttacgcttaggtgtgatttgcgaataacttgtgttgttgtaatggattatgatgtatctgccaaattaattctgaaaacacattgctgccatgatctgtcgtaagttttgttccagttacttgagagttaaaaacaccagcaagagcaaaagaggggtttgtgactaggcagatgacttcacttaccactgataacccaatcaacacttaagtgactacagtgggtctccaatgattgcataggcaagaactgtggttttctacactacaagattcagagccttcctttcatgagatacattgtacaaaaattggggatcaatgtttcactgtttgcttcttttaaaaagtgcaacctaagtccagcatgttgtgggggcggggaaggggaagttgagaaagattctggttgagcattattattattttttttttaggcagtatcttgctctctcacccaggctggagtgcagtggtgcaatcatggctcactgcagcctcaaacctcccagcctcaagctgtcctcccacctcaccctcctgagtagctgrtactacaggcacacatcaccacacctagctaatttttgtatttttttgtagagatgggttttcaccatgttgcccaggctgagctcaagcagtcctccctcctcagcytcccaaagtgctgggattacaggtgtgagtcaccacacctggcctgatactgtgagcttttgggtactactctctgctcttatctgaatagtgaagttactaagttagttacctggaaactggagttttggggtggtcagtgcaactaaactcttatccatctacgatgaccaatctgagatgaaatttaagttctgaagtagttaaacrcagttgtgtaaaaggtgattgaataagtcggtatttagcatagctcagctgtaacatcctatcagtgctttcgtttgaaccatagaaaggtatacgcagccttatcttgagatactgtcttcagtagacaaaaagtcaagctgctccctcatatgctggtgttttggttgagcttttcaaaaggatctttaaggtcaacagctaaagtgttattttagtatggttttaactttaattacacatgctgttagccagaatgacttgtttgggagagtttaagcttgtaataccgagtttgttttagaatttagtgttatttggggtgttaactcctttttctctagggaaccaatgacttactattgccatctaccctcttactacacaagctttttaacagccccttctatttaaaaggctgggcatggtggctcacacctgtaatcccaggactttgggaagccaaggcgggtggatcacatgaggtcacgagtttgagactagcctagccagcatagtgaaaccttgtctctactaaaaatacaaaaattagcctggtgtggtagtgcatgcctgtaatcccagctacttgggaggctgaggcaggagaatcccaaataggggaatcccaagcaggggaatcgcttgaacccgggaggcagaggttgcaataagccgagatcacgccactgcgttccagcctgggcgaaagagcgagactctgtctcaaaaaaaacaaaacctagtatacaaacagatctaatgcttaccatgtcttcatggtaaccaaaagagaaacaaaggctactcaacgtctgatttgatagggtcaggtaagtcctacagggcaggcagtttaatatgggatatggaacaaaggtttgtgaacataccaagggctaggtgcttttcatgtgttactgttatcatcggctcattatagcctttgagagggccagtggttttccatttcacaaagaagctgaaacccctagtactgtgtcaaggccaccctgctagctggtggcagaggaacttgaaagcagcactgtcagatcctggagcctttcctcattgactgttgcaactttgctgcccctgaatcataaatgttcaccccttctgtgtctttaagtagtttgtcatgattctctcaagatgtagaaacctctagctatttatgctggatgtggtggtatacacctgtagttacagctacttgggaggctgaggcaggaggatcaagatttccaggctgtagtgtgcaatgattacaactatgaatagccacagctctccagcctgggcaacatagtaagatctgcctgccccccacccaacccaatctctcttatttatttatttatttatttattttgagatggagttccactatgtcacccaggctgaagtacagtggtgagatctgggctcactgcaacctccacctcctgggttaaagtgattctcccatctcagcctcccaagtagctgggactacaggaatgcaccaccacacccagctaatttttgtatgttttagtagaggtggggtttccccgtgtggtcaggctggtctcgaacttcctacctcaagtgatccgcccggctcagcctcccaaagtgctaggattacaggtgtgagccaccacgcccagtgagaccccatctctaaaacaaacaaacaaaaaacaacaacacaaaaaaacctgtggccattggatagtgtgctcatttataaatagatgcataaagttgattttgctgctgaattttttcctcccaagaaacagcatagaatacatgggctttttttttttttttttttttttgagacagagtcttgctctgtcacccaggctagagtgcagtgrcatgatctcagctcactgcaacctctgcttcccgggttcaagcaattctcatgcctcaccctcctgagtagctgggattatagtcatgtaccaccatgcctggctaatttttgtatttttggtagagatggggtttcatcatgtcggccaggctggtctcgaactcctgagctcaaatgatctgccttcctcagcctcccaaattgctggtattacaggcatgagccaccatgcccagccttacatgggcttttcatagaatacatccaagcttcatcaaaagattttgtgtatacttagaaacatcccatctcttactgtgaggtgctgaagtgaaaggcttttccataataatatagtgatgtgccccagtgattgctaataggataatttgtaaaacatgctttattacatacactgcccataccttaaagtctgggattgttgagaaatgaaatagaaactttagtagtgaagccgacctgtgagctgatactttgtcaccttactgctctattttatttttctctcttgagatgcagtgtggtgctgataaaatggcagaagctttggagttgaatagatgtgggtttgaattctgacttccattgcctgcctcagtagccttggggttttctcctgtaccttgagaggtgtgtggaaatgatatatctatagaggtggctgatgtggttcctggcacatagtgctaaacaagttgtaatggtttcaattaattgagcacctaatactagcaaagtatygtgatgaatgaaacaccgcttagctgctgacagcttaccagagaatctgggtgacaagtaaaaatgcttatacttttagtgcccttccaagttctgtggaagagaagatatgagaaggatggatttggatggcggcaatgggagggcttcatgaaagttgtgaatttgaaatgaccttgaggaaggtcagaggaaaacctgaaaggcgtgctagtatatttgtactgtggaatcttctatttatataggcaataaaggacaattggagctgtcctgaggagagtcacctgatgcaaccccttactgatgtaccttcttgttctttgagatggtttaaaaaaagaaacaccccaaacttttcattagagacatgggtgagtggcccagtgaagtgagtgacaggggaggcaggtgtggcaagacagcgatgtgagcatttggtgccctgtctgctggctgcttagcggcctcttcactgtgcttctgggtttggctgtcttttggatgaacagctttgccagagggttttgccgaggataggtgaattcaatgagaacaggtaagaaaatgagttgtacttagagcaggacaaggatattgacaactgaattctctagggggtagggtttctctcacctcatttttcttcattctctccattaattgtggcaatgtttacctttcagatttcactgatttacggtcctgcaatgtccagcatcccagttttattgaagaatgacttagactgtgtttccaattcattggcaattgcctgaggaactttcatttagactttttgtgggattttactaagctctaattggaccttcctttaattttataatcgtgtattgtgtatgacttcttcttgccaaggtgcctaagaggagctgacagctgtttatttagtatatgcagtggttttcaaagagcagtctctggagcagcagcagcagtaacagcagcggagcatctcctgagagcttgttggaaaggcagatgcccaggccccactcagacctgccaaatcagaaagcctgtgacgggktctgcagtctgagttttaataggccctccaggtgattctgatgcgctagagcatcagaaaggtaaagaggcatttctgatatatagttactcttcacagtgcttgcaggtttttgtcaagtaagtgaaaacacatgggtatgttatggaacgctttatttacagtatctcttggatgtttgatttgtaaaccacatgctaaccaggccttgattactttacaggttcatgtttattttatagaattaattctgctatgactttaagtttgcttttctttcttctgggaaacaaatgtgatttggaaggtgctgtagtttgaatgtattccccaaagttcgtgtgttggaacgtagtcccccatgcagtagtgttgggaggtggagcctaatgagtggtgattaggccaccagagttctgccctcstgaatgggttaatgttattgtgagagtgagtttggtaaaaggatgagttcagcctccttttctctctctttcacccatgcgatgccttttgccatgttacggtgcagtaagaaggccctcaccagttgcaggcccctcaaccttggacatcctagcctccagaactgtgcggaaacaaatttctgttcatcataaatgacccagyctyaggtattctgttatagcagcacaaaacagactaaaacaaatggaaaagtttaaaatctccactgactagagataaagcaaggttagcttcccagggatttcagctggaagtgaggcttataggagccattgggaaggctgagtgaacggggaacctttttgtgtaagaaagggaactctaagcctggaaattctgagcttctaatccctgggggtggcacatggggggctggacagtaagaattgatagatgtcctccttctccattttttttctctccaggacaccttacagtgttattcatttattcgtttattcattcacaatttttagaactgttgaatatgttagcagagatattatttgatagacataagtgcacccaggtcattcccaaattgcagggaaactaccaatctgtttaatttacttttgataaaagataggaggacatttttattgtttattgcttgggatctcccaaaaagaagatttctaattggttgttctttctctattactactaaatctctgaaggaagacattttaatttttttaaaaattagggtggtttatttcttgataatttttattaagagataggatctcactatgttgctcaagctggacttgaactcttgggcccaagagatcctcccgccttagcctcctgtgtagctgggactacaggtgtgtaccaccatgcctgacatagttcctgataattttgtctcagttctcatattttactggcaatatgaattcaatcttaagtaatgttaatgcatatcctatagttgtctccaaataagtagacttgatttgcatataattgaagcaacatatatttcacatacttatgcctagattcagtatctagccagcagcttggtatcctggcacttagaagatactcagtaaatatttgctgttatgacaggtttgcataacatgtctatactgtattgtttgtctaaatgaggaatttattgtctgtctaattaaagatcatcttggcagctttcagatgccatgcaaacattaaatgttgagtttagatttgcttccatcccctgtggaacctggcaagttgttttaatttctctgtgcctcagtttcctcatctgtaaaatgtaagtggaaaatgcatcatcaaaggattaaatgatttaatagatggaaacgtacatgctcaaagtgtgctcccatggagtcaacacctaaagggcagggatggtgatggcagaacccccctcattactgctgccccttggtctgtatccttctttacctgtatccttctttacctgtatccttgtctacctccttgcctgttctttttcactttaacagaatgtggatttaaaatcctagccctattttcttttttcttttcttttctctttttttttttttttttgcgatggagtctcactgtgtcgcctaggctggagtgcagtggcgcgatcttggctcactgcaacctccacctcccaggttcaagcaattctcctgtctcagcctcccgagtagctgagactacaagcacatgccaccacaccaggctattttttgtatttttagtagagatggggtttcaccgtattagtcaggctgctcttgaactcctgacctcaggtgatccatccgtctcggcctctgaaagtgctgggataacaggcgtgggccaccacgcccaactctagccctattttctcttcagaatgggaaaattcttaagttatctatatggaaatacttcagtctatcaatttgggtggggaccaaattaatccttgtgtctgtatacttaaaaaactagtatgttctattgtttccagatatagccgaggtggggagaacatttggacttctgtgttgtatattttgccatcttgcaggggatcttggaagtgtcattctgaagttaccaagcattctcttatttcatttaggcttccaagttgaagttggtcgttgctgctgctgttgcttgtctaaaagcctgagggtttataatgctatctagatgggaaggagctacttgaaatgtgtttgaatctttatgcttgcttcagaatgtagagtttgacttagctaccagggtcagccaaccttgtggtcaacccagtcctgtgggagtttagaagggaggtgaggaagaggaagtacacttggtacactgggttcacctaacgtccctcaggcctcaccgcctctacaaagttaatgaaattttgtgttcataagctcagtgaagctcagctgagaggactaactggaatgttgaagccattaggaatcgaaaacctgggccgcaactcacgtgcccactttttaaaaaaattctagtacttttcatagaagatgtttgctagtaacccctctattattcctcacctccccaaaaggggaccattgtaatcagccagtcttggtccttgagattgtcacttttctgttttttgccccagtcctacacgaagcaggcttctcagggtgggatgaggagcctggtaagatagtcacatagtcagcctcatgaaatatgactccccattcacctgccccctaaactgtgcttcctcaggtaagatctagtaaggcagcccaccagagcctcgctgcatgttgaactcttaggaagtttgtccaagaaatggtagttatagagctaatacaaacatgcttttgctctcattctgttctctactaatgagttttattttccaaaaagaaacaaagatacatttatttgtaaagaatatataaggccggayatggtggctcaagcctgtaatcccagcactttgggaggctaaggcaggaggattgcttaaggccaggagttcaagaccatctgggcaacgtagcaagaccytgtttctacaaaaacaaaataaaaaatgaatatataaagataattttttcctccatgagaaccagggtcacgtgaggcccttccctgctttggcactgattctggtgatagtctcaaaagcttccttcctcagttctccagtctaatctttgctattagtttgaattggttaacaggttggaggattgtgcttgcttattcctcttcactggactctgcctgtaacttttcacattagattaggggaactctgagaaagaagtggagcttataatgtgcttctgtattgtagctttgatatctctgaaaaygtgtacctttctctgctaagcaggacaaataagacaaaccaaacagggagggacatcctcatcctgtggacatgtgaatatttctagaaggttatgcaaataatctagaaggttataatatctttttagaagttgcctttgggaagagggactgggggcaggagtgggaatgcgatttgaaatagttttcaccatatgccgtattaccctttgaaaaaataaagcaaatgtgtgttttggaaaaatatgttttgagaataatgtggacaaaatagaacagcagtaaaatccatgaggaatcaggactgtatcttttggtcaatgctgtatccccactgtctggtacataggtcaacatggcagcagtgattctgtgtaggtaatgagatattttgtgattaatattttttcttcctcaaattttcagctatacatgtttttatagttagactgtaacagttgagttggaaaaattgtaagttaccctttgctgctcaagatacaaagttctctttggctacaaactttgccttatgaaaattagtctgaaagatagatcagttattattggaaggattcagtggctatctaattttccaagtgtgtatgtgtgtacatgcatagagaatgagggacagaaatgttaagaggcccaggactctatagctgttaaactgttgtagttaataatttgtgaaaggggccaggcacagtggttcccacctgtaatcccaccactttgggaggctgaggcaggcagatcactggaggccaggagttcaagaccaacctggccaatgtagtgaaaccctgtctctattaaaaatacaaaaaatattagctgggtatggtggcatgtgcctgtaatcccagctactccggaggcttaggcaagagaatcccttgaacccaggaggtggaggttgcagtgagccgagatcatgccactgcactccagcctgggcaacagagggtaactgtctcaaaaaaaaaaaaaaaatgtgaaaagaaagtgtgtaggaagcagatctgtaaaaggtagtaatgaatcaactagtgtccatgggggaaataaaggttgtgacacgaaagtggagtgttctcttgactcacaaagtgaactctgaagagcctgtgaagaggtgaactactcatgaccattccttcattcaacaggaggtgctagatgccatgtataaggtggaatttacatagggtttatgaccaaatgccttcaggggtcaaatgtgatcacagcctgtataaaataataggaagctttggagtgtctctcagctggagaatgcatttgctgctttcgtcactcaaattggaagggaaacatttgtgagcagtgtacaggcaaaacaagatagattagtcttgtttagcatcttggaagctgccactggccccagcattatgctgtaaaatggaggtagccatggaagtaccgtgaccttagaccaatgagagacgagaagcactgtgatagcaagacctgcatctagcatctgaggacttagactgaggtgccacttactgtgtgatattgggtataagttctttgagcttttttttttttgagacggagtctcactctgtcacccaggctggagtgtgcagtggcgcgatcttggctcactgcagtctccgcctcccgtgttcaagcgattcttctgcctcagcctcccaagtagctgggactacaggcgcatgccaccacgcgtggctaatttttgtattactagtagggacagggtttcatcatattggccaggctggtctcaaactcctgacctcgtgatccgcccacctcggcttcccaaagtgctgggattacaggtgtgagccaacacacccggcctgagctcttctttatttttggagacagggatcttactctatcacccaggctggagtgcagtgacatcatcacagctcactgcagcctccagctcctgggctcaagtgatcctcctacctcagccttctgagtagatgggaccataggcatgcaccgctatgcccagctaattaaaaaaaatttttttttgtagaaacagtcttgccatgttgcccaggctggtctgagcttctttctacatttgaaaagtgggtttatgtttaccctgtctcaaaagagggtgaggtatgggagattgctctgaaaattgttcaagtgtgtgtgtgtgtctacagtggggagggatttaccacttatttgaataattctttggtgaagtcttattagtgttgaaacgggtttatcatttaatcattacctcaaaggcaatgctaccttagctttgtgacatatgttttaaaataaataaattaattatttttgagatgaagtcttgctctgtcacccaggctggagtacagtggcgggatctctgcttactgcaatctccgcctcccgggttcaagtgattctcctgcctcagcctcctgagtagccgaggttacaggcgtctgctaccatgctgagttttatatttttagtggagacaaggtttcaccatgttggccaggcaggtctcgaactccttacctcaagtgatccacccaccttggcctcccaaagtgctgggattacaggtgtaagccaccgcgcctggcctatttatttattttttgagacagggtctggctgtgtcacaggctggagttcagtggtgcgatcttggctcactgcaacctccgcctcctgggcttgggccattctcccactttagtcttccaaatagctgggattacaggtgtatgccactatgcccagctaatttttgtatttttagtaggagatggggtttcgccatgttgcccaggctggtcttgaactcctgagctcaagtgatccgcctccctcagcctcctaaagtgctgggattacaggcatgaaccattgtgcctggctgatatgtgcttttttttgaaacggtgtttgaaatgagattttcctggctgggcgcggtggctcacacctgtaatcccagcactttgggaggccgaggcaggcagatcatgaggtcaggagttcaagaccagcctgaccaacatggtgaacccctgtctctactaaaaataaaaaaattagctgggcatggtggcgggcacctgtaatcccagctactcaggaggctgaggcaggagaatcacttgaacgtgggaggcggaggttgcagtgagctgagattgcgccattgcatcccagcctgggtgacagagagagactccgtctcaaaaaaaaaaaaaaaaaaaagattttcctttctccttcaacttgaaaggcaacattttgcattttggtagcactatctttgagacgtaacttttttgaatcctaatatatgatttttagccagattcttccttgtccatcttagcatttcttttactacgaagtgtgaattttgaaaacagaagttaatagtaagaatctctgaattgaggctggacccggtggctcacgcttataatcccagtactttgggaggcagagacgggaggattgcttgagccatggagtttgaggccagcctgggcaatgtcaggagactctgtttctacaaaaaatctttaaaaattagctgtactctagcctgggtcacagagtgagactccatctcaaaaaaaaaaaaaaaatctctaaattgaaaagactttaagagtagtttctttgagacccatgctgtaggaaaatatttcatcaagggaaactactctgcgagggaggggacatctgtatttttaacactggaggataaagcttgggaaggcaattctgtctcctaatctgatgacagagatcctctctttataaagcttatggcttattctcaggaaaagtaggggggtgagtgtggaagatagtgtggctggggtcacttaatgcttgaaaaggtttcctagggctgctgggtgtcaacagcgggccagcctcctaggttgattacacgtccttgactattatccacgcccttgactattatccacaccagcataatatcccatcttggattagagatcatctaattcatagttgtcaacctggctacccactgaaaactccaggaaagctttaccaagaaaatgtgtgttccctggatattgtcactatcctctgtttatttggggatagaatattctggcataggtgtttttattttaaactttatttatttatttatttgacggggtctggctctgttttctaggctggagtacattggcatgatattggctcacttcagcctcaaactcctgggctcaagctatgctcccaagtagctaggactacaggcatgcacaccacacctggctaattaaaaaaatattttttggttgagacagggtctcactagggttttttgttttgttttgttttgttttatgtagtctcactctgttgcccaggctggagtacagtggcatggtctcagctcactgcaacctccgcctcccaagttcaagcaattctcctgcctcagcctcccaagtagctggaattrcagacacatgccaccacacctggctaattttttgtatttttagtagatacagggtttcaccacgttggccaggctggtctcgaactcctgatctcaagtgatccccccacctcggcctcctaaagtgctgagattacaggtgtgagctaccatgcctgtcctcactagggtattctttttctttttcttttcttttctttttttttttttgtgttttaaacactttcaagctctcaaaacctcaaagaaggatacaatgaacatctattcccttcacttagctttaccacctgttgacatcttgccacaccattccatctacagacattgggatggctcacccctaaatccttcagcacacatctcacatactgagaaagacattcttctctccagcttcatcctcagtgttaccattactgtgtgttcagttccattgttcaatataaattccacactatgatttcccctgctatgctttatagccatgttttaggacccaggtaagtttctcgcattgcctttggctgttattcctcaaggccttccccagcctggaagagtggtctcacctccctctcaatgcaatgaccctgaatcctctgaggagtccaggcctgtttcctccaggtgcatcacatcaggggctacagtgtccaccctcccactactggtgatgaatagatatttttaaaaacctccctaggagattccaatgtgcagccaaggtttgaattcattgaattaattaaatccaccctactttatttgtatgtgtttttttttgtgctaaaatacacataaaattatcattcttaccatttttcagtggacagttttgtggtattaagtacattcacattgttgtataaccatcatcacgatctatctttggaactttttttttttttttttttgagacagagtctcacactgtcacccaggctggagtgcactggcatgatctcggctcactgcaatctccgcctcccgggttcaagtgattctcctgcctcagcctcccaagtagctgggattacaggtgcctgccaccacgcccggctaattttttggatttttagtatagatggggtttcactatgttggccaggctggtctcgaactcttgaccttgtgatccgcccaccttggcctcccaaagggctgggattacaggcgtgagccaccgtgcccagcctctggaacttttttatcttcccaaactgaaactccatacrcattaaataataactcccattctctctcctcccagcactggataaccaccattctactttccatttctatgaatttgactgctccargtacctcatgtaaggggaattatacagtatttggtcttttatgtctggcttgtttcacttagcatgtcttcagggttcaaccatgtcatagcatgtatccgtacttcctttttaaggctgaataatatcccattgtaggtacaggccacattttatttatccattcattcattgattgatacttgggttatttccaccttttggctattgtgagtgctgctacagcgagcatgggtgtacaaatatctgtttgagcctttgctttagttttgggtatatacccagaagtgggattgccagatcatatggtaattctgtttaattttttgaggaattgtatacctatcactttttaatggagtgaattgaagaacacttcaaagaatgaagtatccatgacttgaaggaagaagccaattagaatgccagcctttaggctcctgtttggattacctcctgggaggtcatgtgtaaattcatcttttcttcacacgagataaagagcaatgggtataaagtctagctgtggcagctgggtgcagtggctcatgcctgtaatccccgcactttgggaagctgaggcaggaggatcgcttgaggccaggagttggagatcagcctgggcaacatggcaaaaccctatcctctgcaaaaaaaatacaaaaattagctggtcgtggtggtgtgtgtctgtagtcccagctacttgggaagctgagatgggaggatcacttgagccccggaagttaaggctgcagtgagccatgatagtgtcactgcactccagcctgggtgacagagtgagaccctgtctcataaaaaaaatagstgtggcaaaatttacttctttgtgacttcaggtgtgacctcagatatgcaggacaagggtcacagtttttcatttacattaatcatgactttttagaatttttaaagtttttgattggtgacttaaatagtgcatagacaacaagttgcctttgacctctataaatagtgtaaaacaaagtaacaggctgcctcttggggcatatgggattttcaaaatagaatattgttttgttaacctggctcatccaaatactgtgcgatcttgaacaaggtcttaacttccctagctcatgttgtttagctataaaatggggataataatggtaatcagaatgaaataagctaatctatgtgcttggtgcctgacacatagaaagcattcattcagtgcaagctattaatataatatttcccattgattttaaaggtgtttagacaattccaatacaccagaaactgatatttttaaatgagttattactcttttacaggaggtggcatctatttgactgtcttgagatgagactggcctgggggctctagaatggtggtgcttaactggagcaaaaggtggcaggagcatgtgagagctctagcataactgtggccttaaagtaagcagacgctatgtatttcctaagggtgartgttgataatttttatagattgctgaggccacagggtccagattaagcaagtgtgttccgaggagtctgacttcactgtgctttgactgaggtagatccaggactcagtwggcggctgtttttgaaggctgatcattcttccactccttcattggaaattagccaagaattataaaaacaacagtttaactccatgcaaccaagtggttgtctcataatgattagtttggagcttgtgctaagtactctgtgtggagttcccaggattatttaacaagagaaaatgttggctctgcaggagagcctagtaaattttgaaacgcagacaatcctacttcagtggaaaaatcctgatcttaaccccgagtctctggtctgtctctggcycccttgtgcaatctggggggattgtgcttcatgtctgrtagaagaggacaggtctatgagaaggaggcatgtacacacagctctaagaagtggggaccggcttctacactttctgccaggttaatctcaaatggtgcagataataacaaacacatatgatgcttctatatgccaggtgctgttttaagcactttgtaggaatcgcccaatttaatccttgtaactaaactctgaggttggtaatgttatccccattttataggtgggaaaactgaggtgcagaaacattaagtaacttgcccaaggtacagctagtaagtggcagaatgaaccaggcaatgctacgccaggctttgtgcctgtcatgcctgttgaatacaagctagaaagacagcttttgggtacttggtactctgtcttctgagtaaaggatttatccattttattagtttcctgtttgttcctgctataaaaaattaccactaatcaactcagtatagccattaaatttgggaaaaagaagaattttagacattctaaattttttggcacagtgactgtctaatcatgaacagcgatgtgcattgccagggaagaagctgtgagttactggggttggctggtacctgctattaaaatggtgctggtacccgctattaaaatggtgcttggtcgaccgggcttggtggctcatgcctgtaatcccagcactttggcaggcctaggcgggtggatcacgagatcaggagttcaagaccagcctggccaaggtggtgaaaccccgtttctactaaaaatacaaaaattagtcaggcacagtggcgggagcctgtaatcccagctacttgggaggctgaggcaggagaatcgcttgaacctaggaggcggagtttgcagtgagctgagatcgtgccactgcactctagcctgggcgatagagcaagacttcatctcaaaaaaggagaaatagtgcttggtcatcatcaaagctgagaagtcatcacaaaaacagatgaaagaagaaagagtgggaagagtgcagaagtagcagatatgcaagaaaggatttagaagcatcaaaaggcacatgaagccatggtgggcactgagctagtgagagagggcacagtaagagtatcactgtttagaagaaagtaactcatgatgataatttacactgtctctcagtgacttaaagtgtattcagcacattctgaatagggaaactgggaagcgtggaatcctttatagagcagttttctaccacgtttacattgtagcacctgtaggtttagcgaacagttaaatggaaaataggctcatttagaagctctttaatcaggcaggatggcagrgatatatattgttcttaaaataatttctatagcaacaggactttctgaaatatatccataactcagttaggaatatccactttctattttttgccttgggtaatcaaaaacagagacccaaatttgggactgaactgtagaattcgtgaggggcttcaayattgttttcagtgtgtttattcccccctgctttcattgtccttgtctacttttattttccctttacccaattttaagatttcttttatttataaacctttttttccctaacagatcttttttatttttattttattttattttttgagacgaagttttgctcattgcccaggctggagtgcaatggcacgatcttggctcactacaacctccgcctccctggttcaagtgattctcctgcctcagcctcctaagtagctgggattacaggcatgtgccaccatgcccggctcattttgtatttttagtagaggtggggtttcaccatgttggtcaggctggtctcgaactcctaatccacctgcctagtcctcccaaagtgctggtattacaggcatgagccaccacgcccggccctaacagatctatttttgtaaacctcctcaaatatttttaggaaaaacatgagatataattaaagtgttcattggacaagtgagtggttggrctcctctctgccctcagggagctgattttctgggaggcgacatggcccactggcccagagctgggctctggctctgtcatttgctaatgcttagctctggtttcctctcctgtgacctgaagtaatgaaattgtagtacctgcctgatggcattattaggacaaaatggaacaacaaatataaagcactctcacagagagagtgcccagtgagagaaggaggaagcattctgtgaagaggagacaggctgtgcccaggcctggccttaatgcatgcatgcacgcaggattgattagggaaaggagagcacggtgcatggagggtctggactgccatgggaggcaagtattctggagacactgaggaggcattcacagtcagacctttcctgcttctgcctcctcagctttctttatcttcctgcaggactctaagcctctgcctttcttgctttctttccctgcattcgcttaatccatctggagactatgctagctcagttaagttggggggctgccctctctagtggttccagcaggactgaggatcggttcaacactcataacactggtgaccactattctgggagacagattcttcattaaaattttattgcttggtttccttttttcttctccatcctctttatttactaccctctgttatacataaacttttgaagtctgaatagcaaacagctgttaatgttgccattgcagaaccacggacacaacttaaaataaactgattggtttataatgacatggagaaatgcttattcaggaagcaaaaaggcaagatacactgtagggaagttagaacctaaatagtacggrgaaaggactgaaaggaaatgtgtcaaattgttaacagttgttttagatagaatgatgtttcctgttctgtagtcttcatttttcccagagagacttgtaagtattataagcaaaagaaaaaaaaacccacattagttctcatattattccttctgattatgagagatgaagttctcatctgctcggatttgactagtgtgggctaataggtcccaggtagacattgttgatgggatgaattgccaataatcattttgctggccttgcttttcggttaccttttacctgagcctctgagctccataacaccactgtgcctcatgggtcagtgcgtgcataccacacagaaatgtgagttgttcatgcatgctggggttagaaactggaggatagactcagtctgaagtggaaattcttgggtactaacttcatggatcagtttcagagcaggttttcccatggtctgtgccagtatcctcagtcttgatgctctcaagtcaacgggattagaatgtgtttgcgcagttctgggtttcccttcatcggcatccagtcattttcagtgagcagaattgcggtcagctggcacatcaccagcaagggccaaattagacataattgcacatcagtttcacgttaaggtctgtggcttaatgtgctctgcaaaagcatgccaggcctggagctttgttctccctgggaacagcgtgccccagaagaaaggttacagtataaatcatcatccaaacctagacacctaggaaagggggattctgttagtttttccaaggcaaccatataaattgtgccagccctgggcaagccaggacttatggtcaccctrcccataaggatgggtctgtgcaatgacattcactttcctagacagcctttacagcaacctttggagcagaagggaaaccaaacagttggagaggatgccacagcattccagaaaaggggaagccrggttccttttcaggaaagttgagctaaaaatagaacatcaccattcaacagttgctcgagctcttcaaacactggggcttgtgccattgttccttttctttgcatttcttatgagtcctggctccttttgctttgtgttgtaaaggaactggtctatgtgccgagtctgctgggaagcagcccctttaatacacgaagggcgctggacgagaggatcactaaggccccttccagctctcacagcccatgattttataataggtaacctaaggcctgtgctgcatgggtaatgaggaaggacaagtaggggcccttcttgatgaaaggacagggcccctgcccctccatccttggctgtcacacactcaatggcaggctcttctctgagccaagcggggaaaaaccatggagggtgtgtgtgtgtgtgtgtgtgtgtgtgtgtgagtgtgtgcaggactttactgaaaaatgagttgcatagtggagtgatcagtacataatgggtggtgggcactgagagagaagagaaaataacattagagttaatcctgtaggtcagggtttctcagcctcagcactgctgatgtttaggactggacaattcttggttgtggggtgctgacttgtgcattgtaggatgtttagtatcatccctgacacactcaattccagttgcagtccccttcacctgtgacaacacaaaatgtttccagacattgccacatgtccccggttaagaatcactgttataaataaagaaacaaaattgttttctggacatttctttttgtgaagctgtgtgttgcctggccaagctcccaccttaagcttttataataccatttactggaccaattagtgttgtgacggtgggtggtgatttaaaatgaaataccctcactttcatgctcttggatttggctttgaaataaagtgagctgagctctcccccctcccctttcaagagtgcatgaataatgaggtctttctgccgggaataggattatgcttgttcccacaacttaaaactattttttcaaaatttctactgtgactagcatcctaggttttatcctgacagaaacgttccattttaaatgagggttccctagaacagtgcttcccacacttgaatgcgcgtgtgtcatgtgaggatttggtgaarttgcagattctgttcccgcaggtctgggctgggccccgagactgcatgtgtaacaagctcccaggtgatgccggcactgcaggtctccaggccacatttagtagtgaggctctgctacggaccagttcttgacataaaagaaaagttggcacatatgtccaggaggatgatgaaaggctctgagcgggggcagcataagctttcagcaatctgttgtgtgcggggctgctcgcagacccttctctgtgctggaggtgagtccctgagcccgtctgcagccttgcaggctgtcaagcagtgggaggaccaatgcctgcagttccttacctggcactgaggggagcattttaacaggacagcctgagacagatggctgcaccctctgaatgggcactgaaggggcaaactggccccagagaggcagcagcttggactgttagactctgagctatttggtggctccctgggtgtggtttgagcagagactcacagaggagcgccagcccctcagaagggctttggcctgcctttctgcttgcccagctctgcggggtgatgggcagccagacaccttctttcctagctcagtgctgcccttgttaccctgaagcctttgttgctatgggtctgctgggtacctgggaagggagaaggagtagggtatggtattgggcaccacgtgaagtgagtaaaatgtttaaatctggtaatgcaaaggaagatggggagcccaggaacccactgttctgcgccaggagtttgctttgaatccttttttctttttttttttttttttgagatggagttctgctcttgttgcccaggctggagtgcaatggcgcaatctctgcaacctccacctcacgaattcaagtgattctgctacctcagcttcccaagtagctgggattacaggtgtgcgccaccacacccagctaattttgcattttttttagtagagacggggtttcaccatgttggtcaggttggtctcaaactcctgacctcaagtgatccacccgtctcagcctcccaaagtgctgggattacaggagtgagtcaccgtgactaccctgaatcttaatctgtaagtgggcagcgtctttccattgcttactaaaccaacttacttaaaaaaaaaaaaaggtttctcagccaggtgtggtggctcatgtctgtaatcccagcactgtgggagaccaaggcaggcagatcannnnnnnnnnnnnnnnnnnnnnnnnnnnnaggcaggagaattgcttgaacctgggagacagaggtttcagtgagccaagattgtgccattgtactagagcccgagtgacagcgagactctgtctcaaaaaaaaaaaaaaaaattctagaagtacattgctttcctagaaaaacatctgaaatgaaaagtgattccttccattgagaagtatgtcatgtatgttttctcttatagatactttttgaccttattacccaaatataatcattttgtatacttaaggcatttttctttttagtttttattcctgtttttctctttttaaaaatatatccatgttaggctgggcgtggkggctcacacctgtaatcccagcactttgggaggctgaggtgggcagatcacgaggtccggagatcgagactatcctggctaacacggtgaaaccccatctctactaaaaatacaaaaaattagccgggcgtggtggtgggtgcctgtagtcccagctacttggggggctgaggcaggagaatggtgtgaacccgggaggcggagcttgcagtgagccaagatcgcaccattgcactccagcctgggcgacagagcgagactctgtctcaaaaaaaaatttatatatatatatatatawttatatatatacatatataaatatatatatatacatatatgtatatatatatgttaaaattagttaacattcccatcaccttgatgaagggtgttaaagtaaacttgtgctattcataattctttgaaattagaagaacatcaatctatgaaagtctttgtgggagaactgaagtccagagatcctgcccaaaccttcaatcccaagttcactaaggatttgcatttgtattccagctgaatgaaaaggagacacagacacacacacacacacacacacacacacacatgactatttcatttgtataggatttaggacattttttagttttctcacagcatccatctaggtagagagagtagatatctgtagcctgtgggtggggacaggagttccagtgatttaaagactgatttgaggtcctagtgcagccctcagattccttggacttgtctttatagctggaagtaataggatttgaggtgtgaaaaatgttacctgcctgaattagccaggcagacctatatatgtggttcagttacatagcgctctgtgacaaatcacctcaaaacttagtggaataaaaccaccaccatcttatttgcacagattctttgggtcaggaatccagacagggcacagtgggaatggcctgtctctgctccatttactggaccaattaacgagctccagctgggaagactgaaactgctgggggctggaatcatctggaagcttctccacctatatgcctggtacctggggtgggatgactcgaaggctggactcagctggggctgtttaccagagcatctgcgagttgacccttcatggagctcaggcttcttgcagcatggcagctggcttcccaagtgggagggttccaagagtgagcatctccacagaacaaatgttccaagagaccacgtggaagctgcatggatttttataacttagctttggaagtcagataacagcatttctgccactctttcttggtagaagctattgcacgtctccccagattcaaggagaagggacccacctctcactggaaggactaaaaaaattcacagccacgtaaacagaaaaagcacataagccatttcatgctacaccatggtgctaattcaatgaaagattagcttggagtagaagtcaggaaagctatatcaagaatgagttaattgtaaatgggggaaaaagcatgaacagtgtatattgtgaagaattaatgaaaataattgcgttcagtagcaaaattcaagttaacctaaatgcctagcaattggggagtagttcaaataaattataaataaaatatttatattaggaatatgatgcagactttaaaaagaatgaggtagctctatatgtaattatataagaatatgtccaagatctgttaagtgaaaagattgtttacagaaaaacatgtatgcaatgattcatgagtattttatcttaacgtgtacatatatatgtaaaaattcaggaaatagtcttaaaaattgcattaaattgttagtggatttctactgtagatgagagtaggacttgggtgggtaataggaaggagaacccacttctcactctatagttctatgctgtttaaatttttagatgtattacgttttcctatattgctcttatgatatgaattgctatgtgagattttaacttttaaaatacattaaatttaatttataaatataaaaatataaaatgtttcatatttttataaaatgtaaagtttaatttagttaatttggtaaacatttttcttcctgggactgttactgaactttactttcctagtattttattatatgaattggtacagtaggtgtggcatgggcacagatgggcactagtctgtttggcatgctttgtttggcatgctttgtagttgcgagagaaatttaagaatgccagtcttggccgggcaccggtggctcatgcctgtaatcccaacattttgggaggccaagccgggcggatcatgaggtcaagagattgagaccatcctggccaacatggtgaaaccccagctctactaaaaatacaaaaattagccaagcgtggtagcgcttgcctgtagtcccagctactcaggaagctgaagcagaaaaattgcttgaacctgggaggcggagattgcagtgagccgagatcgcaccactgcactccagcctggcgacagagactctgtatcaaaaaaaaaaaaaaaaaggaatgccagtcttactgttttttgttcctcttactgctcaggcagtctcctcagtggcagcagttcctgaaatgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactatattcataatatagttaattacagataataatcaaattaaggaaatttggtgtcattagaaaagatttatgactttaatggaattgactgatctttctttcttctttttttttttttttttttttttgagatggagtcttgctctgtcacccaggctggagttcagtggctggatctcagctcactgcatcctctccctccgggattaaaaaatttttgtgcctcagcctcccaaatagctgggattacaggcatgcaccaccacgccaggctaatttttgtgctttgaatagagatggggttttaccctgttggccaggctggtctcgaactcctgacctcaggtgatccacccacctcagcttcgcaaagttctgggattataggcatgagccaccatgctcagcccaggctggtctatttctgagctaatcttctggggtgggttttttggagcatcacatacccctcaagctaatagaacaggatagaagccaagatggagatctagagctacattttaaaggtgccagtcctctacttacttcctgtgttgtatggtaacctgatcatgcctcatttttcaaacaattatgttatttaaattagtgtcagacaagaagtagtaagaataacttaaacggtgccagggactgagctgtgctctggctgggcaatgagttagctgatacttcctacctgtataacatttatggtttagtaggatagacagaaacataaaataagtgattatgagaagatcggctcatcacaactttgagagatacacctggctgcatactctctgtttgccctttctgatccaccatgctctgtgccctgggaggcagaccattatggatcacatatggggccccttgccctgtggcttttaggtatttatttccccygctccctccttccctcagcttcctcacatttgtaaaatgggatattatttaagtagtcagggtccaggcaggaaagaaatggtactcaaaacagtctaattgcaaagagtttaatgacagaaatttcacaaagatgtgaacaaggtaagggaaactagcaagaattgtggggtacctgggaggtaccccaaatacttgcagatacttttctctcacgtttactctgatggttatttcttttgctgtgcagatgctttttagtttagttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttgatccaaggcttaaggctctgggtgattggtggtgctatgttcctctgctgaaagccacagctcccatagggtggccctctcttacagctgttgttgcagctaaattcttgctgaattctggcaactaatcctcctcctcaaaaacacttaaacaaacaaacaaaaatgcatataaactctcccaccccttcagacgtaggggaggtgatagctttgctgttgctagcctcctaagtacccaacaattcttgctagtttcccttaccttattcatgtctttgtaaaatttctgtcattaaactctttgtaattagactttttataattagactttgttttgagtacaatttttttcctgcctgaaccctgactrcttagataatatcccattttayaaatgtcaggaagttgaggcgtagagatcggtgaatatcagaactaggattcaaattcagattattttatgtcacggctgattcttaacttcagtgttttcctatttgtcacatccaaggaattctcatagtcatctttacattgagaagaaaccctagggaaaagtttcttacctgtcagatacagctatgaasttatgaggctataaaacaaactagctcttaaatatttcaataaataacatccttccaatcaactcctgtggttcagagtttttckttactttcttttagaattgccatcagattcatattataagccaggaaggaaaaaataatctaaaagtaatcaaaccttcaatttgccaccgtattctctaggcttggttcaggttgactactggttgtttgcaaacacctgatccacttttgaggaccaagtttaaggatatatttaaaatttttaaagaaatttcaatagctttgggggtacaagggtttttggtatgtggatgaattgtatagtggtgaattctgagatttttagtgtgcttgtcacctgagtagtgtacattgtgcccgatacatagttttatatccctatttcccctcccaccctcctctttctgagtctccaaagtccattatgccactctgtatgcctttgcatacccatagcttagctcccagttataagtgagaatgtaacggtgtttgattttccattcctgagttacttcacttagaacaatgacctccagctccatccaagttgctgcaaaagacattatttcattctttttttatgattgactagtattccatagtatatatagtccatattttctttatccacttattggtcaatgggcacttagattggtcccatatctttgcaattgtgaattgtgaaaaagacacctgcattaaacatacacatgcaggtgtcttttttatataatgacttcttttcctttgggtagatacccagtagtgggattactggattgaatggtagatctacttttagttctttaagaaatcttcatagtgtttttcatagaggttgtactaatttacattctcaccagcagcgtataagcattcccttttcaccacatccgtaacaacatctattgttttttgattttttattagtagccattttggctggagtaaggtggtatctcattgtggttttaatttgcagttccctgattagtgatgttgagcattttttcatgtgtttgttggccatttttatattttcttttgagaaatgtctacgcatgtcatttgctcactttttgatgggattcttttttttttctttttttttgctgatttgagttccttgtagattctggttattagacctttgttgtatgcatagtttgcaaatattttctcccattctgtgggttatctgtttactctgctggttatttcttttgctgtgcagaagctttttagtttagttaggtcccatttatttgtttttgtcacatttgcttttagggtattagtcataaattctttgcctaggccaatgttcaaaagagtttttcctgggttttctcctataatttttatggtttcaggtcttagatttaagtctttgagccatcttgagttaatttttgtatacaatgagagggatccagtttcattcttctacatgtggctatccagtttccccagttccgattattaaatagggtatccttttccagtttatgtttttgtatgttttgtcaaagatcacttggttgaatttggctttgagttctttacttatgttccattggtctgtgtatctacttttataccagtaccatgctattttggtaactatagccttgcagtataatttgaagtcagttaatgtgatacctccagatttgttctttttgcttaggattgctttgactattcaggctgttttttggttccatatgaactttaggatttttttttctagtcatgtgaaaatgatgttggtattttgaaaagaattgcattgaatttgtagattgctttaggcagtatggtcattttcacaatgttgattcttccaatgcataagcacaggatatgtttacgtttgcttgtatcatctgtgatttctttcagcagtgttttgtagttttcccttgtagtgatctttcacctccttagttaactatattcttgggtttgggtttttgtttgtttgtttgtttgttttttgttttggtttttttggcagctattgtaaaagggattgagctcttgatttgattcttagcttggtcattgttggtgtatagcagtgctattgatttgtgtacattgattttataacctgagactttactgaacgcatttttcaaatctagaagtcttttggaggagtcttaagttttctagataaatgatcatatcatcagcaaacaatgataatttgactttatcttttccaatttggatgccctttatttctttctcttgccttattgctatgtctagaacttccaatagtatgttgaatagaagtggtgaaagtgggcatccctgtcttgttccagtactcagggggaatgctttcaacttttccccattcaatataatgttggcttgtgggtttgtcatatatgacttttattattttgagatatatcccttctatgcctgatttgttgagggtttttatcataaaagaatgctaggttttatcagatgctttttctgcatctattgagatgatcatatatatatatatatatatatatatatatatatatatatatttttttttttttttttttttttgagacagagtcttgttctgttgccaggctggagtgcagtggcgcaatctcggctcactgcaacctctgcctcccaggttcaagtgattcttctgcctcagcctcctgagtagctaggactacaggtgtgcgccaccatgcccagctaatttggtatttttagtagagatggggtttcaccatgttggccaggatggtctcgatcttttggcctcgtgatccacctgcctcggcctcccaaagtgttgggattacaggcatgagccaccgtgcctggccaatcgtatggttttgtatttaattctgtttatgtgatgtattgacttatgtatgttaaacatacatttatatgtttatgttatacatacatacatacaaatgtatacatacatttatatgtatatgttaaacatacattatatgttatgcatacatttattggcttatgtatgttaaaccatccctgcattcctgggttgaagccccttgattatggtggtgtattatcttttttttttcttaagacagagccttgttctgccacccaggctggagtgcaatggcgcaatctcgactcactgcaacctctgccttttgggttcaagtgattcccatgtctcagcctcctgagtagctgagattacaggcacccaccaccatgcccagctaattttttatatttttagtagagatggggttttgccacattgcctaggttggtctcaaactcctgagctcaggcaatctgcccacctcagcctcccaaagtgctaggattataggcrtgagccaccatgcccagcctatctttttaaaaaatttttattttattttattttaagttctgggatatatgtgtgggatgtgcaggtttattacataggtaaaagtgtgccatggtggtttgctacacctatcaacccatcacctaggtattaagccccaaaggcattagctatttatcctgataaatagctcccccgctcccctcccacaggccccaccgtgtgttgttccccttcctgtgtccatgtggtttcattgttcagctcccacttacaagtgagaacgtgtggtgtttggttttttgttcctgtgttagtttgctgaggataatggcttccagctccatccatgtccctgcaaaggacatagtctcattcctttttatggctgcatagtattccatggtgtatatttaccacattttctttatccagtctatcatgggtgggcatttgggttgattccatgtctttgctattgtaaatagtgctgtaatgaacatacacatgcatacatctttataacagaatgatttatattcttttggatatatacccagtaatgggattgctgggtcaaatggtattatctttttgatgtgccattggatttggtttgctagtattttgttgaagatttttgcatctatattcatcaggtatattggtctgtagttttttttttgtttttttttttgtttgtttgttttttttgtttttttattatgtccttttctggctttggtatcagggtgatactagctttcatagaatgagttagggaggattcctctttctaaatctttagaaatagtttcagtaggattggaatcaattcttctttgaatgtctggtcgagttcagctgtaatccatctggccctgggctcttttttctttggcaggtttaaaattattgattcaatctcagttcttgttattggtcttttcaggatttctgtctcttcctgattcaagctaggaaggttgtatgtttccaggaattcatccatttcctctagattttttagtttgtgtgcacagaggagttcatagtattctcaagtgatcctttgtatttctgtggtgttggttgttatgggcttcattttcattttttttctttttttgagatggagtgtcgctgtgttgtccaggctggagtgccatgtcatgatcttggctcactgcaacctccacctcccaggttcaagcaattctcctgcttcagcctcccgagcagctgggattataggcgtgcaccaccatactcggctaatttttgtatttttagcagagatggactttcaccatgttggccaggatggtctcaaactcctgacttcaggtgatctacccaccttggcctcccaaagtgctgtgattgcaggcaagagccaccgtgcctggccttcattttcatttctaattgagtttgtttgaatcttctctctcattttcttggttagtttagcaaatgatttatcaattttgcttatcttttcaatgaaataactttttgtttcactgasgttttgtattttttgtttaaatttcatttagttctgctctaatcttttatttatttattattttctagttttagctttgtgtttgttcgtgtttctgtagttccttgaggtgttatgttgtcaatttgtgatctttccgattttatcttagcactgcttttgctgtatcccagaggctttgataacttgtgtcattatcattcatttcaaagaatttttaagtttccatcttgatttcattgttaacctaaaaatcattctggagcagattaatttccatgtatttgtatagttttgaaggttacttttggagttgatttctagttgtattccactgtggtctgagaagatacttaatacaattgtttctttaattttactgagacttgtggactatcatatggtctatcttggagaatgtttcatgtgttgagaagaatgtatattctgcagttcttgggtagaatgttttgtaaatatctgttaggttcatttgttctagagtgtggtttaagtccagtgttcctttgttgactttctgctttgatgatctgtctagtgctatcagtggagtactgaagtcccgtactattattgtgttgctgtctatctatttcttaggtccagtaataatagtttyatgaagctgggagctccagagttaggtgcacatatgtttaggtggtaatatcttcttgttggattgatccttttgttattatatagtgaccttctttgtctttttttttcttttttactgttgttgttttaaagtatgttttttctgatataagaatagctactcttgctctcttttggtttccatttgcgtggaatacctttttcactcctttacattgagtttatttgagtccctgtatgttagataagtcttttgaagaaagcagatatttggcttgccttgttttaatccattttgccaatctatatcttttaagtggagcatttaggctatttatgttcaatgttaatattgaaatgtgaggtactgttccaatcattgtgctgattgttacctagatacttggttttctttgttatattagtgttttataggccatgtgagttttatgctttcaagagtttttattctgctgcatattgaatttttgtttcaagatttataactccttttagcatttcttgtggggttggtctggttgtgacaaactcactcagcatttgcttgtctggaaaagactttatttctccttcatttatgaagcttagtttagctggataccaaattcttggctgacagttattctgcttgaggctaaagataggaccccagtcccttctagcttgtaagatttctgctgaagttaaggggacatttaaaagaaatacattttctgctgggtgtgttggttcatgcctgtaatcctagcactttgggaggctgaggtgagaggattgcttgaggccaagagttcaagacttagctggccaacatagtgagatcctttctctttttaaaagcattttcattttttataattatatatttttaaaagtaaaattttaaaaatacattaattgagttgaaggacattccaaaagaggcacctaaagatgtgctcagtgatggctgccaagttgaaatgagcatagagcttctagggactattttgaaagataggatatttatttctgtgtgtgatctcttgacttacaaataccagaacttactcatgttacctgtgtctcacctcagtgcatcctgggtgtgtattaatttctttgacctgcagaagaactctaggctggccaagttgacagtgattgagagcatacagcccattattgccatctaaccagagatggcttgagacagcatagcctagtaagtagttaagagtagggccctggccgggtgcagtgactcagtaatcccagcactatgggaggctgaggcggacggatcatgaagtcaggagtttgagaccagcctgaccaacatggcgaaacctgtccctactaaaaatacaaaaattagccaggcgtggtggcggatgcctgtgatccctgctactcggggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtaataatgctacttcttataaagccagtggcagggttcgtgaatctcagcggtatgtttgggctgattttcacttctggttctgttcccattcgagcactacctttgatctcctatgctgttaatacctgttacttttctaccttttggttaactttgtagactgaactgttgcagatgaagaatcactcttgcatcaggcatgtaaaagatatcaaaactaaagaaattttgccttccttaagaaagcaagaatgagaaatccccctgtgccatccataaagagggcattcaaagcctgagtgttgagtaggagttacagcagaatggcacatgtggaatgaagttcaggcctttgaggactaggaaaatggtactcagcttttctcgtattaatgcctggaagcaggaagagctgttctacctataaaatgggggttggagggatcctacccattagcgagggaatagccatgggaggaaagaaaggaactggcaagaaaacagggacccaaagcctgaatcactcatagatgaagtagctgaattcttatctatgtgatcttatccccccatcagatgagacattaacacagagttgtctgaggcaggtggagaaggttaagggagctataaaagggtatcgggctacagtgctttcatagagaatatatatgcattctgtttctccatttttctttggaggatttaattcttttcttcctatctttccaattaaaatgaaaacctatggtaygatttattacaagaagctttacttaacttctaatagtctgatctcatttccttgaataaaaatgacatcacagtaaaactagattataacatttttaggctttgacataatacagacctatgaattgacttaacccactgaatagttatagaagtgaataactaagctgtctgtgtaatggggagggaaaggaatgtgaatcctttatcacacgaagtaaaccaacaacatagtacagttttagagccacaaggcagatatgaggacgcacctggtcactcgtgctaccttgcccagggataaaggattttcacctagagtgcatgtaaacatctctacttgcttacctgagtgcctattcagctgtaaccccagttctttcttatttctcctacatttaaaatcacttaacaggctgggcacagtggttcacacctgtaatcccagcactttgggaggctgaggtggacatatcacttgagatcaggaatttgagaccagctggccaacatggtgaaaccccgtctctactaaaaaatacaaaaattagccaggcatggtggtgggtgcctgtaatcccagctacttgggatgctgaggcacaagaatcacttgaacctgggaggcagaggttgcaataaggcaagatcgtgccactgcactccagcctgggtgacagagtgaaactctgtctcaaaagataagaataaatwaaataaaatcagttaataatatgataccrgaataaagaccacacgtaatctgctcaaatctaaagggacatgcaatggaagcttaaatacaccatgttgtagttgaaaattgttttaggaaggggctggacagtgagaacgcttattgccctacagagagtgacatgtcaggatttatagtcggaaaatatatacaaatagtctccagagttttaaatcatctgctcattacagaacctcatttcaacataacagttctctggtgtatgaaatggatggaagcaaaagttatggtagatttacaaaccaaarttcaactatgtctcattttatgtatgtgagaggatggcatgcatccatagtcccagctacttgggaggatgagacgggaagatcatttgaacttaggaattccagttcagcctggccaacatagtgagacctcatctctgaaaacaccaaaagtttttttttttttttaattaaaaaaaaatgtgagagracagaatggtatattaagagagtatgagtttcagaatctgacccctgattctggcctgcttggcacccaatccttgggcaggtttccagctctctgagctgttttcttcctctgaaaataaagccgtctctctagccagggttgttagaaagatcagtacttacatgtcaggccactagcacacagcctagtaaattaacaatggcagctgctatgggacatgacatttcatgtctgaaacatatccagggttttgtcaaagagcaagtgttcagctatagtctttattggtgaagttttagcacatttattgggcaaactctagtttcatgagatacttatataaagttttagttattgacacttttttctatttcatagccacattggtatattttttgcttataatttggctacaggaggggattgaatatagaattcacaagtctaaacttgtgtgtaaagttggctcagtttcgtctaccaaattagagtgatcctgccctccaagtgtattgtaaagtgtaatagaaataaatgggagagaaggctcttcctcacaatagtagaaagaattatggagttagaaaatcaataggctgggtgcgatggcttatacctgtaatcccatcacattgggaggccaaggcagaaagatcacttgagctcaggagttcaggaccagcctgggcaacatagtgagaccctgtctctatttaaaataaaggaaattaaaataatagaaagagaaaatagatgcttacatcagtaaatacaagtgtttttttgtttgttttgttttgttttttgagatggagtttcactctcgtcacccaggctggagtgcaatggcacaatctcagctcaycgcaacctctgcctcctggattcaagtgaatctcctgcctcagcctcccaagtagctgggattacaggtgcccactaccacacctggctaatttttgtatttttagtagagacggggtttcaccacgttggccaggctggtctcgaactcccaaccttaggtgatccgcccaccttggcctcccaaattgctgggattacaggcgtgagccactgtgcctggccaaaattgttattttttaacaactttctgagtgcttggaattatgaaggcagcatttgaaatttttgaaagtatttccctacactttaacctaatcttaagccactaatactgtttaagatttaaaattatcttggcagtcgaagaagtaaaatccagaaaagataaatgacttgctcaagatggttcctgccaaatctagaaccttcatcccatggcctcctgggattgggttttttcatagactatcggcttaagtgctttttggaaataaaagaaaatgtaaatatataaaagataagaaagcaaaattgtatcttctctggggtagtttagcagtagttctgtcttaaagagaattagaccagagagataccatttctaatttgaaactctttggttctgtgaaattggttaaagaggctaaatttgatacaagatctgtctctatgtgatgagccctttgaatattactcagtacatcacggtgaggggtgggtggcctcgtgtctttaggactcttccagtggcatgtgagcaatagcatctgttaccatttctacatgaaatgattggccaatcccacaggttgggctgtctcactcactgagaagcagcagggcagagtggttagggaaaggtgatggagttggataccagcatttgtgtgtctgctctggccacttgccagctgagtgactctggaccaggataatagtgaagatgacaacaataataaaacctgcctcatagggctgttgtgaagattaaatgagttaatatttgcaaagaattgagaatagcacctggcatatagaacatgctatacaaacatttttaaactgtggcaaaaatcggccgttttaaccttttttttttttttttgagatggagtttcgctcttgttgcccaggctggagtgcaatggtgtggtctcggctccctgcaaacttcgcctcctgggttcaactgattcttctgcctcagcctgccgaatagctgggattacaggtgccagccaccatgcctggctactttttgtacttttagtagagatggggtttcaccatgttggccaggctggtctcgaactcctgacttcaggtgatctgctgcctcagcctctcaaagtgctgggattacagatgtgagccgccatgcctggcccatttcaaccatttttaagtgtacgtctctgtggcattaagtaccttcacattgtcgtgcagccaacatgaacgccccgttctctcctccccaacaacccccagcaacctctattctactttctgtctctatgaatttgactactcttggtacctcatataggtggactcatacagtgtttctttttgcgactggctaatttcacttagaataatgtcctcaaggtttatccacactgtagcatgtgtcagtatttccttcctttttaagaatgaataatattgccttgtatgtatataccacattttgcttatctgcttgtctgttcgtggactcttgagttgcttcttccttttggctattgtgaatagtgctgctatgaacttaggtacaaatatctgctggagtcccagctttcgcttattttgggtgtatacccagaagtgggattgttggatcatatggtaatattatgtctaagtttttgcagaattgctgtactgctttccacaggagtggcaccagtttatatccctaccagcaatacacgcaggtttcatttttttccacacctgcaccaccactcgttgtttttttaatgcattttttaatatgtaaaattattggaggaatttattaaccagcagtcatatatccagtgttgttaagttgttgccttagtctttttaaagaggaatgagtaaaatattttgacgaaggaagatttgggaaatcttctggttaatcagatgctggttaatcaatgtttaccagcaaagccctccttctgtgtttctagaaccctccttctgtgtttcatctaacctctccttgatctaatactcccacccccatcctttgcactctacttttaaggagaaaggcaagtcataggtagtaagtttataacaagaattcgtttagaaccaaatggctttttggtttatgtactgcagtgtgtaaaaaatgggttggctcagtttcatctaccaaattagaatgatcctaccctccaagtgtattgtaaaacttttatgaacagacttagcatatccagcataaaagtagcccatccgtgaaaaaagatgtggggaaaaaacagatggaatgagaaagttctggttcctctctggcctgtgttttccctctggcctgtgttttccctcttgacgtgcttccttactttgtgagcacaagtttcagtgggtgccaggggcaccagtgcattaagaaggtcatgcctattttgcgaccagtttccagaaggctctgcggatcacagagattggtagtaacatggggcatagcccaattcagcaggaaacagttaagagccgttgtcggccaacctccccaacagcacttgggttttcctgttgagagcagggactgagagacaggactagctggatttcctaggccaactaagaatccctaggcctagctgggaaggtgaccacatccacctttaaacacgaggcttgcaacttagctcacactcgaccagtcaggtagtaaagagagctcactaaaattccaattaggcaaaaacaggaggtaaagaaatagccaatcatctatcgcctgagagcacagggagagggacagtgatcgggatataaacctgggcattcaagccggcaatggcaaccccctttgggtcccctcccattttatgggagctctgttttcattctattaaatcttgtaactgcaaaaacaaacaaacaaacaaaaaacatggggcatagccacgtccgtcgagagctgccagaatcggtgggtctagggtcttgaataagatgcttcttcccaggaatgatgcctcccagctgggttccctaagctgcctgcacatgtttgaccaagtgtgagctaagctggggtgggtgcttggttggttaaacatgaagttgcttatgtggcctgagacctctgtgctgytaaaccaggagctgctggtatgcagacctatgcagcccgtggggtacacatagcacatcttctcaaaaatgccaattttactaagtttgggggtgggaaccccttctattttaaatactgaaacacagataaattgtggattaaaatgaaaaatggatgatttttttaaaagggtgagacagacatgatactttatgctaattggactttgagctgtgcccccaaatattccttttcaccccttgttcattccatgtgtttcctctcttctgcatgtagggttttctatgaaaaagcttattgctgcacaatttgggaagcctggggatgtgtggaggtccagagagactcagaaaggctggtttgcatctcctaagggtagcgtggctggtaagagtcagactgctgcatggctgtgctcgccatgtgtcatctgtgatcttggacaaatggttgggctgtctcaagcctctgtttccactctgtaaagtgggaataataccagtgtcataggattgttgtgggttaaatgctgtgcaatgaagaggagctggtgctggctttgtctgtgtctgtggaagggtggataaggagatgaagcctcacctgctgcttctattagtgcctctcctagccctctatccttacttattcatgtagcaaggtctctacatgctggaattcacagccttcttttattgctggatctcttctctctgccctttgtctccccttagataactctaactcctccagacctgatatcaagatgaaaggaaggctggcttgggatctggagtagctgaagatctggagtacctgaagactactccagaggactttacctccaagggcaagaaacccatctggtgtgctgctcaaggctctccataagtggaagcatcaggatagtagtgggtggagcactaggagaggaaatggggaagcaaggattttgaagggcagatgagagccattatctttaatctccatccccattcccatgggtgcagctctaaacatgttgcaagaaaaagcagatccacatggactatgaatactggtcaactggcaaaatgagcttggtttgagtattaaattaatagtaattattataatatcatcagtgacttaacaattgatgcccagtgaactgtacatgattctcttgcaggtatgtgtattattaggtgttccaagtcagccaccttgaaagaacttttatcaatagaatgaacatctgcccagcttcttgattttgagctgtcacctgatcttctcactttcatctcacaaccgtactcctctcatctacccagcttagaaacagctgtaaaatgacctgggggtctcccttcacctattctggagaagctcaaagacttggaagggtggaggggaatggccctcttagctgtgtccataaaacagagactttgaaggctgaggattgggacagaaatgtgccttgatgtgtgtgtacgatttctctattcttgtcttcacttctccagatgtgttttgcacctaacttcctttctctcccgtccttcaaacctgacttcaaactctcttcatctagaaaactggctctgattaatcccattattgaacaacctcttttccctccctcggcttttctattctttctactttaatgagttggtactttttccaaaggagctttataacttttctccagctgttaaatgggtcttctcctgttagattgtaaactgaggtacaaagtccttcttccaccttatcccttttctctacccatgaagtgccctgcaactatttaaacattagttagagactttgccatgtatcagaagaaacacattctgttgttgtatttattggttttaattataaagcagttggaatgcattttaggattctgaatctccataattctctgccagcactttgcacctagtggaccattagtaggaataattttccatccctgcctagcttcataattgtagacacttctgctgcacaaatgctggcagggctctcatgacttaattctgaaattgtatttagtggctaatacacagagaagatttggctatctcctctggtctgcagctgacatgtggcatgagggaatttacatacagtaccacgatccagttcccagccaagaattaaacgcctggaggagatcagttatttaaatctgaagcagtacagcatgaattatatttaaggtagttgctgttctggctcttgtataaagttctttcagctctgggctaaagaatcataatacctgaaaaccttcatgtctgttgtatgtttataagaacatccttttctaaacttgggaccatttactttctgagagcagtggtactgcatgttagaacaaaaagcacacaacaagccaaaaccaaaatrtttgcagctttgttgccctagtggggtaaattctttcccatgagagagctgttctctgtgtattttatacactttccaagtagtttacacaatcacgggttgtatacattatcttcagcctgcaaactcgatgtgaacctcacccactcttgccaacccaactcccttcccacatcagccattccgtttcctcctactgcttcctgtgctgttgacctaaaagaataaaaatgtttgcactaatataatagggtacctccaaaacataaaggtcagtgaagactaaacaaaaaccaagaatagttttaaatacacaccaactctatagagcaatctattagctctaggaccttgagtaaagcacttaacccatttgaatcttagttaagtggaggtaataataggaggtaataatatttgtcccatctatctgatgagagctgttttagtcatatgagagaatttatgtggtagcactttataaatatgtactacttctatgaaactgaagagctcagcatgtttggttcaagtcttgctgcttgctgttggcaccatatgcagtgttttatgacttctcatgagtctggtctccttacaaaccctaaatgtgtgkacctgagctgattttcatatcctacttaaaccagagaaacttcttgctaatgagaactagcctaggtggctttagtcctgaatctaatcacattgaaatatattcttgatccatgactgtattgtcaacatatccccatttgcatagtatgatccacttgagagctgagtttttggcaatmttttttaaattgccctgaatcatgtgttaattcacactcactaacagcatatgcttgcattaatagcacccrtctgttcaacatcatagtcttctaattgtgtctgttatattaaacttctcttccaaatataagttttgacttaaagtcagctccttagtatatccctggaacagtgaaatgcctttatgttttgtccccttaattgaacaagcttgtctttatgtaaattggcatattggggtgactttctggtgccaagccatggcttgtttccacctccaccatctgaagtcacgaagtgtgctggctgttacttgttgacttcctttttcttcccccataccgtgctcctcttcctcttgttccttctattgccagtcctgcctatgaaaagcatcaccatgtttttctttcttcttctaatttggatttcatgtcacacaggcttgctgcagccttctcgtcactgtccaggttaggttcccttccattcattctctttcactcacctcttaccctacctgttttctcccattagcctgtcacacccacgctatctctttaggccgttgggccttctaataagatatcatggcattagtcatcttctgatcacttcctctctgctgcctttgaacttctgtgatttttaaaaatacggtaaaactgactaaatattcattgtacattttgaatgaccatgatccttttctagaagttcagatagatcagttagatgcatgaaagtcatcctttgcagtggacctggtattaatgcttattcctcattattattatttttttttctgcaactgaacattaaaacaaatttaggctggacacagtggctcacgcctgtaatctgagcactttgggaggccaaggcaggcagatcacttgcggccaggagttcaaaaccagcctggccaacacaacgaaaccccgtctctactaaaaatacaaaataattaaatgaacgtggtgatgtgtgcctgtaatcccagctacttgggaggctgaggcatgagaatggcttgaactcaggaggtggaggttgcagtgagctgagatcacaccactgcattccagcctgggcaacagaatgagactgtcttaaaaaaagaaaaaaatttaatctcttgttatttctgatatagatatagtaaagtaatacaggtaaatggtatagaatatttggaaaatgtataagaattaaaaaaaaaaaagaacaaatctgacctcaggtgatctacccgagtgctgggattataggcgtgagccaccacgcccagcccttgtttttttcttttctttttttttttttgtttgtttttattatactttaagttctagggtacatgtgcacaacgtgcaggtttgttacatatgtatacatgtgccatgttggtgtgctgcaccattaactcatcatttacattaggtatatcccctaatgctatccctctaccctccccccaggaagggggacagcccttgttttttcttttgatcttattacaaccctggcattcctcatgtgatctaatttgtcaatattgaatattaatttttttctgttgctggactatatttgagatttttggatctctgagaaaaaagcctataattttactttttatactttcaagatagtaacattaattttatgtggttttcagggaaaaacaaattcacacaaatctatctgctgattaacaagatatctataataatagcgacactctcagaaaagcaacaccctcagaaaagcctaatggctgctgatgtcatcaagcatttacatgcagggagatagtggcacttcagtttagtagaaagatcatgaactttggaaccagttgttttgaatcccaattctgccatttacctgtttttatgatcttagaattaccaaagactaaattagctaacctctctgagtttgtttcctattcgaaaaatgtattttccaatcaattcctatcttttttttttttttttttttttgagatggagtctcgctctgtagcccaggctggagtgcagtggcgcaatcttggctcactgcaacctccgcctcccaggtcccagttaagcaattctcctgcctcagcctcctgagtagctgggattacaggcttgcgccaccatgcctagctagtttttatatttttagtagaaacggtgtttcaccatgttggtcaggctggtcttgaactcctgacctcatgatccacccgcctcggccttccaaagtgctgggattaaaggtatgagccaccgcacccagccttcaattcctatcttaaagaggaatgcagggactaagaagtaatatatgcaaaatatgtgatgtagtaagtgcatgttaagtattaatcctttctgtctgtgtttttttattaacacatcataaagagcttacattgattagaggaataagttatgtgctgtataatatacagaaaaaaaacccacttgtaaccaagagattgttttattttcttgcatgtaccattgaatcatgtgtgatctattttttcatttttcctaatagtcaagggaaaattaagccaaggctcactgttcccttgtcttctaaagcctccaactttgtaggaatatcctctgctattttactatttggggtggtttttgtgaggatagggacagggtgttagcagtgacttgctactccttgggaacagcccagaggactgttgttataagacctgctaattctgcttaacagttgtaaaatattattatttctatggggcattaaagtttatgtaaatatctgggtctttaaactattcattatctatagagaatagggagaattactttaggattggttctaaataacttgagacattttgccctgaccaacagttaaagcataaaaggttcataccgagtcatagggagttgagtttctttcccttcttctaaatatagtagaagcttatccaaactaaagatttttaaattaccttctgttgttggagttaaattttttaaattggccttggaaacttgacacttcattctttcttactgagatctgtatggggatgggaggacagagtgtataggagcaggcagtgggcaaatggaattttctctgtgcctacttggtaataagtaagaggtttggtttccaaactgtgtcttgaaattgtaattgtccaagaaatcccaaatstaggaatcattgcctataattcttccaaattaagcagggttctagatacaccscacccacaaacccagtctgcaggccagccctctgtatatgggccttaatgtctccatgggctgctttgggtttctagataatgaaaaaagaaattagatatatatatattttttaattattattatactttaagttttagggtacatgtgcacaatgtgcaggtttgttacatatgtatacatgtgccaygttggtgtgctgcacccattaactcgtcctttagcattaggtatatctcctaatgctatccctctcccctccccccaccccacaacagtccccaaagtgtgatgttccacttcctgtgtccatgtgttctcattgttcatttcccacctatgagtgagaacatgcggtgtttggtttttttgtccttgcaatagtttgctgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatagtatttctagttctagatccctgaggaatcaccacactaacttccacagtggttgaactagtttacagtcccaccaacagtgtaaaagtgttcctatttctccacatcctcttcagcacctgttgtttcctgactttttaatgattgccattctaactggtgtgagatggtatctcattttggttttgatttgcaagaaattagatattcttattcagatttacacagcggaccaaatgaatttttctcttgtgtgaaatttataaataattcttctattctggaaagacatcctgggtttggagacycaggcttggtttaaaaacaaatgaacagtctgatgcagtggctcacacctgtaatcccagcactttgggaggctgaggtgggcatccctcaggaggtcaggagtttgagacctgcctggccaacttggtgaaaccctgtctctactaaaaatacaaaaaaaatttagcctggcatggtggckcatgcctgtagtcccagctacttgagaggctgagtcatgagaatcgcttgaacccaggaggcagaggttgcagtgagccaagatcgtactactgcactccagcctgggcaacaagaacgagactctgtctcaaaaaaaaaaaaaaaaaaaagagaacaaacaaaaccaacaagtgttaagtagatgtttgtaagtatgaaaatagtttggggacttttgtatgaaagtgggattaaggaaccctctttcatgtgtagatcctgatgccatgtacattgaaagcatatttgcagaaaaggataaattattttygtaaagcctaaactatctctccattttcctgcataattatgacaagcttcttaactattccaggccctagtgacctcactgcaacaaagagggtattggcagccaatcaggaactctaactcttgttggtaaacttgtcttgtcactgttagttaccctcacttctccacctgggaaattcttctaatgccaaacttgaagatttggggctttgtgttattatggtaggtggccatagtcgcttacagccttgtctaacccgaatatcctctgaagttgtgtgttgatttataactttggaaggttcttagaaatgtgtcatgggggaacagttccaggaatgatgtggaaggcaggctttccataaagttcccctgcccttagtatcttgtgtgactattatgagagcagcaaacttcgtaggactaaacttggaaggacacagcatctctgccttgaagcacaaagttgagcacaccattcagcagcctttactaagcacctattatttcytttgcccttggtagggatatagaaatggatgagactcgagggcctgtgctcagtgtctcataattttagtgtcttgatgaagccatgtttttaacatgggggtggcagtctctttcatcgtttcagattctttagagtgcctgtgaatacgtattggtttactaacaacttcggcctagggtttgcctatttttcaaaagaaaattcagtttaaggaagtttgattatgtagtcctttaaagcttaagattaagcagttgtgaaatacttttggaagctggtatgaagcaggaatgtaccacgggtcaaatttacagagggtatcagcttacctgaaatcttggactttaggttctctcatctttatattccattctcccattcccaccccagttttagtgtcttggaatcagttctcttccttctagtgtgttctttgatgtataaatgccatctctgataactattctttaagttgtgagagggggcagatatccttttaggtattttcttccagataaaagcagttcccaactcttagaaratggttcaatgaacaattgaaatgaattatctattcaagtatacttaggattccttgtagaaattttgaaacacatagaataacaatgtgtatttataatgctaaggctgggcaccatggctcactcctgtaatcccagcactttgggaggcgtaaactggaggactgtttgagctcaggggtaagttcaaggccagcrtgggtaacatagtgagaccttttctctactgaaaataaataaaggttaaatttttaaaaatacaaaataaatgctaaattgtggacatatttttttctttctttctttcttttttgagacagggtcttgmtttgtcacccaggctggaatacagtggcgcgatcatagtttgctgcagcctccacttcatgggctcaagtaatcctgcctcagccttcygagtagctgagactataggcttgcaccaccacactcagccaattttttgtatttttttgtagagatggggcttcaccatgttgcccatgctagtctcaaactcctgaactcaagggattcattcaccttggcctcccaaagtggtgggagctaccccagccggacatatttctatgaattggtaattcctggttttctgcttttccttgaagagaaacaccctaaataataccctattacagaacagattccaagccctggttttggggcctcttgccaaccctcccttcaatatatccctcaaatctaagcatttcgtaattatgccaaactttcaattgtttaataaaaactttgagagaccttttgagtcatattcatcactttktgttccatctccataataaactggcaccaagcagccactcaaatgtttgttgaacaaatgagtgaattttaatacaaagtgtatggtggccttggtgtctctgtgtgaaggtagcaggtagagaataggggaaattaaacagygaccatgtcaactccttattgaattaggtagattttgggctatttttacattggattttgtacgtrttctttgggaaatggactcctaaaggaccctttcatttctaatttatacttctatttcaaaatactctctaacaacttgctttcattctgctccttgaatctgtgaataagccttattgtgtaattttcatagaatgcaattgctttgaactgtcatctgatgctacaagtggtattttgtgagttgctaatacatcagaaagctgtgttcttcacaatgtcctcatattttttgtggttcacggcagcaagtaaagatgaactgtggaggttgcagttaatcaagttactttaaaatgaaaagaattttgaagccacttaaatgacctgcttcttgggcttggcagtgacaagtcccttcctgggcccacttagatttaacagcaggaggtactgggcaaagaataagggctgcaatgttgacagaccttagttccggccctggctttaccattgacccagcaaatagctgtgggcagtccctttcccttgcttgactttggtttcctcatttataggaaagagataatgcctatctctgagggtgatcatgagaaccacagaaccacacagtaacatatggaaatgtcctttataggcagtaaagccacatcttaagtgaattattttattagctccatgatggatctttaaatgacagtgttattatccatgccagtggttcttatcaaaagccactacttagtaaatattgagwaatgcagaaatatttgcaggcagtctctgtggcccagaaggacttgcttttgctgttaagattttctcaaattccctaaccttcctagacttacaatttgacagtagattatgaaaggtgttctctcccattcaaggaaggtgaggccaaagtgtgtgtagttagaaagtcagtgggccaggcagaaggtcagaaggcraggaatggrtatgtacaaggaagtcccatgagggtacacattttttatacttattaccctgtgtctggtgctttgactcacatgtggcacatagaaccyacgaattgaacattagttgagtaaagtccacagaatggtgctatctttgctccattaatgatcatactcttattgagtgtaaataaataaaattacctcacagagatattttggagccctttgggagcctttcccgataagatattttattttttcatcatatatttttacagagcatgcagcctgtgcagggaggtgtgctgggcaccatgaggacacaaatacgtcttctaggagtttactgttaaccaaagcaggataggagggcattttgagctgagacaatcaggaagactttgggaagaaaagtgcccactgggtcaagcctggaagataggtaggatcccactagatggggtcaatatgttgcaattgcaatttaaagctttgtgggtgtgtattttaattcacacattaagtaaaatctcttatttggacaggatgataacagagtttgggagcccctcagcagctgtcctgggctggtacaatattgcatggtttgtggaggcagttgtgggcagaggccgagggacggggttctgctggggcttctgtcttctgctggggggttagttgaggccggaagggtgcagcagcataggaaagatggggagagcaccgcctttttaatgtgactccagtgcccactcttccaagttggggatggtgtgacaagcacatgggctcccactaggagttttattttggatccaaaccttactgtttctgaagtacttactataaaatgaaaatatcctgtcagaaatgggaaagtctttaagctgaaattaaaaagagaaactggaaatcatgaggtatcttggggattaactgttcagaacagtagagatggaggattaggtgatggtatgtgagtgtggcaggtatcatttaagaaaacacagggaaagaaatataactttttttttgagacagagtctcatactgtcacctaggctggagtgcagtggtgccatctcagctcactgcaacctccgcctcctgggttgaagcgattctcctgcctgagcctcctgagtagctgggattacagctgggattaccaccgcgcctggctaatttttgtatttttagtagagatgggatttcaccatgttgcccaggctagtctggaactcctgactcagtaatctgcctgcctcgacctcccaaagtgctgggattacaggcgtgagccaccgtgcctggcctaaaaattataatttttaaagtctattcattatggagtaatgatgagctcacttagtgaggattcactggaaggtagtttttctgtacgcgcagagtgctatctatgtgcaaggagccctgacaaattggcaggagacatgaagatgatcaaaagcttcctctaaggatcccctagtttggagagacagacagactgatttacagtggggggcttttctgatgagtgatgtaataaaaatgtgaactaaagtgccaaggagagccaatggatttagattcagagatccatggaattttgcctgagatgatgtgaaaggcaccacctgcagaaggtgggagaatggctttccaggcagagagaagggtggagcagaagcactcagcgttggagggagtggtgtggtcctggaacacggtgctgcctgggagctctggctaaagtgtgggcttcctggatgtggggagatgcaaagtgctctagaacttgttctgtaggaaataggggagccatcaaaagttttgagaggggaagtaataaggaagacggcttctgttggccatggggagaatgagtggaaaaggggtagtggctgagtgactagacctgttctgagagttttatgggagagacattaagacctggactctcgcaatggaggtgcagaggaagattgagagcttctgtacttttctgaaatgtgagagctcagttttaaagtttagattggactgagtttattaaagaaaaagaaaatgtttttgacacatgtcaatctttgttgacacccgttggtatcaatgctgtggggtgaggtctccatgttcaaggaatggagccacaatggaaaattgggagtggtaggaagggggatgggacaaggatgaggacatccatggaagctcctgcccgtttgcacactgctttttttttttttttttttttttccctgagactgagtctaactctatcgcccagggtggagtacagtggcacaatcttggctcactgcaacctccacctcccaggttcaagtgattctcctgattctcttgcctcagcctcccaagtagctgggactacaggtgccccccaccacacctggctaattttttgtatttttagtagagatggggtttcaccgtgttagccaggatggtctggatctcctgaccttgtgatccgcccacctcagccttccaaagtgctgggattacaggcgtgagccaccgcacctggccttgattcacttgttagaaataatactgtaaaaataaaaaaactagccaagtgtggtggcgtgtgcctgtagtcccagctacttgggaggctgaggtgagaagattgcttgagcccaggaggctgaggttgcagtaagtcatgatggcaccactgcactccagcctgggtgacagtgccagttcctgtctcaaaaaaaaaaaaaataaaaataaaggaaaagaaatgatattgtaaaatccaaaggcaaatttctctctctgcctggtgtttcaatactcctgtctctgaatgttaaatgttcagctgcatatgatttttttctgattgattgtctcaggtgtttaatgaagactgcctttgtaaatcacatgttgttatcctctatttctagctattgtggacgatgaaaggctctctgcagaggagatggatgagaggaggcggcagaacattgcttatgaatatctgtgccacttagaggaagccaaaaggtaagatccagacttagtctatttgtgcaccatctcttggagataagctttgtgataagggygtgggatttgatgaccagagggttctgaaatgggccagcaattctaaagagttgtcgtagttggagatggccagggagagattcttgcctgcactcagtgatttagatttggccaaacctcccatgccaggaggccagtgggctaggggatgacccctccacactctgctccactcctgagtcacagctgggtgcacatcacactcctgtgcatatgctacatagttctaataactcatttgcagtcttgttggcagcaggataatgggagaagaagcatctatttcttgcaaatggttgggcagagttgagaaaaagttgatgccacagccaaagttgaggcactaggaggaaggcaactattcatttccctgcctcggagcctcccaggaaatcacggggccaactgcagattgtttcaaattcttcatctcactggcttggatgtagaggagcaacaatgacttaaatcaacttcctttttccgcagagcttccttgggtcttttccccactcgcagcccaatgatgataaatgcccagcaggacagtggcatatcagactgaagtccatcagtccctaagyaggtttatgacagcaatctcctctttaaaccgtgggtgtgtggccacttagggtatattgtctctaaaatcacattgactcttttaggctttttagattaaataaatgttgcgttctccaaggagaaagtgaagataaagagtcctaagtgcaaatactttcctcatgagaggaaytgagagaactttatcctttgtggggtgaatactacagagttcatataccatgagttagagtttgattgaatgctttatgccagggtggagcgacagtattgttccctggacaaagatatgttccagccctcttagctatatagaaataaatacttggttaaatggtcactggtgttaattatctctgatcactgatgaatggctatctacagaactagaatgatgaggtttttaatcagtattttggtgacacatgccctaatttgacatcaaaattgctttcaaggggtttctcagagttgtttaatattttagtagtgtcacgtaactttctttaggctctaaaaaccaagttttaaagattgtttaacatgtctgtgaagtctacagttaggttgcaggatgctagcgattcactatcagtctaagatcattaaaaacatgcttttagtcaagttgtcgcaaaaaagttagataaggagattgattcataggcattagaaagaagtggtcccaaccactcctgaggctaaggtgggaggatcacttgagcctgggaggtggaggctgcagtgagctgagatcgggctgctgcactccagcctgggtggcagagtgagacgctgtctttaaaaaaaaaaaaaaaaaaaggaaaagaaagaaagaaaaagaaaagaaaaaatatactttcagtgaataagttcaaggagatagtagaaaaacttacttttctattgatactcactttacattctgtttttgcctcctgtttttaacaagtgggaaggggtgtcatgtagaggaaaatgatatgtgrttgggagttggtttgcctaacttcctggtcccagctccaccacttacacaagcagcttgaccttccacagaccattttacctgtgggaagttcaatttgtcccctctgtaaatgagacaatcaagatgatgttacttattgccctacttattcatggattcaaggatttttaaaaaatcatttaaagaaggtgaaagtattctgtaagctatagtgccagtcaggtttatggtgataacataagcaaagttttctcctcagtatattgaaatggtataaatgtagcttgaaagcttgtcatcttctctagtatttttgaaattctgtagttgaattttgtttcagaaagtcagcataatgattatttcagattctttgaggaaaactttccttggaatagtttcatgaaaataattatcaaaatgtacaatttttcctctaagatggcttttcataaatttatttgatgagtatattagatgtagtatatatttatgaatcttttattaagacacaaatactttttttcttttttctttttctttttttttttctgagatggagtctcactctgtcgcccaggctagactgcagtggcgggatctcagctcactgcaacctctgcctcctgggttcaagtgattctcctgcctcagcctcccaagcagctgagattacaggcgctcaccactacacctggctaatttttgtatttttagtagagatggagtttcaccatgttagccaggctggtctcgaactcctgacctcaagtgatccgcccacctcggctcccaaagtgctgggatgacaggygtgagccactcactgtactcggccaagacacaaatactttgaaagaagctgatttttggtcatggattatataaaaatttgtggctactactagacatatagttgtgctgatttaagaaagcatagtgcacagaaaactcatggtcttgaatgcaagaaatacaggaaagggtgaatttgtctttcttgaaaagatgagaggatttattgcatgattcttttraagtattagtacctttggaatttgtgataytgggtttattataatgcacatatgtgtgttcacatgaatggagttgacttagaatattgagtttctactaaattgtatgcttgtactgtatatattcatctaggaagtgtttcttgtttctgatttcagttgaaatgactttattgcattttaattaaaaatgtattggttctgtctttgcacctgtttttctttctggaggtgagaattggaaggtatctagtttgtatatcctgtaacttaagatttttacaaattgagaattataatattccagtatatctttaattttggttttattaatttcaaaattctataataaatcaggccattgaaaagttctttattcagagrggacatcactaccaacattacagaaatacaaaggattataaaggaatactatgaacaattacatgccaatgaaaacttagaggaaattgacaaattcctagaatgacaagctactaaaactgactcaataagagacttaaacatctgaaaaaaactaatataaacagaatgagacttataataagtgaagagcctgacttagaaatcagaaaacttcccacaaacccagataacttcacagtagaattctgccaaatgtttaaagaagaattaagagcagtccttgcaaactcttccaaaaaatacgaaaagagaaaacattttccaattcattcttctgaggcctacattaccctaataccaaaaccagatagccatctcaagaaaactaaagaccaatatctcttatgaatacaaatgcaaaaatccttagcaaaatactagcaaatcaaatccagcaacatataaaatatatttaataccatcaagtgagatttatcctaggaagcaagcttggtttaagacctgaaagtcaatatcatagaccatattaatggaagaaaggacagaagccatatgatcatctcaatatatgcaggagaagcatttggtaaaatccagccccctttcttgacttaaaacgttcaacaaactaggaatagaagagaatttcaacctgataaaggacatctatgaaaaacctacaagtaacaccatactcagtggtgaaatacaggaataaggatgttttttcttaccacttctgtttaacattgtactggagattttagccaggcagttaggcaagaaaaataagcaaaaggcatccaggttagaaaggaagacgtgaaactatttctaagggatgttwtctggtttatagaaaatccataggaatctactaaaaaacagaacagragaaaacactaagaaaaccccaccacaatgagtccatcatggttgtaggatactaggggagtgtgtaaaaatggcatttcttgacacgagcaataagcartctgaaaatgaaattaagaaagcaattcactatatgatagcattaaaaacaataaaattcttaggaataaaattaacaaaagaagtacaagaattgaacactgaaaactacaacacattgaaaattttaaaactcttaaatagacrgaaagacatctcatgttcatggattggaaaatagcattaagaaaacaatggtcccaaattgatttatagattcaatacagtttctagaaatattcccagctgccttctttttttttaaatggagaaattagaaagctgattctaaaatttatatggtggccaggtctggtggcttgtgcttatcttccagcactttgggargctgagatgggagtattgcttgaggccaggagtttgagaccagcctaggtaatgtagcgaaaccctgtctctgcaaaaaaaaaawwttttgaattagctagatgtggtggcatgcaccagtagacctagctactctggaggctgaggcgtgaagatcactcaggaggctgaggatgcagtgagttacgatcacaccactgcactccaggctggatgacagagcaagaccttgtctcaaaaacaagaacaaaaataaagtttatatggagatgcaaggaatgcagaatagtcaaaagtgtcttgaaaaagaaacgcaaagttggaggactcatttttcaatttcaaaacgtacttacaaagcccacagtaattgagacagtatggtactggcataaggatatgcatatagatcaatagagtagatttgagagtctagaaataaaccctaacacttctggtaaactgattttcatcagcagaataaagtcaattcactgggagtgagagaagatgcccttttcaacagaggatgctgactactcagtgtctacatacataaaaatgaatttggacctctgcctcacaccgtatacaaacattttcttaaaatggattattaacctaaatgtgagagccacaactgtaaatctctccagaagaaaacaggagtaaatctttgtagccttgggtgttaggcattggtttctgagctatgacaccaaagcacaaccaataaaagaaaaacagataaattagacattataaaaactgaaaccttttctgattcaagagataccatcaagaaagtgaaaagacaaatcatgtgtctgataaaggttacatgtattcagaatatacaaagggttcttaagtygggtgaggtggctcacacctgtaatcccagcactttgggaggctaaggccagcagatcgcttgagcccaggagatcgagaccagcctgggcaacatggtgaaaccccatcgctacaaaaaaatagaaaaattagctggatgtggtggcacatgcctgtagtcccagctactctggaggctaaagtgggagaattgcttgagcctgggaggtggaggttgcagtgagctgagatcacactgcactctactctaacctgggtgacagagcaagactctgtctcaaaaaaataaaaataaaagtaaagcacttttaaattctacataaagagttaatagcctaattttaaaatgggcaaaagttctgaatagacatgtctccaaagaagatacacaagtgatcaataagcatatgacaaggtagtcaacatcattagtcatcagggaaatacaaatcaaaaccacaatgagatgttacttcatacccaccagcgtagctataatcaaagatggacaataacaaatgttagtgaggatgtagagaaatcaaaactcatacattgctgaacagattgtaaaatggtgcagctactttagaaaatagtctggcagctctttaaaaaattaaacagagttaccatatgacccagcaattatcctcccaggtatatacgaatgaaaattgaaaatctatgcccatacaaaaacttgtactcgaatgttcacagaatcattattcataatgacaaaaagcagaaacaatccaaatgtctacccactgataaacggtgatgtatccatacaatgaaatatttctcagctataaaaaagaatgaagtactgatacatactacaacatggatgaaccttaaaaacaygttgagtgaaagaagctagacacaaaaggccacatattatatgaaatgtccagaatagacaaatccacagagacaaagtagattagtgattgccagggcctaggggaagaagagaaatgctgggtaactgctactgggtatgggatttctttttgggctgataaaaatattctaaaattgattgtggtgatggttgcacaactttgagtatactaagaaccactgagttgtttactttaaaagggagaattgtatggtatataagttgtatctcaataaagctatttattaaagataatttccttacactggcttggagaggtccttaggaagctgttaaataagatcaattggtattagcagatacattgcatatagaaggtacccctaagatacacgagatatctaaatactgtgtttgttttacagatatttattgagcatcctttatgtgtaaacaagcctaggagggttgttttgggagatggagttcaggcaacaaataatgctgtgctcagaaaaactcgccatttggttgaactttttactcaagagtttaaagttattttccttcatttatgtttgctctgttaatctctctgtatatgtgtatcatctccatatccagccatcatcctcctaaacagctctcatatgttcacctctctatcccaccactgctagcccgccaaaggattccagcatctcttgtgagactactgtagtggtccttaactggtttcttcatgagtctctagcctccttcaatcctttatctgtcttatagtcagataaatcttttcaaaactctgagcaaactcctttacttggcctcataggctctgcatagtccagttcaacctctttagttttacattgtgccgcactgctctgtgcttcaaccacattgatctgttttattccctgttccctcctgcacaggaccttgccatgtgctattcgcttttcatattcctctttatctagtcagacttacttcctcttcagattgcagctcactttttcagggtatccttctctggcttccacatccaggtcaaactcaccgattagaaggccttttgacatcacatctattgcatgtttgaatgaataacgtaatgcccagtgttggatcagtatcattcgctactaaggaggtttgattatgctctgttttctgtacattttggatgttggaggtaacaaggaggatatgaatcagactcacggtagacagctagactgccagcctagcggtaatctttgtttcactggaaaattctatattgcagttagatgatgcaagtccttcccgacaggtttgtgacccagtaagttatgaagctgggaattccagacaacttaataagccgtgataccacagtgaactagaaaatatccagaaaggcgtatagagtattgctcaatgaatgaatgaagagagaaagaggaagcctgtgtattaggaggacttaaggctgaaattattgctcaaactttataaaattatgaagtctttacgtatagatgttaagactcaaaaaatgaattttttttttttttgagacgtagtgtcactctgttgcccaagctggaatgcagtgcagtggtgcratctcggctcaccgtaacctccacctcctgggttcaaacgattatttctcctgcctcagcctcccaagtagctaggattacagaagtatgccaccatgtctggctaatttttatattgttgtagagacaggatctcaccatgttggccaggctggtctcaaactcttggcctcaagtgatccgcctgcattggcctccaaaagtgctgggattacaggcatgagccaccgctcctggcctcaaaaaactaatattgatggcaatgaacaaaatattaaacaggcttttttttttagggccaaaaagaagtaatttggctcttcacccaaattacttcaccctacaggctgaaggattcagatgaagtggagagtgaatcacttctgttaagaggcaaaggatgtcttgtatatgtattagttgcctatgactatataacaagttattctaaaacttagtagcttaaaacaataaacatttatctcggaatttttgagggtcagaaatctgtcattgcttaactgggtcctctggttttgggtctctcacaaagctgcagtcatctcacagttcacgtggggcacacccacttccaagccacccagtgacactggcaggattcagtttctgacaggtttttggactggagatctcagttccttgctgctgttggccagagtcttccctcagttgctcaccacttgggcctctkacacatggaaacttacacatggcaactggtttccatcagagtaggcaactgagagaagaagatggaagctagtctttttgtaacctattcttagcaatgacacccatcatttatgctgtatcctattcattagaatcgagttactaagtcaaggccatgctcaaggggaggagttttccacaaggggttgaattcagagggatggggatgactggggcaccaccttagaagctgcctttcacagggtgtcttcataggcttttgaaatggaccccagaaagggaatttgaggataaaattatttttgttactattagaaactcaatcagaaattgaatccttcctgatctgaatgcttacggttctaagcttactgctgccttgattgttttttgttggtttgtgtttttgtttttaattttaagggtcttgctgtgttgcccaggctggattcaaactcctgggctcaaacaatcctccagcttcagcctcccaagtagctgaggctacagttgcttgctaccatgcctggcaactcccttgattttttttaattgggagctgttttaaactaagccttttcatttctttgtcatttaaaataatactaaatggactttttaggtttccttttcaagtaggccctcaaagctaactttatagcttctttgctgtggggcttttgctgaaatgaaactgtacagacaagtctactactaatatgggctttgaaatgtcctctctgatgccagaaatcctactatttaaattaaaggagtaacttttccaaaagaattagtactgctgagtagattttatattaatctgcctaaaatttattcaaataatgaaaatgaatctgttttaagaaattcagtcttttagtttttaggacaactatgcaaaaatgtacgatggagaattctttttggataaactctaggttgaggaacttaatccaaccggagctattgtgaaggtcagaaaacaggagagggaatcttggcaaggaatggagacggagtttgcaaattgcagcttgagtaaatagttatgaatgggactgctattgtgtctcccaaggaaagttcctgtgatattatattccttttttaaggaaagagaaaaygcacagaaaacttttgctgtgcttcctttttctgtcctacctctgaaaataaactaagcaaaaaaaaaaaacaaaaaaaaaacacccttcccttggtgataggcttgtttagaaatattatcttcaaaggtctctttakgtaagccaagccattggctatattggtgagtctgggacagttatatatgtgccctggaaagaaaacraaacacgggtgtgwttccttttgtgtcagtgtttacaactcagataccaaaagaacaccttgttgattaaatcaagtctcaagctctggccttatctagtggtgagttagagaatcagatttgaaaggagaagtgcttcaaatgtttaagcaagtgaaagccatgagttgcttaacagtcaatattcatgattagtttaaaaaaaaaagagaatcttctgactggggaatactttagagaatccagtggatttcctctgcatgcttggacctcactatccttattcctaggacatacccatggataagcaatgctaataagaacttggaatttccagggaaatatttttctttgttgctctacacacaaaatagtaatgaaatttttaagaattcctaattgcattttcaaaacataaatagttttcatgtttccactgtaactctccatttctcccttccctcccttgttctctccctggctctgacctcacctctgctttccacggggagcaagatgaactgcttggttgttccatgcggcagctggtggggcagagggtgcagtgagctgagagcagggaccccctcgcaagtctggcacctggttgaggggaaggcctgcttggggctgctttccaaccagcttgcctcaggagccctgtgccagcgaggswgagatcagggcctggcacatcccaatggcagggagagagtaacttgtgaggagcccagacttgtccagcgtagcttggcagagttggagaggtggtcttaacagggtgatctccgtggcacaggaatagacgtgatcccagccagccctacctgccaacaagtagtgcttgtagttggggcctcagagaggtgttggtgctgagggccagctggcggtgaccagggattatgctgtggagctagaatggaaggaacacttattaaggatataaaggaaaaagctacaggacttggcaggggtctggatttgggcagcagaggaggacactgggaggtcagatgccctggggcagatcaaggcattgcttatctgactcagcaggacacatttcgtgttctctgtctgccaagcctaggcttgggcatatagtaggtggaaaaagttctttgtttttagtttcacatattgtactagctttggatgtatgttggacaggtgccaatcgggtatgttctgacagatgaaagtataacttttcagagtgctggtattttaaaatacaaataatcggtattaatcatctccagccaaagacaagttgagcaactgatatttgatcccaaagtttatatttgtttctcaggatcttcaaagttggaaacctgggagaggtttggaattttccatggttgcaaatgtactttactcacaaggattatcacacgagtgtctactcaccaggcacggtgctttaagcattcaacccacatggtctcgattctcacaaccactctgtgggaaggagcattatccccatttgatagatggaaaaaccaagtcttggaaaaacttaagtaatttattcagtgtcgcagccaacaggcgacagcaacagtattacaacctaggtctttctgacttcaaagactgtgcttaaaaactataacatactgtcccatttctttatttcttaatgtgttttgatcatgtcttccttgtaagtccaaaacatggtcttggtttttaggttctatatgggctagttctagttctagctcttgatcaataaattctcacttaagctttggtggaattagcacaatatagctatccattggctatatatggctatatattgttttattttcctttctctttttttttcctgtgaactgtttctattttgttttaactggtactattataagtagtttgttctgggaataatttatcttgtatttaccttgtgttcttcctccctctttctccttctctcttttgctcattttaggctagctctttcttgctctctcttttttcaattaaaataaaatagagatgagatctcactatgttgcttaggctggtcttgaactcctggcctcaggcagtcctcccaccttggcctcccaaagtgctggaattacaggcatcagctactgtgccttaaagtattattaagaatttgtacttctctatgatgtagactttattctgttctcttcacccaagaaaattttggtgcatctttattcttggttaggcctccatactaccttcaattcatcaattatctttttggttttgccactattatgactggtttcaaagaatgcttggctttttgttgaaacatcaaaaggtatgagtagcaaacagcactgagatctcttccttcctgtgtgaacctccccaccggaagctgcctcatgctgtgatgcttaaaagtcataaaacggtatcattattcaaggcatagagtgactttagggaagctggtgggggagaacatttgtacaaggttgtcacagaatgatttctttgtgtcttccatttttagggtgatatagaatgtagagcgatcttccattgccttctcagtctgaacacctttgtttttctttaacagagtcaaatccccatttcatatatggggatactgaggctcagaaatttatctcacttatccatggtggagttagtggtagatttgggattaggataaaggtcttctgactgtttgacagtgctctttagttccatgagtctctatacaccatgttgagtagtaaaagtagaaagctcaaatgagtctctataaatcatgttgagtagtaaaagtagaaagctcaataaagaaaaaatataaacatgaatattaaacttatttggtagattcagttcaagtttgcttttggttaaatgctgcaaatggtttgggggaattagccattcatatgttcttgtccttgatctttcatttttgctgagaaacttgaacccattttggtgcaagaacaggaattcaggaattaacatttctagtcatttctgcactctgtactccgtcctacttggcttaatgtccctgggttgcttttttgtttgtttgttttttcccatcrtgtgatttgtaatacacagcttttcctgcccctggtatttctcaaggcaagagttgaggcagctatgtcatctgggagagtgacttagggcagtgatccccaaattcatttacacctgcatcaaggtcacttggatgcttgtgtgagtgcaggcttctgaggatcactcctgaccctataaggccatctctaaggacaacctccgcctcccaggttcaagcgattctcctgcctcagcctcccaagtagctggaatcacaggcatgcatcaccacacctggctgattttgtatttttagtagagacggggtttcaccatattggtcaggctggtcttgaactcccgacctcatgtgatccacccacctcagcctcccaaagtgctgggattacaggcataagccaccgcgtccggctgaggtctgccttttaacagagcactggagtacactattatgcacactgacatttgagatagcatctatggctgaggctgtctcagctctcagccttcccaccccagcttagaaaaaaggaacagaggataccccttcctctgggatgagaggggagagaggaaggatactaagagtcaccatctgctgaggtgaggagggtggaggcatgaaaaagcagtagtgcatcagccagggttggatagaaagcctgagtagttttgaagatccaattagtgttataaatgttctttgcagagccaataagcattttcatgtgaatttctccaacaagataaaagaatggggtaactatgcctagggattgacctgctggctctgaccaagtcataggtgttggggctcagacactgatgccccaaaatacagcattttgacattccaaactgaagaagcttcaaggtgtctctgacattcctgcatcccacattctctttcaaaggctttatctaccaaagatcgagacccaccaggggaaagaattgtttttccttcccctccctgtaagaccgggaatgtggccacacctgaacagaacctttcacaggatgacatacaggttaatctctgttccccatcccttttccttggtaatctcaaccaaattccttttctgcccccctcccataacctgttttgctgggatggtagttaagcttctgagtcacttgaggggtgggtaaacatgtgagtctacttgcgtacatgttaataaaacttatatgccttttctccaattgatcggccttttgtgagttgattttttcagagaaccttcagatggcaaaggggaggatttcctttggcctctgcatgggaaacagggactccagggtgttcatgaragtattgctgaaattgggttcttgaggtcccatctggccgaggagcctatgaagccaggatgggaaagatggagtggggtgaaatcaaggaaccacctacaatgagaataaagggcaggatctataagaataaggaagtggagaagtgagtaaatagaaaggctatagtccaagatttggaagccttgatcttacaggtggagtatttccaggtagtgataacgtgcaaggtgtggtgcctgtgtgtggttggagtgtagtggaggagtgttaccaaggtcatccaccttcttgaagccacccagcagaggcaggcctgggaggaaggcagcaattgtggcaagaaaggaaaagtcctggaggtcaagaaatgagtggcaaggttaggggtgagagggaagagtgaagccctgagaagtgaggtgatggacaggatgtggcctgggagaaacgtttatttgggaaagtgatgactatcctctctttgtcctgggagtcaaggaaatttggcaaacaaccacccctggagtgggtttatgaggggtgggattttgaagcaaaagccagcttttcattagacaagtaggtagagaaagtgtaaacaaaaagtgataatataggagaattacaacgggtcaggagttcagaggctcattggaaggagtgagtaggcttggggtatgtttaaggagggctggttagcaggatggagacagatgactttatatgagttctgggggggtcaggacttttactagagtttactaggaaaccaaatccactgcagaaacaggcatagatttatgtaactgtggtaggggcccattagagatcttgtgttactgatttactaattgtgctactgatttattactaattcattagctgtgacatacactttcagcaagtgactaaaaccttatgacccagagtaaaataattttatatcatgacccaggtagctgtgtgatatgtgtaataagtgggcgtgwgtgtctaactaaagattcaccgagcaacacttaacttctactatatgcaacagcctcttatgtttactattctgttctgttctaattcattttctaagaaaatgctggtcatgaaccactgtgttgattttatgatccgttaaaacattacaggtcaggcatggtggctataatcccaggactttgggaggccaagatgggtagattgcctcagcccaggagtttgagaccagcctgggcaacatggtgaaaccctgtctctgcacaaaatacaaaaaaaaaaattaaccaggcatggtggtgcacgcctgtagtttcagctacttgggaggctgaggtaggaggatcacctgagcctgggaggtagaggctgcagtgcacagtgatcacaccactgcactccatcctgtgtgaaagagtgataccctgtctcaaatcaaaacaaaataaaacattacagccgcatttgaataaagtgctttacactatcttgagcatgttttggtaatagttatgttctgcataacaatatcccataagattataatggggctgaaaaattcccaatcaaagcattactcacgtgtttgtggtgatgctggtataaacctactgtgctgccagtcatatgaaagtatagcgcatacaaatgtgtacagtacataatacttcataatggtaatacttatgttactgctttatgtatttactatgtttttatgttatttttagagtgaactttctctacttaaaataaaaagcaaattgtaaaatggccccaggcaggcccttttggaggcactggaggagaaggcattgttatcataggagataacagctccatgcagacctttcagtgggacaagatgtggaggtggaagacagtgatattgatgatcctgactcatgtgggatcttgctaatatgtgtgtttgtgtcttagtttatagcaaaaaagtttaaaaagtaaaaaaaaaattaaaaagttaaaaatagaaaaaagcttatagaataaggacataaagggaaaaatatttttgtacagcagtaaaatgtatttgtgttaagctaatgagtcaaaaagttaaaattcaaaagtttataaagtaaaaaagttacagtaagctagggttaatttattattgaagaaagaacctttctttttctttttttgagatggagtttcgctcttgtcacccaggctggagtgcaatggtgtggtggctcacgcctgtaatcccagcactttgggaggccaaggcgggtggatcacctgaggccaagagtttgagaccagcctggccaacatggcaaaacccctatctctactaaaaatacaaaaattagccaggcgtggtggtgcatacctataatcccagctayttgggaggctgaggaaggagaatcacttgaacccaggaggtggaggttgcagtgagccgagatcgtgccactgcacttcagcctaggagacagtgagactccgcctcaagaaaaaaaataatttagcataccctaagtgtacgatgtttataaagtctacagtagtgtacggtaatgtcctagggcttcacattcactatactaaaggacagtgacacaagtcctgnnnnnnnnnnnnnnnnnnnnnnnnnnnnnnnnnnntgatccgcccaccttggcctcccaaagtgttgggattacaggcgtgagccaggcgtggttgtgcgcacatgtaatcccagctacaggccgggccccctttttatgtttagatacacaaataccaccatgctacaactgcctacagtactgagtatagtcacatgctgtatgggtgtgtagcccaggagcaataggccatatatcctaggtgtgtagaaggctgtaccatctaggtttgtttaagtgcactctgtgatgtttgcgcaatgacggaatcacctaatgacatacttctcagaacacatttccctcattaagtgatacatgaccgcactaggtgctgcttcctaggcatctctgggaggaagaacattaattttaattttctgtacctagttcatacttggggtttattgtaccatctgggagaaaccaggaggtgtttagttaggcctttccctgctcacaactttcataggctccgttttccctgcaggatcatggaagggcacctcctgagcctggcccaggagcccatactcaccccttttacaccgcctccgccttcccgccatggttgatcgttctctcctcagttatgcctcaggtccctgtcctgcttccactgtgcatagtatgctttatggtaactttctccatgtgttgtcctctcttagcagtcagggagctccctgaggaagacattctcactcgctgtaccccactgccttgcacggggcctgtgcagaatgggtgctaggttgctttgcctgagtgagtgttgtgatctcagaagttctggcttaggcttcttgtccctgtgcttttgtctagagaggctttgtgagggacgctgattctgttggatagcctttgaatgattttcattctcaattgcatggatcgctttggggaacacagaccagctggctgtgcttggcagcaaggtgttgtgtggtggaaatggctgaattccacatatcctctgttactcacagacatttaggggagcacgtgccatccctctcacaattttgaatacataggaccgggtgctcctcacccttccatttcagtgggatagtttgtctagcagctgctctgtgctgatgacattatgaaatagggattttaaaggacctctgtgcaaatggagcccctcaacccctgacgatgtgttctgcacaaatagatttaagtaggctttttatgcatcagaactgcctgcaatctgaaacacaccaacaagacaggttcaaggatgaattaacaaaggttcagcagacttaaatgatattcagaagtcttgtggctaagtcaaattataaataaactcatgtgtgtggtgtagaactgtgtgtgtgtgttggttttgagagactgatagaaggaagaagtagatggagtattattttcttactcctgatgtgtctcccaggctggatgatgacaaagaacaaaggagaagttgtcaggctcagtcaaggagaagggaggagcgatatggtttaagtgtggaggaagagaattgaagggacatttgtgccactttacgcacccacagagctgtttgtgtaggtgggggctgggcagggagtgtcaccagagactttgacttctctgcctcagaacttcactcagtggggtgtctgtgtgcctcagattaatgtcagcctgctcagggagaagcaaatatgtgtcctctgagggataaggcacatatttcacataccctctgttctggatggagctgagctcaagggactgggtggagaggaggtcctcttctctcaaacatggcccttctttctcgcagccatacttttgctaatcccctctctctggaatagttttcttattcctttctccctcaattatcattttactccttttaaagtctacctggtcttcatagatgaacccagagcttatcttttctctgcagatttcttggtcacccaaatagtggtaatttttcttctgaacgcccctagcacttactgtccatatcacttctgtgtcatgtataacagaatagcagatggaggaagctcagtgtttttgtgtctcatatacataggcaacttccatattattgttctgtatgttatcttgtctccccaaatacagccccaatgtgtcaattcttaccatgtctgctacagttcctaggggattttgcagggggaaagaagtgagttgtcatgtaaatgaaataatggtgtaccttgactgaggatgtgagagaattttttgtgcatccctgggcacacagctgtcttagtctcttgtgcccctataacagagtacctgagactgagtaacttataaagaacagaaatttgtttctcgcagttctggagactgaatgtccaagatcaaagtactggtgggtttggtgtcccataccagctggttatctgtttccaagatggcatcttgtagctgcatcctccgttggtggaagtgatggaaggaaggtcaataaggccctacctagttccctccagcccttttataaggtcactaatcccattcatgagagctctgccctcatgacttaatcatctcctaaaggatccacctcttaatgctatcacaatggtgatgaagtttcaacatatgaatttgggggcacacattcaggccatagcagcagccttatatgggaactgacaatattgtctctaccggggctgtcctctatatagaaatataacaggagccacatgtataattttaccttttctactagccacattaaaaaagtagaaaaacaggtgaaataattttaatgtattttatttaacctagtatatcccaaacgtcattttaatacataatcaatgtacaaaaaaagtttttttttttttcgagatggagtctcgctctgttgctcaggctggagtgcagtggcacaatcttggctctctgaaacctctgcctcctgggttcaagcaattctccggctttagtctcctgagtagctgggattacaggagtgtgccaccacacccagctaattttttgtatttttagtagagacagggtttcaccattttggccaggcttgtcttgaactcctgacctcagatgatctgcctgcctcagcctcccaaagtgcagggattacaggcatgagccaccacacccgatccaatgtacaaaaatattaatgagatatgctactgtcctttattttatactaagtctttactaactgatgtgtattttacgcttacaggacactgcagctcagactagctgcacttcaagtgtttaatacttacatggggctagaagctgccatgttggagagaataggccctgcattcttgatccttagtctaacaggagcctcttagggatcttctgattattccaggaagaagcaagaaaggttacagggttgtgtttcatgtattaggaggcaaattaaagctttaagagaatagaaacagagaatttaccaatgaggtgcacttaacttttttctcccttagttttcttcccatattcacatttaccacagaaaggagaaacaggaaaaatttacaacagaaaggagaaactcaccaagtacttacgcaaatacaagtagcgcatgggatgcattctttttcttctgtcctgtgcacctgccttaccttttcccagggtgagtggatgatagcgtggcatctttgcaggaagagcttgtagagaagaaatggtgattccagccacctcagcctctgcttctgatagcctcttgctttgttcctgaagttaaataaccaaaatatatgcttataaagtggtgatgaaaaattacttcttggtcartaggtgtctctgatggcagcaaatccatgttgcatttgtctttttctcttaataaaggacttgatggactgtgacaagattggccacctattttagagtcattggaattaaattaagacatgcccacactacctaatttcataagggtggtgctggagggagaagaggatagtacatacagaaggaagagggtggcccaatatcgacatgttaatacccaggactaaaaacaaagtctctactgttataaaggccaggaaggatgttctctttctacccaggcaaacactgtccaaattttatccacaggaaaatcaaggctcagttattcattgtgtacagctgcagaaacaatagaaaatatagccccttggttatcagagcagcattatccaaataaaattatcaggctcaatgtagccttgactgaaatgtgtggaggtaacatgctgcttttgttcttctaaaacaatgtatgaaccatagtcgatttatttttcctagtcctggttctgttagtgcctgagtggccttgagcaaagcactgtctctgtggctcaacttctgaatttatgaaatgggtccaggaacacctttcacacctatatcccagcattatgatgtgaaaagcagcctaaaaattaagcgctacattgctatgaattgtaaagtgtggaaacatggaataaaatacctcttaagctccattgtttattatgaaaaacattttcagtagtaggaacagctgtgaatcaggcagcccaacttaattagagtcaaagaatgtgcgccttcagctgctttttattgatagtgtttgcacgtttacttcctgaatagcataaatagaggtggagtaggtttatgcagggaagaataagtacattggaacaacctagaagtggaatcttccttctgtaaacaatattctcaataccagatacaggcccctctgttgtagcaccgggagagtaggagacctctttttaaacctagaagtatatgcatgtggttaattatacatttacaaggtaaagaaagcatccatcaaggaaatacttggagcaatattggcccagcaaattcagcttttaaatataattcgtattggaacaactggcatctccttcagaaagaaaaataaggtggtcaaaatgttgattctctaacctaccatcttggatagggctggatgttaagtcactggctcttacaggtgatgtgggcagcacgtagactgggtgttttcgagtcaagcrcataaaaggctgcaggttttctcctggccacccggrgcactgcagtaggacggcacctctcctgaaataaagctaatttaggctcacctcagctcccccatgggttgggatatgtgtgtgtctgctcttgctaagtgccagatttataattttgttctcttatgctagtcctgcagcctcttctttccatccccaccccatgccagccaagcagaattggggggatggggagaggactctaaacagacagctccttagcctctcagaggcccctgggaagagccacaggataggcaagggtcaagggaataatagcttttccttcttcctgagaagccttctagaattcccctaaagaactaggggacgcaatgtgaatcaaatagagaagccttcctgacttcaggatgttagggatacacattttttgagggcggagactctcattgttcatttttttttttcctgtccagcaggttctcggtgtggtggttaaaatgacttccagcttgggccccagacatttctttggaagaatcttgctttaaaacctaaatttaagctaagccccatagaaagagcaaacgaaacttcaaagaactcaaaatagagcatgtaatttcatgtgttgtgaaggcttatgaggaaagtggctttagtcaggtgtcaacaccttctcagggttacaaggaataacctagtccagctgccattgcagatgtgggggcgcaggttgtgacaggtggcccctcaggtggggagggctgtcttagtgctagctggtctccacttgtctgttctgcttcccacttgagagtactgtgttcattcctcctttatggggtgttcccccatcatgtttttaagtgtcagaatgttgggcagagggttcttttctgcatcatcctataaagcaatcactaaatatatcgggctatgaagcacttttcctttaaaaaaaatttttttttctttagaaacggggtctttatgtaacaaacctgcacgttgtgcacatgtaccctagaactgaaagtataataaaaaaattaaaaaaagaaacggggttttgctctgtcaccaaggctggagtgcagtggctcaatcattaatcactgcagctttgacttcctggactcaagcagtcctcccacctcagcctccaaaagcactgggattacaggtggcctcatttctctctctctctctctttttgttattgttgttattgttgttgttgagacggggtctcactctgtcacccaggctggagtgcagtggcatgatcacgactcattgcagacctgacctgggctgaagggatcctcctgcctcagccttgtgagtagctgggactacaggtgtatgccaccatgcctggctatgcttttaattttttgaagcaacagagtcttcctgtgttgcccagtctggtctccagctcctaagcaatcctctgacttggcctcccaaagtgctgggaggtgtgagctatggtgtccagccttcttttttcaaaatcattttcatacctgctttccctataacacctcgaggtagggtgcgaatgggcacagaggsaagagagctgagcctatatccagagcccaggccagaacccaattctctggatgaccatgcttcttcggtaagtatatttttgtggaatatttggagctcttttgacacataaagatttactaaacaacatattcacatatggcaaaatattatctataaatagcttcaaaatgtctttgctttagttttaggttctgatttgctgtgrtgtagtgaggacagaatttttcttttgctgtattttaattgcaatagcgagtaaacaaaccttttytccccccttggttatacttttctttggtttccttggagttttccttggttacattgaaaaccacccagtatttgcatttgcatgggttagttcttaaagtcctaagtgggtcctagtgtttggaggttttgtagaaatcatatctttgtgtagtacaggccacacatggggagttgaatgtccatgtagtcattggagaagtggccagagttgggtgtcagagctgctgtttggacttggacagatcctgagtgtgtcatccttggccaggcactcattctgtacagccccccaggtgtggctctagggagagagcaggtatgcactgctgggtctgtcctgttctctgtagcttctggatgggaggaagggtgaccttttccaattgtattttatatatttgacatatttcaagtacattttaactttgagtcttaattttatttttttccacagctttagtaggaagattttcaatgacttcctcagcacatacaatttttctggttttaatttttgtaaaaacttgatccttgatgtttagattcacctttttctccccttaaaaatccagccaagggccaattaatgatagttgctatggtaactttggtgaaattcagaatgttcctaatgcaaagagcaatatgcttgaacagtagatttcatttaaaatgtagaagaagaatttgctttggtataaaggtgttcagctgaaccttcatgaagaaagttgccaaggactgaaagtgcaaaaggttatagtttgaaaagcttatcatgggaatttttagccatcttttaaataaataaatctcatttggttgcagcatgtttgccctgtacataaataaagcttagattttgtttgggtctccaaaacatggatttaaaattctgcccagttttatgtcccctcatcaaatgattttaccatgtattagattataatgttagtgatgtttctggcttatattaatatactgctttatgttgaaataaactcattttcatcctcaacacataaatttcatcaatttcagaccttaagcacggttatcaacctgttagatgcttctatttgactttgcttaaatagcgctgaaggcctgtcagatgactagggggaagtttttcctaaacaaattcaagttattttgccaattcagtgatttttttttaaaaaaggatttctttaataaaatgaatgttatcacacccttaaaagtgacaacacccatgtaaaagaagctgattgtatatctaaatatcataaaaaagatcattgaatttaaacttcttcagagttttgttttgttttgttttgtttgccactgtagccaccattacaagctcagttataagtaataagtgaactgtttctcatttattttcctttttatatctgtcctaggcacattttcttacctaggagtttactaatcatttaacctgaggactatctagaatatatgatgtttaatattttagtcacctgcatttatcataactgagcatttgatccatgccaaacactgttttaagcacaatagtgtttttttaatgtaatatataatagtgacattttwacacactttgattgctgtgtaaatgtttattggtatttctttctttctttttttttttttgagatggaggcttgctctgtcacccaggctggagtgcagtggcacaatctcagctcgctgcaacctccgcctcccaggttcaagcagttttcctgcctcaacctcctgagtagctgggattacaggtgcccaccaccacgcccagctaatttttggatttttagtcgagacagggtttcaccatgttggccaggctggtctcaaactcctgaccttgtgatctgcccaccttggcttcccaaagtgctgggattacaggcgtgagccaccgcgtctattggtactccatattgtcagtttgaatggggggatgtggatgcggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgctcaggcacatgtatgtgcttttttttatgcagcgaggttagagaatggggggcagggtcttttcctacatggggtaggggtgcattggccagacactgcatctgtctgttctccactctgtcctggcacagctcacctccagaacacagagcccaaagctgtcctgaagcagtgggtcagaaaacatgtttgaatactcagacacatggaatatgtccagtccttttcaaaattcaaaatggtagaaccatattgggaagccatgactggggacaaggaataagctttatcaggccctagtcagaaaggagtttagggctgactggagttgtaggacatgggagcctatcctcacatctggggatcaccccttgccgttcatgtgaccttgaatgatcactgagcctctcatctgtggttttcttggggaatgataccaagtcataggactgctgtgagcactggatgtaataatggatacaaaaactgttttagcagtgagcacagtttccttgggacttggtaactgatagctgtcaattcctaatcctcatttaaattattataaatgtgaggtgaagggaaggagaaattcttgttagtgagaaattagcttactctttggcatcaaagtgtgacatttgtctgtggtatctgttaatcaagttctattgatcaagctaaggtcagatccttctcttatagattaaatattctttttttaaaaaaattattggttgtttttttcttggttttcagtttataatgaatgcctatcttttaagattgacctaggggagcagtgtaggataaaatatcaagttccctgcgaaagattctgtgcttctgaataacaataaactacaaggtcaactttctagaataaaattcttctgatctaaaaacatatccatttggggaaaggtcagagaaactgagattcaataattcatcttttgagggttcatcttgtttatgcgagtcatttctttgaacagtttgatcaggttttgcttcagtaagggaggtacgaagatacaaggtacgtgttgcctcaaggagagaggttgtaggtttgccctttccctgtaatggccggactaatccaccagcttatattaggaagattagccatctgttagcttctaaaacagaggcaaaagtttctgctttcagattctcttggtgtgcgggcttgggaaggacagatgggagctaataaatatcataccttgaaaggccaagcacccggctgagttgtcctatccactgttaagtccagcccccacagcagtcctgtgatgtaggtgttgttcctcccttcaggtaggaggttcagtaatcattcagggtcacacgactggaaaaggctgaccccagatgtaaagccaggctcccmgctccttgttcttccactgtgttctaaactccttcccagcttgcgcttgacacagccttgtcttctctccctccgtgcctcgcagtggtagggttccatggaacacgcaggtgaacagtttgacctatggatgagccgatctggagagcctgcctggtgggagcaggttggtccctgcagtccagagtctgcacacagtccttccagtgagtgtctctggaggctgtatytcctgattacaactctatagttttgtctactagagctgacacctttgttttctgtcacttctcaggccaagaagtaactttttttaggaaaatatctttttccagtaaagatgtcctttcatctcgccaccccacccccatccctgacctcttctacrtgcagtcttttttgtttttgttgtttgtttgyttgttttttagatggagtctcgctctgtcccccaggctggagtgcagtggcacaatctcggctcattgcaacctccgcctcccaggttcaagcaattcttgtgcctcggcctcccaagtagctggggctacaggtgcacacctccatgccaggctaactcttttggatttttttagtagagatggggtttcaccattgttggccaggctggtctacaacacctgacctcacgtgatccgtccgccttggcctcccaaagtgctgggattacaggcgtgagtcaccatgtccagcccacatacacttttaaaaataatagtttatcttgataaaatctgaattaagctgttgtttttatgaggattgtttctgactcctgtttctcatttcccttttcacctcccctgtcagacacatacactccacgtccacaccacacatatgcacactgcggacttcaccactcacattcactttactttgttaatctggctgcaaggaaatttcttagcccttgacacrgtatgtgaagagagttctgttggcagctcaccatggtatttcaaatgtgtgcctcaaattgagagtgccggttggaaataacaattcactctaagcagtgcttttcattgaaatgtaaattgccttatacccgttttcattcttgcggacttctcaggaggaagacaggttttatgttacaagcattgaagagaaaatctttctcctggtatctctttttttagtatgcaacaagattgaggatgattcatttaggcaactctggtctactctaggagcttgcatatctaacaatatgcagtattctcaggaattttaccagtgtgggattsctggtactttgaggggagaaggataacttcatatctggatttaatttctgagttaataaaccgccatcaccctggaatgcccatttttatttgtttccttatccatttatgaactaccttaaggcatttatcaaatagtgacttaaatctaaaaataaaattaatgtcctttgtttggaatgcttttagagaccattaggacttaggagcagtgcagtggatgtggagagaatgaaagattcaacaataactayataaaaccctaaggtcccactcaagtggggcggcctggccaaaatgtagctcaaaacataatagtggctatgagaaaaaagctattttgttgtcattgttataacacccagcaaggaactgtataggttatagggccttttaaaatttttcagctggataccactttatttttattgtgactttcaaacacgaaaataccattatgttaaaaaaaaatactatggaatctgtgtggcagaatgtatttaagctgaacagattaaggctgtaggaccaaagggctgaacaaccttgagcatttttctttaaatattcaagtttaaaagcatattccttggcacccctaaaaggaaagcccagtaaaatgaatatgacatttagaatatgtagcattggagattttcatcttttttttttttttttttttgagtccttgggtttatcagctggaaactttcatggcattattgcatctttacatagtaataaatgtgtcataattgacatgtgctttaaaatgctctcacttcctctacttcctggaagattgtttctgtcttgcatgttgtccttgctgtgttttatgatgtgtttgtataaacatgatgaaactattcatgttcttgttgatgcttctctgaatggttagcactggctctctgggtgtgttttgtttgctaaaccttgaaaaagtcttagtagatggaatacagtggaaagattaggaagatgcctttttccctcatacttcctttaattaaataatrtgaaaatatactgatttaatagatgtttctgtgagttgtgctaaatagaattggtaacagtgttacagttttatagggctttttatctgtttgagaggtatgcaggatttcttttttattattattttttattttttgtagagataagatttcactatattttccaggctggtctcaaactcttgggctcaagtgatcctcccacctcggcctcccaaagtgctgggattacaggcgtgagccaccgcacctggccgatatgcaggatttcttgatgtttctcatcttcccataacttttctcttttcctgacatgtgcttttagcctctgatagccgtcagcaaatacctggctcctgttggttgttcagtcctctttttctcttctctcacatacctaccaccctccaggcaaagcaagtaccctgtggttctctgcctaatttatatgtctcggaacatgctgctcccctcaccttaaatgccctgcataactcacaagactcttaggacctttgagttgtaccttcatctccagaagttctccctggcatttgttctgcacctcccatggctccacatgcccagagttactgatttgtctcctctcgattctcctggaacacccagtccacctttttttttggtttgctcacctgccatctcccatgtcatagaaaggctgcagtgagacacagccctgttcatgaccttagtaataacatcataagcaggttatcagtaaatgttgatcaactgtatgaatctgctgaggttgtgaaaagggattcggagaagtttgagatgcatttggccccagtagttcttacctagggtggggaaatcaggcatgtacctgaggaaggttgctgtgctgctaggcagaggagttgtgaagtgaaacagagcacagcatgcacctgtggactgctttcaggccatgttctctggagtgtgaggtgccggacggctcaggcctcctgtccctggaaggcagagtgggagcaagcatcttgctggtagcggtcagaggctaaagggaaaggtagcactgggatattgccttaagatgaataggatttccataagctggggtgaaggaaygaggaggagcacaaggaaaagattagcattgagaaggagcaaggtatttgggcaaaaggttggagcagagatttcctgttctggaattagcagtgggagggaaggaagaaaggaatcccagaagccagttacggagagccttgattgctaggctaaagatatttgggtgttatcctgacgtacagaagagtgtgtgaaggttttgtaactttgaagaaatgggagcaaacagtctagtgatgaaagcagaggaatactgggcagagaaggagacttttgcagtagtctaggcagggagcatcctgacccaagacacagtccgctcttcactcatcctacaaagtgagtcccatgtgccaggccatggagagtctgtgatgagtagtgtcccttgaggagaaaggggcatgaaaacaaaatcaccttagttgtcacgtttctagtgagaagattccaacctgaaggaaaatccataggaggtgataaggatgctggttgactgatatgcgtaccagcatagtcacaggatgtgcagatcgtggattgcagatctgggctttgttcacagtgaaacaaacaatgctgcctgtgctgctctagtcacttaaccggacatctccctgatgctgtcaacttcagtcccttttaactggtctcctgctgcttcccttgtccccacttgctctgttctcaacatggcagccagggtgatccatttaaatcttaagtcagatcgcgtcacttctcttccccacactcacggtggctctcgtcgcacccagagtaaaagccaaagtcctcatgaagatccacagggccccgcccgcccctcaccacccctctggcctcatctcctgctcagcccagccactctgagcacactggcctccttgctgttcctctcacccctataaagctccccaaggcccctccttccctgtgtgtctccatgtctgatttctcacctctttgaagtctgctgaagtgtcactgaccaccctatttacaattgtaacctgtcccccagccctaaccctggcccttctgacccctctgaccctgtcctaccttttgttgtcatgactgattaccttctgccatgatgtgtcatttgctgttgtttcttgtcagatcctccacactgctccccccaccccgtaggtggctctttttttggaattaattaatttagtgattttttttctttttatttggtaggctctttaaggcaggaatcagcttctgttttgtttaacgatgtgtctcaaatgtctagaacagtgcctggtacaaagaagaagctcagtcaatatttgtcgaatgatttgtaatttatttgctcttactagtacggcctagttaacttttccccactaccaagtggattttgtttatgagaaagaaaggttgatcctgtcacagcctaaattccaaatatagttgccccttggtatcctcggggaattggctccaggagcccccacagatgctccagtccatgctataatgtgatgtagtatttgcatataacctatgcacatcttcccatatatgctagatcatctctagattatttataatacctaatgtaatgtaaatgttatgtaaatagttgttctactgtgttgttctttaaatttgtattttttttattgttgtcttgttagttttgatctgcagttggttgaatccacagatgcagaacccacagatacgaagggccaggtgtatattttacctgttatttgttttcttcaaatgacgtattttctctttgaaattcttagagcagagttctataaaatgggcacaataattagaaaagaaaatttgaaagcgacttttcaaataaaagaaatgtggcaaaagggttcagtcacatattagaaacgatttgtaatctgcaaggctaaagtggaggataaaaatgttgtaaccagaggataaggtccactggttctctggcttgcatggtctgggtgcattccacttattcctaacaacagtgacaagttctccatcattattatcttgggggaatttcagatacccccacaattgtacatgccctcagcattctgttgcctcttaattcgagaactaaacacacacagcacaaaatgctaaataaaagcacatgatagaatacaagatggaaaagaataattcctaaaaggaccacaccgcagaaggtttttagttttttgttgttgttgttttttgttttgttttgttttgttttgttttggtcttgtcacctagcctgtttttttcctgtgcacacatgcatcattgacatacacatatacactcaaccctccttgtccctacctcctccccattaaagaaagctgttgaagaagattcaggaaatcagaacagagaacgtcgacatgtgcaaacctttggataacttttaattagctagcctgccatcttataagtaactttcaaaagtgaattgggacctttttaaattcccagctggaaagtttccatttagactgtgagggtgttttcttttcattacataacccatttgtcagtggaggcagtatctccctgcaggaggtaaacattggttcttagaaggcaaaaataaataaataaatacataaatacataaattttaaaaaccctatttaaatgtataaagcacagatatacatacctatatataaaagatatacaataaatagatatacaatatatctatgttataaaaatatcctcagggtgagtacagtaatgaaaatggttgagaagcactggttgaacccacactcagaggcaccagcctagagcacaaacggtctgctctgcatgttcatgcttttacgtggtgtttgatagtttaacagtgagctgtgtccaagggcatgagcctgttaggtaggacatggacttatcatgatcaatttggtctattaggcactttttggttagagggacagaattgctcaggtgactcagttcctggagggcagagggaaggccttgctgggctgccagggaccagctggcaggagtagagtctgggaaggagaagggtgtttgaaatgagtataaccatcatccctctcctcacaggaccattgtggggtagtgtgttaattcattcttgagtcactataaagaaatacctgaggctgagtaatgtataaagaaaagaggtctaatggcctcatggttctgcaggcaatgcaggaagcacggtgcttgcatctgcttctggagagggcctcagggaacttacaatcatggcggaaggtgaagaggtagcctgtgtaccacatggcaggagagggagagagaagggggaggtcccagctcaaacaaccagatcttgcatgaactacctgggtgagaactcacttatcaccaaggggatggcacaaagccattcttgagggatctgcctccatcatccaatcacctcccaccaggccccacctccaacaccgggaatcacatttcaacatgagatttggagaggacagacatccaaaccgtatcaggtagtgttgaggttgttgaggtaagtgtatacaaagctcttagcacagagtgaagctcagtgaacaaatggctcttcttatgaagagcagccctcagcggaggcatggcacttccttcaagagaaccaaacttggaaaccttgaattaggaagtgattactcactttacagggaatgactacggtaatgatatatttgctttctgttacctaaacttagcagcttacatatttatcatctaatggtttctttagctcagaaatgtgggcatagctttatgggtcctctacttagggtctctcaaggctgccttaaagtgttgactgggactgggttctcatctgtaggctcagctagaaaggcatctggttccttgctcatgtggcggtcagcaacactgtatttcctggggttgaaggattcataggagcttgcacttgaaagccagcaagaaaggagagtgagaaagacaaagcacaagtctgccagtaagacagagtctcatatgatgcaaggtaatcacaagagtacagtctgtcccccttgccatctactgttgggtagaggcaaatcacaggttctgtctgtactcagggagaggggcctacacgaaggtgtgaacattgttgggggatcatgcggagggagtctgtttgctacaaatggtattcatattcacatgtgtttcaaacagtagaggaaaacgtaccaaatatttttctttctttctgtctctttctttctttctttctttctttcttttctttctttctttctttctttctttctttctttctttctttctttctctttctttctttctctttctttctttctttttcttttctttcatttattttttgagatagagtcttgctctgttgcccaggctgcagtgcagtggcacgatctcagctcactgcaacctctgcctcctgtgttcaagcgattctcctgtctctgcctcctgagtagctgggattacaggcacatgccaccacacccagctaatttttgtatttttagtagagacagggttttaccgtgttggtcaggctggtcttgaactcctgacctcatgatccacccacctcagcctctcaaagtgctgggattacaggcatgagccactgcgcccggcccaaatctttctattagcaaaacatttggttgataaaaatattggcttatattttaataatactgattggaaagcaagataaaggcactttgtgctgcctgatattaactgttaacagccactaatgctgccttctgcggtttggagtttattgaggacacagccctcttctttgaaaacgtggctgtctgatatcttccaaccaagggagcttttcaggacctcaaaacttcttgctttgtaaggaataattgaaatatccctgcaaaggtgattttaaaaaaatcttttctaaaatgtaaaactttcttttattatttgtgcaatgtttataataagtactcatttcagtgaagataaccattgctttgtttcactcagattcattgtcaagctttaaactttcatttgttttctaaattgaaaaaagccatttttggattgttcttacactggcattcttaaatgagaagtttggcacttcgtattctctactgggctccccctccttacactagcttggagttatgctcagtcagctctcctctgtatgggagaatgttgaggaacaatgctgagaattatatgggtattgcaaacgacaaagtgagagtgctgttggagattacgataccacaatgcaaaacaatttaatggtttggaggtacatttgtaagatgacaaggaaggatgattgaccacacccttaaccaagggttaagaggccctgaagaatatttggaacctttttttctgctgtacacaggtgtactggccaccacctatggcccttgaagtggggagaggttggtgttttggtgattagactttgaaatattttatgattccatgtactcagcatatcctaagtttctggctcactgaccaaacttagcaaggcattgttaagttatgggcttcttacagtttggaactcccggataaggaaaaaacaaacattctaactgtctcacaatagtaagagcaaaaagcctgtgcagtccccaccatggacattgtgattgtgcatgacatacatattcaaatttagaacggagagatgcttcagcattctcttggaccaattgtttttcagaatgcagggttgaataaacaagtatctacatatttccactcttctgaatgccacatatttgcataatgctggacttttcaatgtttttgtagttcttcttcattgaatgcatccaaattgtgggaatgtggcagatggtgttatatccatttgacagatgaggaaactgaggctcaataacttgacttgcctgaggtcatgtcacacttctgtagcagagacagaaacagagccaagccctcctcattccaaacctcaggcaggagctgtggtgaaaagcagggagtcggtttgcatcttggctctttcatatgccagcattgtgaccttgggctgttactgaacttcaaagcctcagttttctcctttgtgaaatagggagactcccttctcttagggtttttagggttaaatgaaaatttacaaccgtccctaaaccttgcaagcactcagtaaatggcagctactgatgtggtttatgttggttttggcatactgctatttgcacaactgggtgttagttgagcttacctggtgtatctccttaaggcccattggatctgagtatctggcattctaggcccataattcagaatcagtggaagagacaatgttgatacatctctgaggcttggttacctgggagctggcttgatgtctggggttctagatagtgcccccaacaggagagttgttacggggtgggatgaggggctttgcccgcaagaggatgaaaagaaaatagtagaaacaggagagtggcttttgggcaaactcttggatttgctgttcagacatattagcaattcgtttagtgaagaacagagcagggatgtgtgatgggcttccattactgtgacatcaaggatttgaattctgaccacctggcagggaatttgggttctaatttgccaccagtggagatagcacaattatgattgtcttaacacaagaagccgtctcccctaacctactctcaaaatctatctcaggtactaacgctgacacagatctgctgccataaacttggttgtcttttttgtgctggagagggtttcttctgaaatgtaagcacctgggctcactctttctgcccctctgtctttgaatcagacagcagctttacctcttggcctcttagcagatttattcttaagcaatattaaaagtattgttgcttcttgtccaaatctcctttccccattcagaaataaaacaactcccttaaaggggagagataccatcacctccctacttggggcctgagaggtgttgcagaaaataaaattctctgagctctttgggccaattgttccttagattttaataccttagcatgttgtctgtgcagttttttaargcatggcatcacacacatacccagcagcatttgatgaaaggctccagtttcaaggtaagatagtagtgtcaagctgtgcaaaatggttagtcggcctactaactcaactctggagcaagctgcttaacctttttaagctacctgtaaaatgagaataagaagagctgcctcacagaattgttaccaagagaataggctcacagtaagaactcaattgttaatttccttaaaaaaaaatcctgctggggcctggtggctcatgcctgtgatcccaacactttgggaggccaaggcaagaggattgcttgagcccaggagttcaagaccagcctgggaagcatagtgaaacctcatccctaaaaaaaaaagacaaaaattaactgggtgtggtggcatgcacttgtagtcccagctacctgggaggctgagtcaggaagattgcttgagcgtgggaggttgaggttgcagggagctgtgattacaccattgtactccaacctaggtgacagagagagaccctgtctcaacaaaatgaatgaatgaataaataaataaaatctattgaaagggggaaaaaaagcctcgaagaactttatttactttcttctgttgcatgctaccacttcctgaaagaatagacatttcccaatctcccaagtaattaaaaatgaatgcagatactgatttagagtggctgcatttgttcattggtagaggtagggacctaagaaacggagatgttcttcccatagctagactgtgtggctaagcatagcattgctataacttaaaatttttttcttatccattgtaaaaagcttataaaatatagaaatgcataaaaaataaattccatttacagccttactctatagaagtagtaagacattttggtgtctttgctctttctttttaacttagatttgtgtgtgaaatagatcatgtctacgaaagtgcatggaacatatatgtatgaattaaggaatactaaatatacgggtaccactttccaatttaagagctagcacattgctagtctctatgagccccttttgtgcctggctcttccatttattattatttttttctagaatcaagttagttctgtttatgtagttttatattgtgtttttgttcctactgtatcataagtatttttcaataatgtcatcattttaggttgctttcttatctttagagctcaaggtaattacagatcatagaatagcctttccggtaccgtgccttatatactcatttaattttacaacatgctgtgagctgcagcagctccccattttacagatgtgaaacctacatttcagaatgtttaggtaaattgccttgatgacagagtatgccaaaggactgagattagagtccamgtctgtgtttccaaaacccttgccatttctaccatggacaggctgactttatggggctgtatgttggaggcaccgtgtacatttaaggaattgaccattaaatgtgatgatgacgttatgggaacttgcttaatgataaagtaggaacaaaaacacagtccgaaactacataaacagaaatatagtatttctgcctaattctaaacaagaataacacatgactaagttctagtttttaagtggtactggtgccagaaaattccagatgaaggcaagcttccacaaggaatgtggaaaaacaaaaataatttcttgaccaggttcagtgactcatgcttgtaatcctagccctttgggaagctgaggtgggggggcatcacttgagctcagaagttcaagaacagcctgggcaacatagtaagaacccccggctctatttttaattttaaaagaatattaaaaataataaactataaaggaaaataactttttgagaatcggaacagtattgcatgctctgcttttatttgaagagtctatagtgttgggttgtctggtgttcccccttatcctcccttaattcccccaccttcctcccaccccataccactatgaagtgaagtctgaacttttatgttctaagcagccctcctgctgcattttctttttccttttcnnnnnnnnnnnnnnnnnnnnnnnnnnnnnnnnnnnnnnntttccttgagacagtttcactcttgtcacccaggctggagtgtaatggcacgatctcggctcactgcaacctccgcctcctgggttcaagtgattctcctgcctcagcctcccaagtagctgggattacaggcatgcaccaccacacctggctaattttgtgtttttcgtagaggcgggggtttcaccatgttggtccgggtggtctcgaactcctgacctcaggtgatccacccacctcggcctcccaaagtgctggtattacaggtgtgagccaccgctcctggcccctgctgcattttctacagttgtacagttgtgcatctgtgattgattgtgctacaacctgggaggaagccactctcctcctttgctttgcccatgaagacgtggccctgtaaagtctagaagaataaaatggttgctatggttgctgtggcagctacaatgccaagctgaaaagctgactagaaagtcgcctgcttatctttggaaagagaggggactccatttggcacagatacagttgctcattatattctgcaggtatagtcactgtggcatccttgggcacattctgcgaactcaaagatgtgtagagatttggaagatgaataaaaggctgtgtttgtttaggtggaagtatggctgttattaagtttagtgagatggtagtggttaacctcaccaaagtattcattaatataagcatcaccttcagctttgccacagtgttttttggggataggaaaattccctgcctgtgaccagtgaatagtaaaacactactgggattttttcaaatggccattaaatgccaacagccaccaccacttgctgagggacaataaaaggagtggaggaaggcagtcagtcactttgtgtatgtttgaattcttacactgtaggtgtccaacctaaatagtgctgtcattggttttagttcagttaatcatgcctgaattaaaatagatttttttaaaactgtgattgtgggaatagtgcaacataaaatagttttatgaggccctacttcatgtctaaagtgtaaaacaatttgtttcaaaagaagagaatttaaaaacattttctttatttttaatacagggtcttactctgttgcccaagctggagtccagtggtgcagtcatagcttgctgcagcctggaattcctgggctcaagtgatcctcccacctcagcctcccaagtagctgggactataggcatgcaccaccacagctggctatttttttttttttaattcttggtagagagagagggttctctttatgttgcccaggctagtcttgaactgccaggctcaagtgatcctccttgcttcagcctcccaaagtgctgtgattacaggcatgagacaccatgcccgacctccaaatattttcttatgataggttactcctggaagcaataaatatgatgtaaagctcagattgactttttaattatctttatttttaaattttgcttttaaatttccttttctttttcttttcttttcttttttttttttttttttgagacggagtttggtcttgttgcccaggctggagtgcaatggtgcgatctcagctaactgcaacctccccctcccgggttcaagcaattctcctgcctcagcctccygagtagctgggattacaggtgcctgccatcacacctggctaatttttcatatttttagtagagatggggtttcaccatgttggccaggctggtcacaaactcctgacttcaggcgatccacctgcctcagtgtcctaaagtgctgggattacaggcatcagccaccgctcctggctgctttttaattttctaattcatttatttttattgtggtatagattgagttttgttgtcataccttcctgtgtttgtggagtcttagaaaagaactctcaggttacttttttttaaaaattttatttattttttgatacagagtttcactcttctcacccaggctggagtgtagtggcatgatctcggctcactgcaatctccgcctcttgggttcaggtgattctcctgcctcagcctcccgagttagctgggatcacaggcatgcactaccatgcccagctaatttttgtatttttagtagagacagggtttcaccatgttggccaggctagtcttgaactcctgacctcaggtgatccacccacctcagcctcccaaagtgctgggattacaggtgtgagccaccgcacctgacctcagcttacttttcttttaggccagacagatattcatttgtggagtacagatattcttctgttggttggtgctgtttagcagtatctacctagaatcttgtgtctcacaagacttgaccagattgataggcacttttcaaatgccctgctaaagctgctgaatccctgaatgatcaaagctggcactgactttggcagcggccttgacttttagagcatagcgtgctaacaaagaggagcttgcttcctccaaacagtaatagggtaatgtccagggatcagtgagcgtgttcctttcacccagtactctgcaccttgcatctcttcagcctcctgccaccttctactgttcgacacctcttgtcctggtggtgagggagcaggcagagtctttggatacagctcagctaagtggcttcaaagtcaggcaggggaactggtagctgagcctccattgcctggggttatctacttgtaaggtttttctgccttcctaattcttattactactattttactgccactctccctccatttgtgttactctgtataaccaacacctaagtgcgaaagtcctgggcttcagtctgtaccttctctatatggtatagatggatgcaggtgagatttcctgccaactcccaaatgtgtagctccagcccaggccacttccgtgagccccagatctgtgtgtgtgattgcaaactcaacattctccgccactgtgtactatttcaaactttaaatgtttaaatccaaactcattattttgtaaccctccctcctacctataagccttcccccgacaacaaaataacatatttggtctctttcacgtccttatcatgtgaaggacgctctcatccacttaactttgcaagctgggagttaataccgtaatctcttgctttccctctgtattcagtacattttatcagtttagattcttaaatctctgtccttaggcccagcatgatctagccctggcctcactcactagcctgatttccagctgtccctctctgccctgcttaggtggaccctcctccccttagaggccttacaccagcccccacttgctgaaatccaccccacctccccactgcccaccatcctcctgatttcatgttcaaaggtcatgtcctctggggaggcttcccttgatgctcaaatgaggtcagtgtctaggggggtaagctcttgtggcctgtatggcaccctcactagagtcttaagtcccacagcaataagggctttgtctttgcttacagtatatgctcagtgcctagggcagacccctcaccaggtgagcatttgacagatatttgtctagtgaaggaatgagcggatgaatgaatgagtgaatgaatgtcaggcactgtgccaagcaatttgtacacatctcatttaatccaggaaaccgtcgaaactgcaaatctcaactggggagtcaacccagagctgagccaacacccaagcccaggctctttctgctgctaccactggcttccttgagggagagacagttgctgctatttgattttactgataaaaatctgtgatgctacagggagaatggagcaggacttcttctagtagagaaattagggagacattgaagagacttgcattttaccgatgctaatttccttagggtcatttctttaagaaaaaaaaaatcctcttaagtaacaagcttggggagctgtagagctagatcagagattttgctgccaacctctaagtaacattccaagtccactttccactgcttcctgaggaggcctgtcagagttttgcaggtgtattcctgatctcctggcttggagctcttattcagtctgcttcagctcttcctctctactmttttggttcttgtctctttagaccatatttattcattcaagaaacttttactkagcacccattatgttctaggcactacgctggttgcccacctttattcctgttcctggtaagcatctccttaccattgcccctctgctcagcaacccccacacttttacaggaactatcattcattacgtaatgaggtcttgaacttatgatttaagttcaacattaattagacactttctgtgtagcagatactgtgctaggtttggaagtttaagaagagacacaccctgtgccttgaaatctgtttacactaccatcaaccacacaagaatgggcagatgaactagtgtgaagtcaggaagtatccatagttttctgtgatccacaaaagcactacagattttcaaacccctggacagctctgaggacttgatccattcgtaggtcaaacattgtacagaaagtaacccgagagagctacttgagggcaggacgaaggactgggctatttcccctctctctatcaccttcctcaccctcattctcataccctatctaagtactagttcttgccagtaagcttcttgcttccaatgtgtgaaaatgtaagcacttaatgggcaattcctaagtactactatctttttccctgaaagcagtggcatgaacttatctcaaagtttggaagttaatgggaaaaatattgaccaataggcacaaatctatgcatcttatttggatttgacataacagttaagacaactggactccaaaatagacagtaacagtgatctccagaatcaaaagtgaaaaggaaatattagagcatctacttttctaacttattgtctcaagaatttcttttttgctttatacaaaaatgtacataatattctggaactaacaagtgattatagcaagattgcaatgtaaagatgaatacataagtaaatcacattcctatatattagcaatgaacaagtagaatttgaaatgaaaacacaacacacttacatcaacacccccaaaaatgaaatactcaggtataagtctaacaaaacatgtacaagatctatgtgaggaaaactgcaaaactctgaaagaaataaaagaggaactataaatgcatgaagagatatttcatgttcacagataggaaccctccatgttgtcaagataccagttcttcccaacttgatctataggtccaaagcagtgccaatcaaaatcccagcaaataactctggatattgacaaactgactctaaagtttatagatagaggcaaagaccccgaatagccaatacaatattgaaggagaagaacaaagttggagaactgttgctatctaactttaagacttattataaatctacagcaatcaagacagtgtggtattggtgaaagaacagacaaatagatcartggaacagaatagggatctcagaaatagacctacttaaatatagtcaactgatctttgacaaaggagcaaaggtgtgatacaaggcagaaaagataatttttttcaacgaatggtgctgaaacaactggaatccacatgcacaaaaatgaacccagacacagaccttacaaccttcacaaaaattaacataaaatgaacaagacctgaatgtaaaacacaaaactctaaaactcctagatattgtacatgttttgttagatttataatagaaaatctattatacatgactgtaggtttggcattgacgttatrtacaataccaaagacatgatctgtgaaagaaagaatcgataaactggacttaaattaaaattaaaaatttccgttctgtgaaaggccatgtcaagagaatgaaaagacaggccacagactgagagaaaatatttgcaaaaaagatatatctgataaaagactgtttttcaaaatatacaaataattcttaaaactaaacaataagaaaacaatctgattaaaaattgggccaatgggccaggcacggtggctcacgcctgtaattccagcactttgggaggctgaggcaggcggatcataaggtcaggagttcaagatcaacctgaccaacatggtgaaacccatctctactaaagatacaaaaattagctgggcgtggtgacacgcgcctgtagtcctagctactcaggaagctgaagcagaagaattgctcgaacctgggaggttgcagtgagccaagatcgcgccactgtactccagcctaggtgatagagcgtgagactccttctcaaaaaaaaaaaaaaaaaaaaaaaatgggccaaagatatgaacaggggctgggtgcagtggctcacacctgtaatcccagcactttgggaggctgaggcaggtggatcacttgaggtcaggagttcaagagcagcctgggcaacatggcaaaaccccatctcaactaaaaaaaaatacaaaaattagctgggcatggtggcacatgactataatcccagctactcgggaggctgaggcatgagaattgctggaacccaggagagccgagatctcgccactgcactccagcctgggtgacagagccagactcccatctaaaaaaataaaaaagatatgaatggatacctcaccaaagaagatatacagatatacagatggcaaataagtatatgaaaagatgctcaatatcatatgccattagggaattacaaattaaaacagcaatgagatatcactatatacgtcttagaatggcctttatgatgggctggtacagagggtggcttccagaacccctctgaaaaccaaagatcaagtattagaatttaataaagatcagrcccggtttggtggctcacccccataatcccagcactttgggaggcggaggcaagagaattgcttgagcccaggtgtttgaaaccagcctgggcaacatagtgagaccctgtctctggttttttttttgttttgttttgtttttttttttttaaagatcacgtgagaggcatacaaattcataggaaaaaatacgaaatggacaaagaacaggagtagccaattcacaaaaaagtaaaactaaaagcttccagcatgctcagttccacaaaatgacaaaaccatgcggtcccttttttctacctgttaatttagtaaaagcacaaatgcaagcatgcatacagcccctacatgtaccctctgttttaagtatcctgatcctctcggggaaataggtgtaccatgtaccatgctgatgacagtgtgctctgggggagcctttttggtaaacagtttggctgtatatatatgtgtgtgtgtgtgtgtgtgtgtgtgtgtatgtatgtatgtgtgtgcatgcttgcgtgtgtgtgtatatatatatttcatactttaatgtctgtctttaaactctgcttaagaaaaccatctcaagtgcagtaaatgccacatgtttatcatgacaccacttagtatagtgaagaatgggaaatcttaatctagccagccaatgggagtgttaggcagacttcacaaatgatgtgtagaaagactgaatartaacactgaacaatgtttatgatcgtattgttgagtgagaaaagcaagactcaattgtaccttataaactctctcttttatagtacttgccaatttgttttttgtttgcaattccttgtcctttttttttttttgagacagagtctcactctgttgcccaggctggagtgtagtggtgcagtctcggctcactgcaagctccgcctcccggtttcacgccattcttctgcctcagcctcccgagtagactacaggtgcctgccaccatgcccggctaatttttttttgtatttttagtagagatggggtttcaccatgttagccaggatggcctcaatctcttgacctcgtgatcctcctgccttggcctcccaaagtgctgggattacaggtgtgagccactgtgcccagattccttgtcctttttaaactgtctttatgtctagacttgggagtatcctgagggcagagatgggtcataggacagaacatgagaaaagtatccgtagtacttttacccttagtagatagtcaccctcctggacctaagggtgtacctgtgggcagaatgaataataaaactttcttcccacccaacatttcctaagagctgctaatagttttccatatcttaaaattatgggaaacaatatttagagagctccttttcacactgaatagatttaaatgattaattttctttcttttttttttttttttggttggtttttagttttttgagatagtctcactctgtcacccaggctggagtacagcagctcaatctcagctcactgtgaactccgcctcctggattcaagttattctcctgcctcggcctcctgagtagctgggattacaggcacccgccaccatgcccggctaatttttgtatttttggtagagatggagttttgccatgttggccaggctggtctcgaactcctgacctcagatgatccacccgcctcagcctcccaaaatgctggaattataggcatgagctactgtgcctggtcttaatttttatttttaaccttgttgaatgttattggatcattaagaaggttttccaatatagtattagcaactgcaataaagatgtgtctttcttgggggatgcagtgatgacggtgcagggcccatacaggcaggggtggcgcctgagggtcccgggccaggcagcagcacacaggtggcaggatccactcaggctgcatctcccgtggtgctcatctggctgctgccatctgtgctggaccccgccaaggtatagagtctcatggacacgatctggaaggacccagacagtgtgccatygatgtcctctagatcagaggggcccagggaggtgactacttctactcctttggggactgccaccgctaaacagcctagcagcagctgcagccagactgccaagcttgtccatttcaccctctcggacctaagggtgtacctgggggcacccacaccagacttgcagtaaccacctccttggcacctgcccccacctccaagagcccagaagacacacctggcctccagcaggctgggccttccagaagggatagcagggatgcattctctttgcacctgtggggagggtctcactctgggcacccctctcaccagctgcaaggccttggactcatgctgaacagtgtgggagcctcagttccaacatctatgacagttggatcatggccttacccatgaagcattattgagagaatgaaaggagaacagagatgggcttgcagagccacatgctgctggctccacattcccaggaacaaggatcctactgcatttttgtctttatataaccctattatatggactacattctgccataaggaaaggaaaaccttggwtgcgatggtttaaacaaacaagtttgtttttccacatagcatgaattccagagatgggtggctaatggtattggttcaacagctgtgtgatggtaggggtcacatctccgagatccttttgccttgccctcatttgcttgttacttcatggtcacaagatggctgccatgtctccaagaatcatgtctgtgatcaaggacaaaaggagtgggggaagaagaagggccaagctcgctggacctgtcaacttctatcaaaaagtaaaacttctgtcagaaacctgtttcctgctctctcctcctgcagattttcacttaggtgcccttggcctgagctagctaccactgcacctgtagctgtgaagaaagttaagacagtagggaacagagttgtattggttgagtagaccagtcatgttccatctactgagactggcacactgcctcctgaaataaaactggaatcccatttaaacaaaaaaaggaagtgtctttcttaaatgagtttttttttgttttgttttgttttgttttttttttttgagacggagtctcgctctgtcgcccaggctggagtgcagtggcgcgatctcggctcactgcaagctctgcctcccgggttcacaccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttaaatgagttttatacagacaaktggcatatagtcctttcatcagtatccttaggtcaagattatattacattgcagattgtctccagggtactttggagatggattctaattcttattctcatattgcagtaacagggaaactgagagataggggtgtgtcagagtttgaaagacaaactatttgaagacagaaactctagtggagcttgattattagccaaaatacagaatttactattaaagaagagggtccagaatcctatcccaagaagttacttgggcatccaaaaacagatcgtaagacacattgaaagtgtggaactcagactttgtataaggcttttgtatcttgagaaggaaaatttaaaaccttaggaggattgggagcttcacgagttcatgatccttctctgcaccaagtttacacgtgctaacctttctgctttagtagctaaacttttgattccatgaaatcaaaaccttttaattgctttctctattggtgatctttaagagataacttgggcttattggtgtcagtctgtaaagaaaccaaactctgaagtgtgatactatctattgaattagacaggggaaaagctaattagtactatagtgagactggagtgcttctcagatgttacctagtggcaactgaggatgtggaagtttacagatttttagacagtctatcaaattacaattttcagaaaaaagtatttccaatgactgcaatgttttgcctctatcaactatatactatgtatgagtttttagaaatgttacttttggggctgggcgcggtggctcacgcctgtaatcccagcactttgggaggccgaggcannnnnnnnnnnnnnnnnnnncctggccaacatggcaaaaccccatctctaccaaaaatacaaaaatttgctgggcatgatggcgcacgcctgtaatcccagctactcaggaggctgaggcaggagaatcgcttgaacctagtaggtggaggttgcagtgagccgagattgtgccactgcactccagcctgggtgacagagtcagagtctgtctgaaaaagaaaaaaaaaaaagaaaaaagaaaagaaatgttacttttgcactttcgtggccttggctagttttaaatgctttttcattggtagaaggcttacagagatcatgaaacattaatagttaccatttattgtgtactctttctgtgccaagtactgtgctaaatattttaggcatattatcacagtcagtccttacagcactcctttgaggaacatggcattttccccaaaatacatttttaagaacccttgagatttcaaagatcaagaccagagcaggaagggaaagctctgggtctgaaccaggtctgtctgccaccaaaacamcactcttgatagggatgatgatctggaacagtggtaaaatctggcataattcaaacacttaaactagtttgcgtatatgtataaaattcctagaattccttataaaacacacttatgacattgaagttcagtaacttcccatgttccatataagccacagaaatattgatttgccacagtgaaagagttagtggaagctattgggccatccaaaagaagctaaggctgaaaaggctacatatggtatgattccaagtacatgacatcgtggaaaaggcaaaactacagagagtaaaaggatcagtggttgccaagggctaaggggagggagggatgaataggtggagcatggaggatttttaggaatgtgaaactattctggatgatactgtcatagtggattatacattcrtcaaaatacagaatgtgcaacaccaacagtgagccatcacatgaactatggrttatagttattaataacatatggatattggctcatccattgtaacaaatgctccacactaatgtaagacattaatgggcataggtgaggggctatayggaaatcctgtacttttcytttaattttcctgtaaacctaaaactgctcaaaagtctatttgttgccttttttttttttttttttttttttgagacggagtcttgctctgtcacccagggtggagtgcagtggcatgatgatctcagcttactgcaacctctgcttcctgggttcaagtgattctcctgcctcagcttcccgagtagatgggattacaggcacccatcaacacaaccggctaatttttgtatttttaatacagacggggtttcaccatgttggcctggctggtcttgaactcctgacctcaagtgatctactcaccttggccttccagagtgctaggattacaggcaggattcccttcatttttaaaattactgaccccaggccacaagacatcaatcatggtaaaaattccactgtccttgatggcacacttgatattttgctagctctgtggatgagcktttccttatctgttttctctctcccattccagctgccagcatgctagctgcttacgtttggtctacccactcccagcctgtcctacctcctgccatcagattaatcttcctgaaatggagtcctgagtctatcattcccctggggaaaaacctttgttcatgctactctccctcctcggtttctccatcacctgcatcacgtggtctgtcctctctgaaatctcgttagaagcagtcattgaaatcagaagtgacctctatcatagtatgttgtttgtagcttgttgacatttgttcagacactcttgcattaaacatcacgttgtacttgcctccccctccccctcagttggactgtaggttacctgatggttaagactaagactgttttccctccaccttggtttttgaatcacctggagtgcttttaatacagtgggtccttgaaaaatgcattcagctgaattcagtgtgtctgtgttctcagtctatccagagctctgctattaggtgaaatggaagagaaactcattgcctatatgactgttattgtgacgtacagtgcaatagctgatatgtttctgacattagaatgctctcatttattggtatttgatcactggcatattatatttgggatttgtagccctactttgactgctctactatgtattgaatgaagagtttagattggtattaatatgttttaaccagtacattttaaaccagtcaaacatctaaccacatgcaaaagaagggcacgtacttatcatgcttcttcacatgcttaccatgcttgttacatgacaaagggttgcctttacctatttttccttttagaagattgaaaatatttaaatgatgctgttgttttgatcactgttttacattctttgaagattgaggaatctggtgactattttatcaagcgatttttctcctggagttttcttttttaaccttttgtggcttaattccagtaaaagattttcaagtaagtgaaaatgagttgcatatatccattaagtctttttctttatcttaagtaaaaggggagatgaagtagaaatatttagcaactcagttattgcctctagcatttaagagttcagcttgaagaaaagtagttgacttgaaagaatatgacttaaggacagaggtgagaaggagataaagaagtgcatctataggaacaaatttgtttcttatttgctttaaaaattgtttaagtaaagcacatttcaccaagttgaatttcagcttgagagatgtccagatgtgaaacggcaaaactccaaatactgcatatactgtgcttttagaaaaataaagtagtttttttgttttgttttctttttattctttaaaaatgaaggtcaagaaaaatatcagcaggaaagtcagaagtggatttagatatataaatgtcctcattgaggaacaaggggggatctttttttttttttttttttttttgaggtagagtcttactctgttacccaggctggagtgcaatggcgagatcatggctcactgcagccttgacctcccaggctcaagcaattgttccacttcagcctcttgagtagctgggactatgcgtgtgccaccatgcctggataatgtttgtgttttttacagagacggggttttgccatgttgtccaggctgtctagaactccagggcttaagcaatcctcccgcctcagcctcccagagttctgagattacaggcatgagctactacacccagccagggatgatctttttaaaaggaagtatagtttaataataatatgcagaaaataggcttaagattttagttgactataaacttaatataaatctataatgtaatgtggttgcccgaaccattcttaaaatattaggttgtttcagtatgttttactgttttgaggaaagataagcatcctattaagatttcaggtggacatactttttaagcttttgtatttgtttcacttataaaaatcatcaagctataacaaaacttaagtcaacttgtgatgtttgccttccaacagtagctgatggcatatttttttcaagttcatactggattatagttgaattaaaagttatttcttaattctccaggataatagaaacattaattgttcagagaaactccaaatataaggaactttagagaaaagatgtgtttgagtatgtgcgtgtgttgggggagggggttgccggaatacatgatggaaacttgtctaaagaattctagtgctttaactagagcagaaaatagagcagaaaatagccacagatgttaactgayggttgaacatgtgtgaattggatctttgaaaatttacacatggattttctttgcaagttatgtgcttcacagagaagaaaggtatatgttcccttttgcatgtctgcttgctttccaaagactagctgytatcttaacttaaaaaattttatttttcatgccagaaaacattgtattttaaaaattgataaagacactccatttgtaagtacttgttttaaagtaatatatctagaaggcaagatagtggccccctttcctgtcaatgtggagttccaaagcagctgaaggtagaaattaacagtcggtaagagagctatcaaaagaaaaccaggagccagagaccaactactggtagtcagtagtaattctgattgtctactcaatctgccaaggaaaactaaatacattttttcccctgagtcaggttaacacttaaagtataaaaggaagtacattcaggatctcatatgccatagttcaaaatatttttttactttatatatcatcagatacatacgtgcacacacatgtaaatatgcatcatccatgggatgtgatctcagggagataagtaccaactcatatattccttttaaacccactcaccattgccccaatttttgttccttctaactgcattcaactcttcaattcataatcatacagattcatgcaaataacagtaacgtgtttacctggttttacattctaatgttctatttctagaactgcttaaaatgttaagtagcacgcattcctgtagtcttagttactcatgagtctgagttgggaggatcgcttgaggttgagggctgcagtgagctgtgaatgtgccactgcacannnnnnnnnnnnnnnnnnnntcttgtaagttcaccagaggagttgggaattgggaagagagttgggtagcaacaactagaagttagatccatcgcatacgagtatgcgattgttgaattacatccttacctggaaaatgagctgttgtaagggttaaatgaaaacctatctaaagcacctattttagagtaggaactcactaagatggtagggctgctgcttttataaggggactgtattagtccattttcacgctgccgataaagacatacctgagactgggcaatttacgaaataaagacgtttattttattttatttattttttgagacaagagtcttgctctatcacccaggctggagtgcagtggcatgatctcagctcactgcaacctccgcctcctgggttcaagagattcttctgyctcagcctcccaagtagttgggaccaccaggcacgcaccaccatgcccaggtaatttttctgtatttttttagtagagacggggtttcaccatgttggccgggctggtctcaaactcctgaccttaggtgatctgctcacctyggcctcccaaagtgctggaattacaggtgtgagccaccacacccggcccaagaaagatatttaattggacttacagttccatgtggctggggaagcctcaagatcattgcagacggcaaggaggagcaagtcacattttacatggatggcagcaggcaaaaatagagagcttgtgcaggagaactcctctttttaaaaccatcagatctcrtgagacttattcattatcatgagaacagcacaggaaagacttgcccccatgattcaattacctccaaccagcccctcccacaacacgtgggaattcaagataagatttgggtggggacacagccaaaccatatcagggacataagtggaagaagggatataaatagagtttaggatttcaactttgatgtatgtaagtaatggcggttcttctgggtgctgcttggcagtaattgaacggaggttatttgcccaaagtttctttgaatttatcagctatttaccaaacactattgatggagttgacaggaccacaaaaaagactcacagcattttcatctgattcctagttttcaggagaaaaattaaagttctttgggagaactttaaaatgttacatttaaatatagttaataaaaaatggcttttgggtccagtgttaacgttagtaaattaatgtgattgagtttcaagtttttggcttgtgcatgcttaaaactttgtgagtcaagaaattcctattataaatttattatcttaaaaataagatctgctcccataccagagaagatgagacaatgagtctaccatcctaacaaacccaacacagatatgtttcaaatctktttccatctctttttattatttttttaagtttacatacatgaattcattttttggtgtaaaattgcacaagttttaacttatatattcctgtaatcaccaccaccacactaaggatactaaactgctacattattcctaaaagtagcccttgtgctacttctcagtaattaagcacaaccttcctctactccaaacccttggcaactactgatctatggttttactttttccagaatatcacatgaatggattcataaagcatgtaatcttttaagactggcagcctttattcaacgtagtgcatttgagatttatccatgttgtgtgtaatgatatgttcctttttattgctggatagtattgccttggagagagataccacagtttgtttggaggacatgtgggatgttttcagttattgctgattatgaatagagctgtcatagacattcgtatacagagttttgtgtgaatatagttttttatttctatgggataagtatctagcagtactgggtcatatggaagatgtatggttaactttataataaatgaacaaaccattttccaggatggccgtgccattttgcattcgtgccagcaatatatgtgagttctatttttttctgcaacttcctcacacttgatattaagctttttgttttagccattctaacagatatgtggtagtatctcagtgtagtttattgttttgcatttttctaatggctgattattttagctatttaaactcctttgacatttcatatagaagttttatttgctcatttggtaaactatctgctcaactcttttgcccattctttaaaattcggctttcttattgttgagttctgtgagttcttcgtatatttggattcaagttctttgttggatatataaaaagcaagtattttcttttagtgtgtagcttgtctttttactcttatcagaatctttcaaagagcaaaagtctttaatttcaataaagtccaatttatctttttttttttcattaatggtttgtgcttttggtgtcatatctaaaaactctttgcctaatccaaagccacagagattccctgggtgtttttttttcccaagagttttatgttttacatgtaggtctgtaacaatttcgggttaatttttatataagatgtaaggtataagttaaggggggttttttgcctgtggatttttaattatctcagcaccacttgttgaaaagactactccttctccattgaattgcctttatacctttgtcaaaaaccagttgaccatatttagtagagacggggtttctccatgttggtcaggctggtctcgaactcccgacctcaggagatctgcccgcctcagccttccaaagtgctgggattacaagcgtgagccaccgcgcctggcgcattatagtaagtcttaaaactgggtagtatgagtactctaacttttgttttttcaaaattattttagctatttaaattcctttgccattttcatgtataaagtttattattggcttgtctatcccttgaaaaaattctgctaggattttgattggaattgcattaaatctatagatcactttgagaagtgacaactgtgttagatcttcaagtccatgaacatcataggtctctcctctttttttttttttttttttttgaaacggagtctcactctgtcacgcaggctggagtgcagtgagtggcacgatctcggctcactgccgactccgcctcccaggttcaagcgattttcyttcgtcagcctcccgagtggatgggattacaggcacacgccaccatgcccggctaattttttgtatttttagtagaggcgaggtttcaccatgctggccaggctggtctcaaattccttacctcatgttccacccgcctcagcctcccaaagtactgggattacaggcatgtgccaccacgcccggcctaggtctctccttttatctagattgtctctgacttctttcatcagtgttttatagtttttatctctctttaaagttgaagaatccattgattctgatgtttgggggttttttgtttgttttttttacctttcttcctaacagaaatgttttcagaatctgatttaagtttcttttactgcagtaggtacactagaaaacataattatttgtccagatctccatcttatttagtgttggacccaggccctcaatgacagaaggtcccctttaatagggcagtgactatgtgtaccaattccacgggtctagccagcttttcataagtgacaacagaccagagagcatacttacgtcactatttcctatttctctcatctttattttcagttacagtttctgtctttggggaaaagcaggcaaaatctaatttgtaatggatagaactagctgtccacttaaacaatagaaaactgagtcataaattctgtctttataaaactcctccatacttttggaaaatgactcacttttaggcagcgtctgccatagatatttgccagaaagtgatctaacttggataagcttgatgctttgtacaagtttcagagcccctgtagagaaagctcttaggaaccagagaccatcgtgtgcctgtctgtgtcccgtgactttcagtccatcaacacacgtcactgtagcattttggaatgttctggttcagttgctctcagatgttagctacttcagaaccacctggagggcttgttagaacacagatgattgtgtaccactcccagaatttctggttctatagatctgggataggtctgagaatttacattttgaataagttccaggcattactgaggctgctagtttggggcctgcttggagatcaattcctctaatttactgtgtttgtgtcattcaaaagaattgataattaaaaaaaaaaatgcaaccaacagaatctctataaaatcatatatgtttacaattaaatcattcttacaagtaatgagatggtatggatttgttactcaagttattggatggaaacagaaacttctccactaaggagccctgtccatagctgatgtgagagagaaaacaaagctgggccacattgctttctgccttcttcttttatgtaaccaggagggagcatatccctagaatttttttttttttttctaaaggcggagtgtttctctgtcgcccagtctggagtacagtggcgcaatctcggctcactgcaacctctgcctcccaagttcaaccaattcttctacctcagcctcctgagtagctgggattataggtgcctgccatcatgccctgctaatttttgtatttttagtagagatggagtttcgccatgttggccaggctggtcttgaactccagacctcaagtgatccacccacctcggcctcccaaagtgctgggattatgggcatgagccaccgcgcctggccatttaacagcttaaggttgggtctcaagtcctatttcttacctcaaggaaatgtacgatgtttatatttatttctttcatttaggcatgctaaattctgtatattgacagcagacttaacttgaatgcagaaaggagaattcagcagcactcaaaatgaatttacaacgtgacagtgtatgattcattctaaaatgcttaccattgactaaaagctttactcctatgtaccttgatagagcagagatagtatggtagagtagaaagatcaatcattaaccaaggaaatctgttctgtgtgccttggacactcaatacaagggccttggaagccacttactttgaatatcactttagtcaggaaattgaggagtttttggaatcgatctttttaagtttctttttggccttgagattttatgtttttatgtttctatttatttctgcctaagtaaatgaccccgttttctttcttaccaccatccatccccattacaaattacatgcctttttgtaaaagatsttaacctcagaaggagaggaaatgcaatcagcaaactcacaaattttctttcagtcttaattttcttttgcctttttttttttttttttttttctgtgaggcaaggtctcactctgctgcccaggctggaatgcagtggtgtgatcatggcttactgcagcctcaacctcccatgctcaagtgattctcccagttcagcctcccaagtaactgggaccaaaggcaggcaccaccacactctgctaatttaaaaaaaaaaaattttgtaagggggagagtctctctatgctgctggggctgttcttgaactcctaggctcaagcgatcctccctcttggcttcctaaattgctgggattacagccattgaaccaccacgaccagccttaattttcactgggaaagattattgaactgtatgctgtgttcattagcaatctcgccatatcaaatttttgctacctgggttgaaacagggaatttgcatgtctttctaaaatgcatgcrtttttgtctgcagatgtcaaataggcaaggcacagctgaataagacatggaaatgtagcttgttacaagtatagtgtgtggaggaatttctaatctctttctgtccaatcagctatgcagtaagagctcagttttcatcctctagccctgaatagaatgggggcatcatcagcaatctattctggagcatacatttttaaagtgctttgaagagaaaaattttcatctactaagtagtgaagaactcctgattaataatcgcatttcttttaatttgtttaaattgagatgattaggagaaaacaaagatgggggaaagattcaggattttagagagttattacatcctgattcgggtgattatccgtactctccacctcggacacactgtgagctttatttacgtacattttgaggcagacaagattagctagatcccaggtgtccattaccctgtgaccttttaccaatacaggtaagaaatcttaaactcaagcagaaacctgtacacagctgatctctttaggagtctataaatctggggcatgtgctgtgagatgtgtgcaagccttgttgggtcactctctgttaggagaaggccccccagttaaggcaaaggacaacccaacctattcccaaattgacctgtgtagcagaatcagctttggtcttaataatgcaaggaatcaaagagcctttggtgttgaatgaagtatgctataccttagccagaagcctcacttctgacctgtgcttgatatcctgtgtattgtgacttgattatccatacatttgacttttcaagactccctgaggctgggataattagaatagcctggtaaagccatttaagagttttttaaataacaatttagggactgtagtagggttcctgttgccactgttctccaacagcacccagcatttgagaatcagttagtaccgatccgatccagtgatatataagcaaaaattctgattgtgggaaaacagaagagaaggcagtgttggctgttcaagccacatgtctaggcataaatggggaggccatgatttctcactgcttttgacatgaaaccacaaagaatgtctttgttaagaatcaaaaaacataagagttgaacaagccaaaggaagaaatgatatcatggcctagttgaatcaactaagaaatatttttatgttaaagaaattctttaaccttataactagggcattcacattcttgagtatattgagtggaagattcctctgaaaagaaagttcacatcaatagcctttgaaagatttagggaatattttgcagtgtaagattcrttatttaaaatctgaaatatatttttccttcctacgactcttctatgtgtttatagtaacatcaagacaatgacatcctgcaattgcactagaatgtattacaaatgcatgccttgtgccaatgtattcaacaaggaagctatctttttcctctgtcttattttcattgaggaaacccatgcctatgcattatgcatgcgagtctggtgtggtgtttaagtaacctcccatgggactgccgtgagactgctgtgagtctggatttgggggagagctgtgtcttggcattttcaaatataagagaaggatgttacctgatactcagagaatcttggctgaagcttrgcatccctctctggattagcttagtgttgtttcatgatactattttttgttttaaccagttgtgccattgtttgctgatggaaattgttacatgccagccggcaatgctagggtttcagataaatagaatatcagcatcattcttcatatcagcaaaatgataagttgtggttttgcccatcatacttaaagctaatttaggacttaaaatctggagccatgcaaatttataagaactgcttaataggagacagtgcattagttgatttagtggttgaatttccagtgaattttttttttttaattctgtgtagggacccattttaagataatctggaaaagaagagaaccagggaggaaaatacagtgtgaggcaggctgggtggcaaaatggaaagagaggtaggctttgggattaaataaagccagtagttctcatattttctgtatggcaagagctcctttagcaggctgaaagttctgtggaacccctctcagaatatttttaaatgcataaaataagctggactacaaagaaagccagttgtattgaaaagttaccaaaatatttaagaaaacacttatggcacagtagtatgtgcttttttactaacacacaaaataacaagttctagttgtgggacctaatgacttctatagttttgaaatggtgatgggcataaatgatatttcacaattggcaacaactgtgaagtgatataaaaatacgggtatttctgttggagacaaggtcatagatactgccaatatctggtgggtggtccatacattcataattgaaggaaaatgctaaattgtagaggctaatgcaaagtaaaatgtaattattttcctgtcccagtccccaaaacaagagcttgtggatctcagattaagatcccctgggttagaagaacttggctagaatattaacatagccttttactggctgtaccaccttaggcaagttaacctcaaaaagtctatttcctcatttataaaagcgttgatgagacctactttgtacagttgtggaaaggcataggaagatcatgcctagcctcactctttgtgtacaaatgatgacttgaagcacgttaggtcttctggccagatttcttttggcagtgatagaataaaatgacacttgctacacttgctgagaggtaggggcagactttatgctaggcagggaactcaaagattacactgaaagcagaaaactcctttacctttagattttcttaagagttgtcgacccttaaggagtgtcagaagtgggatataatatggagaaaagagaaagcattataaaatatgtggaaaggagtctattaggaaatttcctcctggccttgttgatccaaagcctttagttgcaaagaaacagctttttgttcattataaatgttttaacaataactagaactggtgttgccatccaccccatttgggcatgagcttttttcttccacyggagacgtaggtccccagatgattgattggctgcaaagtatggacatgtcttgattgtttctagaaggggcgggaccactgccttcttggattgtaactactacacctgcagagccccaaaaggtctggctactctattagattaaggtttaacatgtgataatagtctagttttattacttaaggggaaactcaaaagtgtggataccttgattttgtctggatattttattaagcacatgtacctataggccataaggatgtgttctttttctggctggccactgagtgtgtctgtgcatgatgctgggcagctcttcctttctccctgacagcttttaaaggcaggatactgagtgtttgatccatcatctcagtgagggtgtgaaatcagtgaggcaatggagcttcagggtttccttgtcccttgggtcatggctaacaccccatttaatgtctccttttcatcaaaaccagatttgtcgtctcacttatttcccagtgtctggccaagatagtgatctttatgaaaacaaactggaagtaatgcaagccagaaaagatgggagagcttcgcctctgcagaaggaagctgttaaggggaacagatggagacagggtctaaacagcttcaagaaagtgtgcacttgctagtctcagaggtgctccctgtcccccaagagctgtttgaatcaggagctgcttaaggacctgaatgacttctccaactctgccagggatccttcattagccctgcacttctgagatcactcagtgccccccatagacctctcctgctcttctgaatgcagaagcaggagtgggatataaagtgaaaatatagtaaattctaacctagtgtggcttgaaaaagaagttgcaatttatagagaattgccaaatatactgtgatggatcactaattttcaacatataataatttattaaaacactaaggatgacgtctataattgtcgtattaatctctgaaggtatcaggactttacaaggttcctgtgccttggccatcattgtgatcatttatagtgactaatcaatttgacaactatgtggcatatgaatggtaagcattcttggcaagcaaagggaagaaatgtcttatctgcatttaccagatctcatgtcttggctgtttgcagttatttacccctttcttccattaatctaaacttccaagaccctaagctcacattgtatcctgtattaacttgctaactaacctcctgtttttgtggttttctttctctgatctaatcagtccaatcagaagaaagattacacttacagatgcacatgctgatgtcatgacatcatcctcttatttaaggatctccctttgcttccctatcaagtctcaacttctctggccatctagacctcaggtgaggtccttttatcttagcgaccttgttctttgattcactgacatggatcttgggcgccattaagatggtttatttgttgtcagayaccctttgttcttttctgtcctttcactgtggaatttttctcttggccaaattctatccattcttggcccacactgccttcctagcattcttgtatccctctctcactgtctcgcctgcacaatttggtatatttggtttactattggtcttctgttatttcacatattacttgtttttccagcaagtcagagttccttaatagaaagtattctgctctatttattttatatattataattcttagcaaagcaccagcacacagtaagtgttcaataaatatttagaggaagcaggtaaaaggtgtcatgagttagatatttcmaataggaggagatggacccttgatggggtcaaccagcatcaagtgtgcctcttttacaaaaccaggaacccaatcttctccttttttcaaagttgatccaggcttatggaattcagttcataaaaaccaagctcaagggagtgaatgccaattcaataacaatgaaaagtctaacctctaggtaacagaaatatctgtgtcagccattcattgcatcctttttcttgtagcaaggcttccagcaggcgactctagggtcattcgtggccaatatgattcatttgcaccagctctgaagcctagtgcatgccatttagactctagggacaccttgcaaagttcttgctttttactttcaccccttcctcatagatgactctttgctttttaaaggaattgaagggctattctatagacaggagtaaagcctgttcagagatgttctaaacaccagattttgtttgcttgagaagcaaagagaagataatttagacaagggcaaaagcaccatgagaagactttgaaacagttttacccaagttgtaactggagaagaagacttgatgagtcttgtgaattaggcagatagcattcatgagctggagagaatgggaaatgcagagtgcaagggagattagttttgagggagcaggtggcagtgttgagtgatgctgaggggagatcagaatgttgaaagagaagtatgactgatatctggttagtttctttgttttgtctttcttgagctgctttcaccaatgatgtacatatgaaaaagggatgttatgaataagttaccttcaaactaaattaactgagtggtttttacatggagcttcaggatatccagaagcatatgtctaggaataaaaatggttatttttgagggctgggcgcagtggctcatgcctgtaatcccagcactttgggaggcaaaggtgggcagatcatgaggtcaggagttcgagatcagcctggccaacatggtgaaaccccatctctactaaaaatacaaaaattagcctggtgtagtggcgcacgcctgtaatcccagctagtcaagaggctgaggcgggagaattgcttgaacccgggaggcgaaggctgcagtgagccgagatcgcgccactgcacttcagcctgggtgacagaccaagactccctctcggaataataataataataataataataataataataataataataatggttatttttaaagtaatatttaatgtgaaattcataagacttgaaattgggggaaattggaagggattaattcctgtcctttgactcattgtcctttaacacagattagtatttttgcaatcttagaattatgtatttatcaggggcttctttttcctgtggacagtgtcaaggggtgttttgaagtgacttgagcccaggaagtctgtttggataaacactgatggactgatgtagaacagtttatcatctctgagcaactggtaatcactcaaacacatgtaagaagctcagtggttgctttttgcaactatcaatcatgatggttgtgtaatgcaaataggagtaaagaaggtttgattagtctgtaacagcagctggcacattttttttgtaaggggctggatggttttgtgggctgtgtggactctgtccttatagtttgaaagcagccataggccataaacaaatgtgtgcagcagagtttgaataaaactttatagaaaatgaagtttgattttcatgtaaactaatgtgttatgctattcttttttaaaaactttccagccattaaaaaatctaaaaaatatccttgacccacaggctgtatgtgccaatccctggtacataacatagaataggatgagtttygggaagaaacagtacaaaatacaggctgctatatgtttgcaatagtgtgaaaagaaagtttacccagcgttttcttggcaactgagacttcttgtaccattcattttcaaaagtcatttcaaaaccaggaattttttcctaatttctccaaactgattatatcagctttctaaaatatttggtgtgtaatcaaagtacagttttgttgctggatttcaaaggctgcagtttagtactaggtttctcctgtttcaaaagaaattgtgttatgtacataaatatgtacgtgcacatgcacacacaggagggctctttaccttaacaatttgaagttcttctaatttcctttttgttcactactaagtgattctttattctccatgtgtcagtttatttccagatgtacatcttagttttcttctggtaaagtcctgtttcttcctgtccttgctgatagaggaaaccacataaagcatttcttaaaattaagaaaacaatgtcacttcagctgtgaatcctgtaaactttaagaatccattcagaatgcacttgaatgggaacattttgtaaagaaagctgaaaaatggcagtcagatttttacagaacagcccaaaggggtgttttgtgtgctaatgattagaacttttgcagattcttgcttagtaattaggactgacagatgggctctgtattagtccattttgtgctgctataacaaaacacccaagactaggtaatttgtaaggaacagaaatttatttctttcagttctggaggctgggagtttcaaatcaaagtaccaggaggttagggcccagtctctctgcttccaagatggtgccttaaatgctgcatcctctggaggagaacaccatgtcctcgggtggcagaggggcagaagagagagaacctactcctgcaagcttgcctttttaattttttaattttaatgtttttagagacagggtctctgctctgttgcccatgttggagtgcaatgacatgatcatagctcactgtaacttcaaacccctaggctcaagcaatccacgtgagtagctaggactacaagtgtgtgccaccatgcccagataatttttatttatttatttatttattttgagggacagggttttgctatgttgtccaggctagctcaagctcttttgatagcagcattaatctactcatgagggttgtaccgttatgacgtcaatacctcccattaggctgcacctcccaacactgctgcattggggattaagtttccaacatgcaaatttggaggacatattcagactatagaaggctctgttcctcrgaacactgtctttttaaaaagaagtgcatttaattattcaaagaatacatgattatatttttgtcttttaaaataatatggataaattgaatttctcatttgaccctgtctcctccactcaatacttcttcccttcccagagataatgtcttagtctatccaggctgctataacaaaatgtcataaactgggtggcttagaaacmacagaaatttatttctcacaattcaggagactgggaagtccaagatcaagacattggtagattcggtatctggtgagggtctacttcctcatagatggctgtctgctcacgtaatctcacctggtggacagagccagggatctctctagtgccattcatgagggctccaccctcatggcctaatggcctcccacaggccatatctcctaatactgtcatattctgggttaagattttagcataggagtttgagggggacataagcattcagttcattgcgggcaaccattgctatcaatgttttgtaatcattttctgtgtgtttatgtaaataaatgttcatgaagtatgtttcctaatagaaaccatatgagaccaggcatgctggcgcatgtctatagtcccagatactcaagaggctgaattgcgagcattgcttgaggctaggagtttgagtccagtctgggtaacataacaagaccttatcattataagatgaaaaagaaaaaaaacccatatggatgttatatcctacagattataatgaaaattgcttttttttcctacttgatccatgttggagaacacaggtcagcatttttcttttgccatgctttcctgaggattgggtgggtgggggggtagaaggtgatagaaaaccctttgcatatgatatggtggtaagacagcctcctatcctgtaggcgtggtcaaggtttaaagctgactatctcatggggtgctcatgagggttcttcaaagactctgtcatctgtgtcagtttctgggagtctaggggtccaccaccagtcctgccactgtgatcatgttgccctttcagacagccctagaggactggacctgaaacaagccctggactggctcgttcttgtcggaggaccactccgtgcccttggaaacatcaggcactctttgccccmacacccacagcctctgagaggatggcccagacccactgcagcagcaatttcccttcactcccatgccaccagggcagctagccacactgcctctcatgttccaggtccccagagaaggggtgccagcacctctctgtgtctctttaatggtggagcactcaaatcaagcccccaactggcctcactgaaatccggcttgtgaagtaagaagctgatattcctactctttccccaatgggaagagggtgctgaatggggatctcagtgcagctctttccaaagaaatcctccctcacatcttgctcttgaccctccctgtgggagaggagcttaagcctagttcttagttatctcctttttgaagggcagatgggtgttttttttttaactcactttggtatctgatattgctagcatcttgtgttagagccaaaacttgcagtgtagcatcctcatcatgtgtatactagaaacttacttgtggaattgttggatgatagagggatggtgcagtagaatgttaaattactcaccgacggggtctcaggtacatgccacacgcttgccaacactttacaaaattgatctttaaatgtttttaccaggcttttgaaggaaaaagacacatatatctcaccattttacttttctttactaggcagttctttatatatttattgagcattttaatttttctttccatgaatttcctgttaaagtcctttgccctattatttatatatatatatytttttatttttttcttgagatggagtctcgctctgtcgcccaggcttgagtgcagtggcacgatcttggctcactgcaagctctgccccctgggttcatgccattctcctgcctcagcctcccgagtagctgggactacaggcacccaccacacctggctaattttttgtattttttagtagagacggggtttcaccrtgttagccaggatggtctcaatctcctgacctcatgatccgcctgcttcggcctcccaaagtgctgggattataggcgtgagccaccgcgcctggcttgccctrttattttaaaaattgtctctatttattgatttgtaattctttatatattctgaatacgaaccctttgttacatagcaaatattttctcccagcttggccttgtcttttaactttgggaaattggactacatcaaaggcacgatgaataatgactttgtgttgtgtctggcttaaaaaggccatccttctccagggttataaacaccttctcctatatattcttctcatgctgtaatagttgacattttacagtgttttgagggttaatccatcagggatattttcatgaatagtagaactctaacttaattttttcccacatggagagctagttatttcaacactgtttgtggaaagccagtagcatggtgtgtggccactagaataagggtagtcaaagggctaaagtggctggagtggggagaatgacagataattgctaaacatcctactgatcaaggttagatgacttctcagtctagaagatacatacccttctgagaaagccccytgtaggagtgaacacccaacatcctttgaccggttttactatcagaacatttacatacaggcagaactaaaatctgtgattatctggatgagaaaacagttgtaggcaacttactcatttttctgaacaagaaaaggttctacataattacgttctctatgaatcttttatcagatttaatagttaagtctcttcaaagaacatgagatattctttttttaaagtgagcctatgatttatttatcctcattaatacttgttttccccaacccttccaagctgtttgggaatgttgtgtgtcagggatcagtgaaggtcatgaagatgcctttaaggcctgattaacctgatttgaaaaactttaaaactgaccttctctacatctccccattattgtcctacgtttcacagtcagatcaaggcttattatcctttccactggggaagtagcccaaatcatagtgtgagtgaaaaacatttactaagaagtgtgagtcttttaaaccctcttgtgtttcttttaagaaattaaaaccaataatgactatcagttgaatttggttgttccacctttattttatcaaaatccttggacatacattaaagtatttgtcccttgggcaggtgccaaggctatgaagttggagcgtggcatgttctagaagcagaaagaaggctggtgaggtrgggacacagcaggtagggagtagagtgaggccaagccccaggtcagggctggacctcagggcctaggtccaggtgaaagcactgggcatgatgctgagggcagtagatgctgtgggaggattttaagcagggtgacaagatcaggcttgtactagatgagaacgttggctgtgtaaagatagattgacagtaagcaagagtgaatccagaaaaaaataatctagaaacctgttgcagtgatacaggtgagggatactttgcctttattggatttgaaagtataaaaaaaaaatgaacatctgttgtttagagtaaaagccctgtaaggtatggtataaaatgaaacattttcaaaaatgcccatgtcacaaaaaaattttttttaaatcagctctgtgcaggaccagctacctaatttgcagggccctcactgccaaatgaaaccgtgggacctcttgtgcaaaaataaaataatttcaagatggcaacagcagagcattcaacgaacatgggaccctgtgtgattgctatgcggcacgccctgggtctgtgtgacaaaatggcttgagtcagtccctgagaagcttctccttgcctgttccataaaaaggctgatgatgactcctgtggtctaggcagagaggtaaagataagctaagcttgtgtagctactactgttattttgtttgtttgtttgtttagactgcttcttgcagagcagggctaccctaccggcagtgcgcccagagtaacctgttctttaactcaaaggctttgttaaccttaatacaatgtaaattacagagaatgtcggaaacaaaactggcagcaggtatttatgactagaggaggtgagtagggatggtgatgggaattaagagaattgttttttgttcttattggctgtggttgatgaaaacataaactaggagaaggaaataacattaacattaaatttgttccttagaactatttatttctcctagcacgtacccatttacctggctttccaggagcatattctttttttttttttttttgagatggcagagttttgctcatgtcacctaggctggagtgaagtggcacaatctcggctcactgcaacctccacctcctgggttcaagcgattgtcctgcctcagcctcccaagtagctgggattacaggtgccagccaccacgtctggctaatttttttgtatttttagtagagacagggtttcatcatgttggccaggctgatctcaaactacagacctcaggtgatccacccacctcagcctcccaaagtgcggggatcacaggcgtgagctaccacgcctggcttccaggagcatattcttaaacagtttggagggaaaatggtttgggcaaaagacttcctgttaaattgtgtgctgctttctttttcttttttaaagaactggtaatacagccgggcacggtggctcacgcctgtaatcccagcactttgggaggccaaggtgggtggatcacctgaggtcaggagttcaagaccagcctgaccaacatggcaaaaccccatctctactaaaaatacaaaattagccaggtgtggtggtgcacgcctgtaatcccagctactctggaggctgaggcagggagaatcacctgaacccagaaggtgaaggttgtagtgagccaagattgtgccattgcactccagcttgggcaacaagagtgaaactccgtctccaaaaaaaaaaaaaaaaatttggtaagacatggcttttggctttttatctccttctccacttattttttacctgtggaaaatgattcagaaaccggacagagctttgcataagaggtgtaaattgtgaagttccttaactctgaaaattgaagacataaatatatagaattttcccttctagtatcactgagggaagaatagtggctgtgggaatttggtagtttgggatattctgaaattgtttgctgtcattttcatttgtaataagtttacttggcaagttctgtaccaaagctatcttgagggcaaagtttgtgaacaccttttaaaacacagtttacgtttctagaaaaaagatcttatgcttactaaacaaaattcctttcagcagttttcaatgactcagagccctgatatttgcatagtgattcggccaatggaagttgactttgagataattttggttaagataagtctcctggtttatgcttttaaaaggttaggttaataaaggcctgtccggaatagtataatgtgcagtggtttccagccacttttgattatctcaaatgccacctatagagctgggtagtaatagtgatattaaggtattatttcagagggacccacaaggccaactttggactcttgacattaaacactgcaaaattccaaagtgcagacagcttggcaagtttgagttctggtgcattctgttcacaactatttttttttttttttcaatagtgcttttgtctttctgctaaaggtcagactgtagttgtcgagtactggtattgttcctgaattattcgggaagagggtggaartattgacttagtttttctattataatatcctatcacaatgctggattttaatgatttaaaaatgtaaataaaagtatttgcatttttagactacttgtgagcagctgccaattctaaaatcactatgggtgtttgcagctcttttctgggctcattttacccatctttgatcttctatcaacatgcaggtctgtgtgatgggctagaaccagcatgtattttgtttagagtcagactttgttggaatcctggtgtcacaatttggaccctcggggcagcacccagattaagtaacctctgtaatatgggggtgccaccactgctttgcagagctgttagataaagtaatgcatattgcctgctacaaagtagatgttgtatttgagtgtagaggaggggtgtatttgcccattctcatgatgctaataaagatatacctgagactgggtaatttataaagcaagaggtttaacagactcacagttccacatgcggctaggaaggcctcacaatcacggcagaggatgaaggaagagcaaaagtatttcttacatggcagcgggcaagagagaacttgttcaggggaactcctctttatcaatccatcagatctcgtgagacttatttgctgtcacgagaacagcacaagaaagacccgcctccatgatccaattaccttccactgggtcgctcccacgacatgtgggaattgtggaagtgacaattcaagatgagatttgggtggggacacagccaatccatatcaagggggggtaaggtttaagtgcagagccattgagtccaggctgctgccacgtactcttccagggcaatggaggtagtctgagtctgctccatggagagtggccatgagggacccagagctgacctctgcctgcctcaagccggattacaattctgttgggactgtttttcaactgcacccagctgatctagagagagtttataattgatgtgtgtttagctctgtgtcagcatcactggtttcttaaggagtctcactcaattcattggggctaaaaacatgaaatgggtttaactttctctaggcactgcttaccactgtgccctgttaaatccccccttccagtctctgaatggtggattgggcatcttctatcattctttcatctttccaaatctcctaatgttacatccagttcatcttctgtgcctctcctactctctcttctgagctctaggccctctgggatgctggggtggagaggagaggatggaaatggggagcaagggactagtaattatttaactcgccaagcggagttggtggtgagaaagtgcctctcgtagcctgctgcttttgtgtggtttgttctgatggtggggtgtctgctcaggtgatgtgtgactctcttggggctgtgtttggctttacctcagcctcgtttgtgagcagcctgtgcaaaggacagcagtgtccccctttggtattgctgggtgttcatgccccatcaggcttcaactcctccttctagtgagtgtcctggtgcttggcccatcagctgcctggcagcccaagggctcctgcccctctgacctcaacactccttcaaaaggaactgtgtgagttactgcagtcctgtctctctgtccaggggttgtagggaactgaactggagcgggaatattccagtcttctttcctggaacattcccttgaggctctgcttgcatgtggctccctcagtgggcctgccactcccgaatctctgactcaaaaatgggtaccagtctcatgctcatgggtgtgcccccactccagggactggatgccaagttccccctactccctgacatgctccgttctgctgcagtgccagcctggaagggagcgggaaactgtgaagtcttcagctcagccagcagtcagactaggagcaagatgctcatctctccttcttgcaggtatcctagtctctcctagtgattctcttggaagtcccccaacccctacctggttggggaagcagacagtaacctgcactagaaccttgccctccccataaagccaacatcaacctttctccttgtccttgcatgggaagaggggctgtggtcaggtagtaagactggtcctctgacctcctggggaagccatagggggcagtgtctgaccctacttgtttatggctttctgagtagggtacttagccctgttgtgctcagctttggccttggctgtattctaaaaataagggaaacagcccatttaacaatatcctttttaaggatattagtaatattctctttctgtagtgcccaggatgttcttcctgtgcatcctttcctgcagtagcagagtgagggcaggaccacactaatacttactggcatttgtgtcggatttgatcagtaggcttaaaatgtatttcaccttggaaaggtatggtaggggtctccatggacatcattttaattagctgcaggaattggaggttcaaagcgccccaagttttcttcagtttccccctcctgactctatgccagtgacttagaaatataaaggtgtgttctcttggatggattgtttgacttgctgcttcctcttcatattcacctaagaaatggacggtcaaaataaatggaaagtcttactttaaatagcagagttgatgattaggttcaggtaatctatttcattgttcatttattaagtagatacaagaaagaaaaaggaaaccactgggagggtatgagtgaaatggctagctctttttgggaaaagttaatctggtggcagagtatggaaactagatcatccaggggaagaggagttggaggtatggagcactagattataggtcagtgttcagaccagaggtcaaagggcctgaccacagtaagtggcagtggtagtgggaaggaggggatgaaatgagagagaggcacagagttgctggaagccaacaacggactggaatgagaacagggaatgactttgcagcattaatctgggatccatgaaaggagagggtaccatgaacagaagtaagggagttagaagaaaagaccaatttgagggtgcggaacatcagggctacccttggcctatagtgccttttcaagaaggaaaagatgttccctcctccaggcacaggacctggcctgtagcacacaggctggtctgggctaggttctggtgcacagtgtgccacctacacaaccatacatgatggccccggggaagattcctttagagcagcaaggttcccatggagtaagaaggcctcaacacttcatcaagggcatagccagactctaatgtcgaatgagtgatagtgcttattcctgtattgattgcagaaaaagccatcatgtaagaaaagcactccttttgacagacacctacctaatctacacatatcacagcttttcttttttttatcgtgatgaaatatatataatgtaaaatttaccattctaaccatttttaaatggacaatctagtggcattaagtacatttacaacattgtgcaacatcatcattctccatttccagaaatttttatcttgcaaagctgaaactctgttcccattaaaaataattccctattccccctcctcctagccccctggtaacctctattctactttctgcctctgtgatctgcctactttagatacctcatataagtggaatcatagaatatgtgtcctttggtgcccatctgactttttaacttagtgtcatgtcttcaagtttcatcgtgtggcatttatcagaattttattccttttcgtggccaaataactttgtattgtatggatatataccacattttgtttatctattcatctgttgctgggcacgtgagttgtttccatgttttggtgatcawgactgatgctgcagttaacatggggtgcaggtatatatttgagtctttgcttctaattctttggggatattataatacctatactggatcacaaagtaattctacgtttcactttttgaggagccaccaaactgttttccacagtggctgccccatcttacattcccactaacagttcayaagtgtttcaacttctcatcatcctcaccatcatttgttattttctgtttctttaaaaccagtagccatcttaataaagtaatattgcattacagttttgatgtgcatttccctggtgtcccagttctacttttatatacctgcttgtcattaagaaagctctacttttcaagaatgctggaaagagcagctttcccccgctataaactcatagccaaccttcacttatatgagaacatgcagagcatagtttcatctcctttgaaatactgtaataagagttttagatgtatttgattcaacgtgcagaatgtttattttttgtgtgcgtgtatgtgtgtatgtgtttgagacagcgacttgttctgtcacccagactagcatgaagtggtgcaatcacagctcactgaaacctcaccctcttgggctgcagcaatgctcccacctcagccctctgagtaggtgggactatgggcatgcaacaccatgccatactaattaaaaaaaaaaattgatagagatggtgtcacactgctgggcacaagcagtcctcctgccttggcctcccaaagtgttgggattacaggcatgggccactgtgcccggccactatttttcagttagttgtgagcatttaaaaaaacagaagaactcataaaaaatctgaatcttccacttttcaagaaatcccaaaggtcaggcccttgtggtccacatttccacaagtagctgtgagctagagccaagttgcttacagcccccacccagccagcttcgttccttaccggtaccggcctcacccctgcaggtatctgtttccaagcccgccctgttagagtggattttctgaggctaaagttagtttggatttattccaacttatataaataatcgaggtgattagatatgactaatacttctgttctacctagctacttaatacctccactgacactttctttcctgataaaatctgaaatctcttcatttatccttgcatcccttgagccccttgagggacaggtcttatcaacagattggtttctactggttaaaagttgcattaaatttgtctcctcatacctggaacaattggatatcatgttttgcatctgcccatcaggtagatacacccttttagctctgccacattctaacatagagtggctcttctgtcattgccacctaattgtaggcctctgcttgctagttgtatccactgtttacgttatagagaaatcttttcacatatgtaaggactttatatctgtgtgtgtgcccattcatttaatagtctttgtatatgctagaattaaggcacaagaaatacaaatgtttcatgtctgtggtcaggaaatacagttagcaatggctgtagctgtttagattgtgaagatgataattggccgcttcagatcctgtgtcttacagataatcagtactggaaggtgtagggtgaagctgcgtcacagccatgaaatggaggcattgtgaaacccaagccggcccagaacaccctcgcagcatgatttgttattgcacagagctggctgtactgctgctcaagccatatttcctgaaactcaagaacgccagagtggaatagagttctcttataaccagctcctgttccctcaaaccttcgcatgacaccccttgtggttttcagcccgtctctctgtgtggtcgctaatgacttcattaaaggtgaagcatttcagtgatcaagagccagtgcttgatgatggttggagggacgtaaatgtgcaagcgggcctcagagcctaggtggaccggcctccttgccttcactctcaggcatcacggccctccagcatgtttctctgaggagctgttgatcatttgcccaggagatggagctgggaacctcrttgtcaccaagtcagtaccaatgatttgtgcttcctgtcagggaaacctgtggtgcatgtgtttgtcttctgcttctcagccagtttctttttgcatccatcaatctcttcttatctgtcttctttttcctgactgggcatagtagtcagttgtgagtttggacttgtattttcttattttgtaacagtttgtttcctggcttcatcttgcccctccctcctaaaagctccacttgtcttttatttctcaaggtagatgggacgaggttttttgttttttgtttttgtttttgttttgtcaggttgacttacatttccccccattagggtgtgccgcagaaagaagttttctctatttctgatgtctatgtcaatacagaacaataatgaaattgttaggcaggtgaaatggtacttaactatctgtctggaaactcctaagcgcctgcaagtctttctgagtgagaatttactgtggatagcagttaagatgccccattcctgaacatgctgtaggaatgggtcctggtaggcatcactttctagccagtccaaagccacgctttcctggcagcctgttcctctcatcatcttcctgttcccatggccatggcaccccaaatgtctgctgctctgaccaaaaagctggcagacagtaaataaactgacttctaagataagaaccttcatttgaaacaatttttaacatgccttctttgtcaaggagtaaagaccctgaatcccccaggggttcctacagcccacgatggttcacaagagagtctacaatcctcagagccaagaagcactgagactcaaggacagggccacttgacagagagagcagttcccagcygacttggggcctaggaggatattctgggtggcagggctctaattgattattaacctacatataaaatcaaggacatatagccaagcacagcagcaaatgctgccaccttgtgagctgcctgtggttgtgctgggtggagatggatctagctaaggcacaccaggatgcagcttagagagaacttggtcagatttttactgcttctggtataattggaacactttacttcttaagcctactgtgtaatgttatgtgtacagagtgagtggttgcttaattaagtgctttaattttttttggtcatatatacacgtggtgcaaaatgtaaaaggcccaaaggaggggacagtgaaaattatatctttctcccacccagttccccttcccaaaggtaaacattattgccagtttcttttgtagcctagtgggaataatttctgaatagttatccatactttataggtaactctatagcgatagaactatatgtagttctatacagtatgtatgtagttatatacagtacatatatatgtctacagtatatatgtagttatatacagtatatatgtatatatgtactatatgtaaatatatacatatgtagttgtatacagtacatatatacatatctatagttttcttctatatagttatctctacatatacatacatatatacacataactatgtatataaaactatacaattgttacactgttgtgtaacatggatgtgtatacaatagcgatatgattaaatatttcttattaatgatgatttcctgcagcctttcaatcttgttaaacacaaggaaaattagaaatggaccgaacagaagtggcatcataaaaggcagctactgtttgggagcaagggacatgccgtggagaggaaatgtgtggtggtctgaaattgcaccagtttccactacaattttaaaaccatgcctagccttgccraaggacctcgggggcaaaggttaagccgacacaccctttaggtcatggtacacagtatctctgggcacatggtggactctggtttgtgctggacccctaaaagttatttccttttatccctggttccctccctcccataggcaacattctgatatgtatacaatgtatcatttagatttgtgtgtattcttgcaatggatcttgttttgtgtgtaagtatttttaatttatgcaaatggtatggctatctcattctgttccttagttttttttactaggctttgaaagttccatccattttactaggtgtgaatccacttcattgctatctgtctttgtagggccaaactgagatttggaaaatacttgaagcaatctttgtgactttttacccaggttttttcacatgttgacacacatgacaaaaagtgcatgtacttttgtgttactgttttactcactttactatttcaactttcctccattttgctaatttgtcataaatattaatggctgtatagtattccatttatataatcagttattacttcacactctctcctgtcatcagacatctgagttttttatttttaatatcattgtggttacatgcgtatcattggtctttgttgattttctttttcttaagccagaacagatgcccaatagggaattattgagccagagaaaaattctcctayagcatgtgatggaagtggccacattttacctcttgctttatttccagaaatgaacacaggtgtctatatccatttaatacacccctttttggccgggtgtgttggctcacacctgtaatcccagcactttgggaggccgaggtgggcagatcacttgaggtcgggagttcaaaaccagcctagccaacgtggtgaaaccccatctctactaaaaatacaaaaattggtcaggtgtggtggcgtgtgcctgtaatctcagctattccggaggctgaggcaggagaatcctcgaacctgggaggcagaggttgcagtgagctgagatcatgccacagcactccagcctgagggacagagtgggactccatttcaaaaaaacaaaacaatacaccmctttttatttgtagtgcactatacttagagctgttgccataggaattgatataycaggcgtcatggtggtcagcagacaaataggaaactcctgttatgtcgtcagaatgagttgcagagagtaccatctgctacctgtattgtacatctttctgttcctctgtcacgcctggcacaagagcagcattggtttaatcatcagcagcccttctgctctctgtagtcaggattggcagtaactcattggtgggcaacactgccttggtcttgccgcttgcactgtgaactgtaactamggacacacatgtcaggaaagaatggtgcttgggatgctcctcctatctgtgcctcaaacgttttcactcgagggatattaaaaagtggcctactgcttataaagactgtgtgtcagtgaagaggaagaggtgggagtggagagtgggaggcatttgcaagaacatatgttggattctttttttctcttcttggtgacaatgattgacggcatctagtgagtccctgtttgtcacttccttggtacagctggtagtggaggtgggggaaatcaataagggctggacaaaggacatagctagaggaagaaagcactgcaaatatggtattaagatgacattcctcacagttgaatttttcactgtgctattacttcacactacctgctgcgagctrttctcttttgatcctttaggctgtagaggaatcagtctgtgtaactctccctcattcaccacctccaagaaagggttaactttggacataagataactgtagtttaaggggaggaagagaaggaaggaaattcatactggatacagcttttgccagttttgtttcttctatgttgaaatatgggctggctttatggcattctcttggtgttctggaatgtccattatttaacaattccatattgaatacttgcttggggcttagaagagggaagtcaagtgtaggaaggagttgtggcaatttaagtaagtttacaatgatcttattaagcttgttgctttcattttcctgcctacgttggggcaaagacgtgttaaaagtgcaagaacagtgattattttgtggttagagcatgtgcacagtgtagacaaacccaggaaggagaatctgcttcatcaagtcttaagttgttatttagaccaaaatgtatgcgtaagcctcagatgactgttgatgtgccaggaaacttctgctgagtactttcggttctttcttctttactttacctctgcaccccagctcatggttatcttgtaaaactgaagrtgctttgcactgcaaacagacatgacagctcagtctcccctgtagcaagttctagggaaggcaggttggcagagtcccatttttgagctcagttctccaaggccctttggtcagcttattttcctgcagggtgtcacatcccacagtagtctccacctggaagacattggatctcatatgttcagatcagtgtagccacgctgctctgtggagaacagtgtgataaatccttggtagcattacgctttaaactggtggccacttgcctacctccttttaatttcattttgttaacaattgtttcttgaggacctgttgcatgctgggtgcttttttcctgggtgatttcacatttagcatctgttttcattstcatgacttctctgtgaggtagcaagtattgtacccagttttctgatagaggaaattgtggcccagagagattgttgtaccccmaagtaatgaagatgaatacagttgcagaaccaagttagaagccagatttttggagatccaaggtccagtgaacacagctgtacccccacagacacttccgaaagtgaccacagcctcttcagccagtcctgaagagtatgttcaccttcatctgtcttaaagcacaggcacacctggctttgggaaagcatagtttatcaagatctgaattggctcattttagttttagaaaaggtttcacctaaggcttctgcttaagaagagagcattcctaggaagtgagcttaagccctgttcaccctattaatcttaagtgatttgtcagagcagagtggcagagaggtgtcctgcagaggtgacaacctgaatttaaatcacagctcagccgcttactagctgtgtaatcttgagcaaattacttaactctctgagcctcttcttccttctctattaaaggggagtgatatcaatctcatcagattagtgtgagaatacattcatataagtgccaagtacctgctaagtgctagtccatgtgctaagtaaatgtgagctgcaattgtttgccattggcattatcagtagagtgggagtctcattatagcagaaacctggctctcctgaacatatgtaaatatttacatagcccctactaaatgccatttaagagtgtatctagtgtaaggcaataggatgtgtttagcaggaggagtggatttgttcagggggtgcaacagactgggatgggagaagaaggcatgtttgatagtcaaaatgctggcatacttcctgcgcaaggaagtctgtatggctaaacagtgctgaactaaacaaatactgctgaaggtcaggtgtgaacagtgaatcatattggcggggcatggtctgggatatggtggtgagcagtaaaaactacaatagctaccatgaaaggtacctactatatgccaggcactgttctagtgcttttctcctattagcccttggaagcagttctattattatcccattttgtagattaggaaacagactcagattaattcagttacccaaggggcacgtaactggtaagtggcagagctttggttcagtctcaggcgtcgagctctggaktgtgtgtgtgtgtgtgtgtgtgtgtgctttcaaccattgtgttagatgcctctcaagacagataaggtccttgctattgtagaattcacagtctaactgagtgagccagtcaaactaataagtattatatctagtctgccaggtagtaataaatgcagtgaagagaaaattgggtgaggaattttagaggatgatgggagttgatgttttagctagtgtattagtttgttcaggctgccataaacaaaataccacagattgggaggcttaaacaacagaaatttactttctcacagttttggaggctggaaatccaagagcaaggtgtcaatgtgtttggtttcttctgaggcctctgtcctcggctttgcagatggccctttcactatgtccttctgtcttccctctatgagcgttcagccctgggagctctctgtgccctgatcaccttttcttataaggacagtagccacacctaatcacctcattttaacttaaccatctctttaaaggccctgtcttcaaatacagtctcattttgaggtattaggggttaggacttcaacatataaatttggggaggggaacacagttctgaccataacactctgccctctgcacccccaaaattcatgtcctcctcacagcaaaatacattcacctgcattcaacaacctaagccttaacccattctagcatcaattctaagtcccaaatctcatctaaatatcatctacatcaaagtgagagagactcaagtatatgattcatcttgaggcaaaaattcttctccagctgtgaacccgtgaaaccagacaagttatttgcttccaaaatacaatgatggggacaggcttaggatagacatttccattccaaaagggaaaacttggaaggaagaaaaaagggtcatgggtccaaagcaagtccaaaacctagctgggcaaattatgttcaattttaaggcctgaaaataattctttttacatgatgatctgtcctccaggcccattgggctggcagaattttttttttttttttttcagtatttattgatcattcttgggtgtttctcggagtgggggatttggcagggtcataggacaatagtggagggaaggtcagcagataaacatgtgaacaagggtctctggttttcctaggcagaggaccctgctgccttccgcagtgtttgtgtccctgggtacttgagattagggagtggtgatgactcttaaggagcatgctgccttcaagcatctgtttaacaaagcacatcttgcaccgcccttaatccgtttaactctgagtggacacagcacatgtttcagagagcacggggttgggggtagggtcaccgatcaacaggatcacaaggcagaagaatttttcttagtacagaacaaaatggagtctcccatgtctacttctttctacacagacacagtaacaatctgatctctctttcttttccccacatttcccccttttctatttgacaaaaccgccatcgtcatcatggcccgttctcaatgagctgttgggtacacctcctagacggggtggcggccgggcagaggggctcctcacttcccacacggggcggccaggcagaggcgcccctcacctccctcccggatggggcgactggccgggcgggggctgccccccacctccctcccggacgggggtggctggccgggcagagaggctcctcacttcccggacggggtggctgccgggcggaggggctcctcacttcccagacggggcggctgcggggcggaggggctcctcacttctcagatggggcggccgggcagagacgctcctcacctcccagacggggtggcggtcgggcagagacgctcctcacctcccagacggggtcggggccgggcagaggcaatcctcacatccctcacatcccagacggggcggcggggcagaggcgctccccacatctcagatgatgggcggccgggcagagaygctcctcacttcctagatgggatggcagctgggaagaggcactcctcacttcccagactgggcggccgggcagaggggctcctcacatcccagatgatgggcggccaggcagagacactcytcacttcccagacagggtggcggccgggcagaggctgcaatctcggcactttgggaggccaaggcaggcggctgggaggtggaggttgtagcgagccgagatcacgtcactgcactccagcctgggcaacattgagcactgagtgagcgagactccgtctgcaatcccggcacctcgggaggccgaggcaggcagatcactcgcggtccagagctggagaccagcccagccaacacggcgaaaccccgtctccaccaaaaaatgcaaaaaccagtcaggcgtggctgcgcgtgcctgcaatcccaggcactctgcaggctgaggcaggagaatcaggcagggaggttgcagtgagccgagatggcggcagtacagtccagcctccgctgggcatcagagggagaccttgcaaagagggagacgggagagggagacggagagggggagggggaggggagggggaggggagggggagggagaggactggcagaatttcttcaaggccccaggtggcagccttgcttttgaggccttggacaatgacagcctcaccctctcacactgagacagagagagcctcaccctttgaaatggaagagagccttcctcgcccctgggcctgaacactttcgttgtggggtgagagtagtagctttagggaccattcttcctttttcttgaaggataatacatgctcacacccagagccagatagatctattgtcccatcctgtagcatctcagaagcctgctgctgttgtgtcctgtctctgtcccctttagtccaagtcagcagtgtttctgctactggtagaaccccgtctctattcctggcttctgttgagatggccaattagatctgtgagtcccactgtcactctttagggagtgattgtccagtcacactgttggtgccctctccagaacacattctcatttttttgcaatatggataagctgagaattttccagatctttaagttctggtttgtttagcctaacaattttttctttaatttctctcacttctcttgcactttaatagaagcagtaaggagaaaggaaagtggcaaggaaagcacaacaggctttcaacacttggcttagaaatctcagcagaatatccaaggttgycacttacaagctctaccttccacaaaacacaaaaatgcaattcagcaatgttcttggccattttataacaaggattgccttttttcagtgtctaataacatgttcctcatttctgtctaaaatctcactagaatcacctttcatgtccatatttctagcaacagtctctcttagcatctgagacaacgttctgtggaacacagtttggggaagcttgccaaactcaacagattatactatatcatctccccctgaaagagaagagtgagacataagtcctctgcagtctgttccactcctactagatcttgaagtcatatgttgattcttttcwtsgtattgtgtgcctgtgttttaaggaaaataattagcattcttaaagcaaagcaaaaattttactaaagaaaataattagcctttcatgtcactttcttagagtgaaccaaataagttttgtatgagagaaagataggggcccgtagatgcccactttagttttgcagggtgggttcctacagccacgttcccctgggctaataaggctaatggaatcatggtggcagttttgcattggcctccagctaatgaaaagttttgccatgagaacttaacttagtccttctgatgcttttactgcctgttgacacagaaggtggaaaatgaccaactatgctatacataaaaacaaagtccagatattcttatattcttttagaatatgtcttatgtgctgatttttaaaatattaagggaaaaattgacttgtgatacttgaaagttcatagaacagggcactgcrttaaaacagggcttatgcaaataaaacacatttttctgttcttggccagcagttctaccgtcaggatacttattccatacagcactgtatgatacagaccaagatttatagttggtgatttcctgagtaacaactcagatagcaaatgcctccacaaaacaactttcgtatgttctgcaaggcacaaagtagtacaatagaaaggattgtttgcttcaggatttttgtggggtggtttctttttctttttcttttttctcccacaagacagaatttttcttcttgccctaaaatttgaaagatttctcctttctctccccttctgccacaagtagtcccaccctaaaaaggaagatgaggttctctagcaacccwtaagatgctcataagaaatagcttaaacttttgctttgaaacaagacattcacatattggggttgtgggccaataaactagtcaatagaaagaatggggaagaagcagtgaatgcaaggacagtgttggtggggaagggggaatattctggttttcgtttctgtggatttttaggccaaatttgaacacaggctcttgatgacacatgaagtatctctaacttgattttatgtatgcacactttatgtactatctgtrcataagtcatagacatatagattggactagaatttagagttcagaaatgaacactcacttgtacagtcagttaattttcaataaaggtgccaagacagttcaacaaaggtagtcttttcaactggtggtgctgggacaactgggtagccacatgcaaaagaatgaagttagactctcacctcacatcatatacaraaagtagttcaaaatggatcaaagacctaaactatgagataaaagagaagaaaacmtaggtataaatatataacatataaaataccaaaaatataaacaacaaaagaagaaatagataaatgagacttcatcaagataaaaacatttttgcttcagataacaccattaagaaagtgaaaagacggctcacagaatggaggaaacactttcaaatcatataccaaataagaatcttgtatactgaatatgtaaggaactcttataactcaaaagtaaaaagacaaataattcaactaaaacatgagcaatagatttgaaagacatttctccaaaagtatataaatgggctatatgcatataaaaagaagctgaatatcattagccatcagggaaatgaaaatcaaaaccataatgagatgccactttgcatccactaggatggctgtaatcaaaaagacagaagaatattggtaaggatgtgaagaaattgaaatcctcatacactgctggtgagaatgggaagtggtacagctgttttggaaaacagtctggaagtcctaaaaagatgaaacatagagttaccatatgacccagcaattctactcttgggtatatacccaagggaaatgagaacatacatcagtgcaaaaactagttcacaagtgtttacagcagtatcattcacaatagtcaaaaagttatgggggaaaataacatgtccaaaaactgatgaataaataaataaatgtgatatatccatacaatgaaacattattcaagaaaaagatatgaagtccagatacatcttacaacatagatgaaccttgaaaacatgctaagtgaaaggtcacaaaaggccacatattgtatgagtctatttatatttacatgaaatgttcagaataggcaaatctaaagacagtagattagtgtgttaggggcttgggggtaaatggagaatgactgtttatggatataaggtttctttttcggtgtaaggaagatgttctaaaattgataatgatgatggtctttcaaccctgtgaatatactacaaaccattgcattatacgtgttaagtgttgagtgtatgatgtgtggattatatctcaataaagatgttaaaccacacacagtcatattacataattacacagtcatattgaattcygttataatttcagatttatggactaacactgaatactcagagtattaagcgacctgttccagtgcatatagctggtgatcacagagccagacttcctgaacatcaggccaactgtctctccattgtgattgttacaggaagtttgaccccaacataccatacaagtcacacttaaaatttgtattggtgtggccaggtaccactcacttgttcatgtaacagatcagcaagcccctgaaaccgaggctggcaatagcagtttaattcctgctcctgtaaggttcagtagtgtaggctgggggtgaggagacacaacagctgctgctgcttttcttttttttaaccaacaagaatgaccttgaaaacatggggttctttaccacacaattattcagggaccctgtctgatggaagttcttctaccttctccagccagcagatggggaggagagagaggaggtttatccatgggaggttttcctgagccacacttaggggtggtgcacctctcacactcatttccccacaccttctgtggttacaacccagtcacttggcaccttacagatgctgtggggctacgaatgcagactctggtattgaaggagctacattgtctggggtatataccctggggtttgttgtcgcctgccaggaaaatttaggacacatacacaaggagtttaggagcagaaggttaataggtagaagagaagagagagaaacagcttcctctgtaaaggagggggtctcccagcagaaaggacctgctggtggtgaatgcctcgagtgttatagtagggtttcaagaggcagtgtctgatttacctagagctcatagattggttcaatcaggtatgacatttacatagtgcggggaaggctggtttccccaccctaatcttcttatgcaaatgggctgtccagttagggccatcttgtctgctcctttacagtacaggtggctggcagagaagggaagatggagccgccatcttgaacatgtctactccttagttcccgctggcattcacctgtgcaagctcccagcttgctggctgctctttgatagaaaatgatttggggctgcttttcattaaaaagaagaaccttaccaaggactcccatacccttgctatctgcctgcgtgatttcttcttaactcctatatccctatctgggcttgaagttttctccttatacttaaaaaatcaatccaaaggctagtcagcccrcatgatgactgggcacaagtttagaagtttcatatcatggctcctgcttcattgtgagggattttaatacctttagagcaatgttaagtacccagtctgactggttattctgtcagcagagtctgtcacctgtcctagaagaatagtcttgtttgttgctcctagactggctgatgattgataggagtttccaagttgtatcttattggaaggacctttgagagctctaggcctgtgggccttcctgaggaggtgactgcatttgaataggctctaagtttcctatatcttgcctctgccctgctacagcactacaaggggaaacctggaccatttaccctgcctgttgcaaggtaggtgacaaagaggaagttctgagagaacaaatgaagccccaggaatctactcaaccctgacagtgaatatactatcttctgacctcatactgaaacagtgacaacatctatgtctccaagccgtggaactctaccgctactctggaagcagccctgcagtgttttgttatcacttttgttttacactaggctagaggattcagtttggtgagttgtgagaaattaaaagttggaattagaggagcagaggctggcccctgtcagcttattgagctgggtagccttagccttttctgagctttggaaaacctcagatatcatgtcagaaaatcaacagaatctgagaaaaacaccggaaaatcatcagcaaatggtgattctgatagcatctcttccttatggggtcatcatgagaagattccatgataatccccataaagtatcaagtccagattttggcaaaagatcatgctcaataaacactagttgtcattgataataatagcatcatcttttgactttcaaggcagagaaaaagaggtatctccattgatgcctaatgttaaaaaaagtaacattttgtaaatctttggcaatatcttaaaatattttatgatgtaactgtgatgcttggaaaactttctttttagcagtcagaatctttcataaccatatgttaagtacttgctttgtgtaaacaggttgccaggcacaaagggattataaagagaaagaagaaatggsctttgcctttgagcagttcataatgtcataagaattagccatggctatattttaaataggttgtagctaacctaagtttttgctatcagtgttttatttatttatttatttttaattttttttgagacagagtctcactctgtcgcccaggctggagtggagtggtgcgatcttggctcactgcaacctccgcctctcagattcaagcgattctcctgcctcagcctcctgagtagctgggactgcaggtgcccattacgatgcctggctaatttttgtctttagtagagatggggtttcaccatgttggccagggtggtcttcaactcctgacctcaagtgatccgcctgcctgcgcctcccaaagcgttgggattacaggcatgagccaccatgcccggcctggtatcagtgttttaaacctactgcacatatatcctaatatagacaaaaatgtgattacctctttttaaaaacaagcccaactctaaaatatcatacttcggggagcttttatttttgcmtcctgccccttgctcccaattgtcaacttatctccccctactcttgctaccaattgtcagtttacccccagcccctacccctcacacatataccccaatttccaggttgttataaagcattcatatatttttgtgtaaaaaatgatttcttgcatttttccaagataattatttgaaaatgtaattatttgaaaacagattgtgttttaatgtgaaatcacctaataccctaattagtttatttagcttagaaacttggtctagagcagtggctcttaacttggccatattttttttaaggcggcattactattgatttcttctttacaaaatttagcaagtccatggtattcttacttcagtttatttgacacaaggcccacatgagatgtgaatgatatgcatgatatgtgaaaaggaagttcatcatcatcacatcttacctgttccttgttcttccagtttcacagccgttagaatgttagagctggcaaggactttatcaccaaattcttatcaccaacacccctcctttagcagaggagagaaactgaagctcagagaggtgagggtacttgcttgcagtcacaccaccactatgtggctgactcctggtgcagaaccctcccttcaacccagtgcctctccctggctggtaatctcttgtctgtttttctttttttttttctttttgagacggagtctcgctctgtcgcccaggctggagtgcagtggcgcgatctcggctcactgcaagctccacctcctgggttcacaccattctcctgcctcagcctcccgagtagctgggactacaggcgcccgccaccacgaccggctaatttttttgtatttttattagagacggggtttcaccgtgttagccaggatgatctctatctcctgacctcgtgatccgcccgcctcagcctcccaaagtgatgggattacaggcgtgagccaccgcacctggccctctgtttttcaactcccttttctgagctgtcaccaagtcctcttactgtttcctggaactgtctttcggttgtcttccttcccgtttcttcctggctgatcccgtccctcaacatctcacaatgggaaaggcctgacagaggagtcggtctctgaggcgtccattataccatattaattttctctaattacyactgtcagcacrttactcctcttcggtgaggctgccaggagctccctgcttcttgtggctacaaatgtcaacaccgtcctcacatgctagaccttccagagcctagcttcacgggaaggcccagcttcattgctcttttctccctgtgagccccagaggcccactgtcttccctgggttttcttcgtgagtcagccatgtttcttttatgcctttagtttctgttctccccagcttccggttctctccctgcctttccaactacagcaggtcctccaataatgtcgtttcattcgatgtcatttcctcataatgttgatgaagaaaaagaaggggccactgtggagttcgtgtggtctccccaggtctgcgtgggttttctctggggactcgttttcttccacgtcccaaagatgtgcatgttaggttaactgatgtggctacatagtccccactgagtgtggtgggggtttgagtgtatcctccaatgggaacgcatcttgtccagggttggtgcccacccccctacctctgagctgctgggataggttccggccacccaagaccctgacctggaataagagggtgaagaattttcttactttttttgtttttccagtcccttcattatactaaaagtttatgttaatctttcttaattgtatgtatagctcacatttatttcagtgtttaacatagaagtgttttggtctttatttagaagtttgttgatgtttttgtgaccagaaatatgcaataggaacttaattattttttagagacagagtcttgcactgttgcccaggctgtaatgctgtggcctgactacagcttactgcagcctcaaactccagggctcaagcaatccccctacctcaaccccctgagtaactgggaccacaggtgcaaaccaccatgcctggctctttttttttttttttttttaagagagccagggcctcactgtgctgcccwgcctggttcaaactcctggtctcaagcaatcctcccacctcacyctcccaaagtgctggaattacaggcatgagccatagcgcccagtgtaacttgtttatagaaattagcctatggtaaaattgattttgttatacattattttgcttaaattcatagttyccaagtaggtgaggacttactgtactccattcttcaaggccaagtccaggttctaccacctttttaatgttttccttgattgctgcagtgataacccaattattcccctttactcccaaactttttctgattatatcctaccatgtagcattgcacatcatagcctctcatatggttctctggcttttccttagaattgtgttgccttcttaattatatttaatgctctttgaaggcaaggcttatgtttatatttttatcatatatactattcccctcccatccgttggaaatatgttcaaagaccctcagtcgatgcctgagactgaagatagcaccaaaccttgaatagactgtttttgcatatagatacatacctatgctcaggtttaatttataaactaggaatagaaagagattaacaacagtaactaataataaaacagaacaattataacaatatactatgataaaagttctgtgaatgtggactctgcctctgtctcaaaatatcttattgtactgcacttacccttcttgtgatgaggaagggatgggagtgggatagcatgagatttcatcacactactcagaacgatatgcaattaaaaactcatgaattttgtattcctggaactttccatttaatattttcagactagttgacctcaagtaactaaaactgcagaaagtgaaaccttggataaggggggtctactggattccaattttatagtgcctaataaatggtcagtaataaccacttattaggggcttgttgaacttctacaagttgttgttcagagctacaagcagttcagacatattacagtgttggcaacttgggttgggatcagttgttaatattggggcacggtgctctactgtttaagtgttggcaggatcagtggctactgtgttaatgatcctctagggagactgtctatatagatatggtgctcacgctaatagttggatttgtagatcagtagctgggtggcagggaggctgggggctccctgctgagaactgcacaccgggttcttgaatcttgcagtaggtaatagttacttgagaaaggagtatcctcatgactctggcagatcctcagcacaccattgtgacatgtgaactggcctgtctcctctcccactgtaagtccttgagccagtaatgaccttggtgttctcttttctacaatactggcacaacatcttaaggtttaatctgatctttgtctaaaatatttttttcagaacccattaagtacggtgtcttcccaaaaaagataagtgtgttgtcataagttcctggtattggaaaaaggagtctgtgttatttaaagaagccttgtctgcttccttaattccaatgccccttttccatgccttcctacctttcctggtagtcattcctggactgaggtaactgcagattttatagtacttgggactatgcactccctaaggcacagaccgtataagaattgcctctgccaagggctcctaaacttggaattattttttctttaatgtcagcaggactaattccacctatacaaaatggtttggccttttccttctttggcacaaaagagacttggcagaggctcagataaaggtgaagttgacgagctctggcatgggagtgagctcagcgcttctgggctttcattccccctgttcgtctcatgttcaaaatccccattccacccagaaagtcttcccttcccaccagtracaccgaaagatgtttcagatccttcttcctttgtctccaacacacacagcgaaatgctgcatgccttcatttgyagaaagttacccaactggaatcactttaatattttttttttaatctytttaggtggatggaagtttgcttagttgaagaattgccaccaaccactgaattggaagaagggctccggaatggagtttaccttgcaaagttagccaagttctttgccccgaaaatggtatcagagaaaaagatctatgatgtggaacaaacacgttataaggtaaccaagatctaattggttttggcttccagctaaaagtgaaagtttggtatttcatatcctctcccttcttttactcttagtgtttctgtaaggatttggggggctgggggatgtctttggagcctgttaatagcattcctgaggcagcagcagttttaaaaagcaaagtgtttctatttctggtctgacactaagagacctctgacttatggggcttcccaatgcctcccccaattattccttcagggaagtcactcttgactttattagtgccagtaaaggtaaaagtgggggcatgctaccactccttttttcacttgaacttgtggccctaaagagttagggccaatgtgataaaacaagtaggaaggtcgaatgatcagccaagaattcttttccatttcatgtttaaagcaagatacgactaaccactttgtgtacaactagttttaagaattgtttcagggctaatttgggaagcattagaaaataaaaagctattgtagcccttttagaaacatcacaacagctgagtgtggtagctcttgcccataatcccaacacttttggaggccaaggtaggaggattgcttgagcccaggagttcaaggctgcagtgagctatgatcacaccactgccctccagcctgggtgacagagtgagaccctgtctctaagataataatagcaagaagaagaaagatcaacaataaaaaccgcactgttatttaaatttagaaggaggagggagaagaaaacaaaattaaaataaacatcaattttatrgtaataaaaatcccgattttttagagatacatatcaaagtatttacagatgaagtgatagatctaggatttgtttcaaaataattgaggggaaggtagacagatgataaaaagctggccatgagttcataactgttgagttgaatgatgggtacataggagttcattatactattctgtctacttttttacatttgaaattatatattcagaaggaaaaggaaaaagcaaacgccaacctaaaaggctcctccattagcaatgtatcttcaaaacagattttttaaatgtctggtgttctattctgcaatatgtgacctcttgtctgctgcaggtcaaggtttctaaagcttctttgaaacttgatctttatttttttaatgcattcagttctttatatcaatattttttatctgcagattttccagtattctgaacagttatttctcttacagctgtagggaatatgttgcatatagttggaaaaggaatgatttcccatttattgcatgattcatagtacccttcacttctttaggcaaaatatattctttaaatatgtatattraatacagatagaatgtttgaataatcttcaaggttaacagtagacaagattacttgtcaaatttattttgagtctgtttttctagtctggtcaaaaaggtcactgagcaaaagtttttgccttgaataatgttataaataaaaatgtttacatttattaaagtaaatttgtgttcatgaagtttcactccagagttccagctcattataatcttccacaagactttaataaaacaatcayttagccggctaaaattgaagtttagaaaaattttttgagaaatgtttttagaaattcagagaagcccagaaaaagaccatctgtatcctctctccacaaaataaatattagtccacattttagactacagcttgtctttttttcattgcttttattttggttataatcaagatctaggtctgtcagtaccaacacrtatgtagatttgatgatagagttaaagcgtagttggggtaggctccagctccactgaaagggaattacagattttcttttggctttcatgaactgtgagaatcaggctgggaagacgggcccttcatggaagtgagcctcagagcagtatgtgtgctagttcttttctcttcctggaatgttgtataccttgaatataggagtgtccttcctgaccagctcagggccctcatggcagttgcctcatggcaacttaaacaggtaccttctcctcctggcatcagatatcctattatttaaatgaatagcaacttctctttaggatggggacaggggaaataatattcgcaatttctggttatggaataaaatacttgcggggcgtaggcaggtgatgacatacatccccaagtgaaacatcacaagagggaggccacccctgccccatcagatccctggaaggccgggtggcacagaggtgatgctgggagaggagcaggaaggagggaggtgcagcaggagggagatcgtggccagctgtggcgtgggagcccatccttgctgagctaaaagaaaaaaacataagacaaatggaaaggacccctctgtggattgactacagaaaagaggtttgtttttttctttattaaatccctgaaagtgcctagtgttcttgatggaaactttgagtgatttgccatgtaatcataaaatcttattttagcgccttttcatctctcatacgaaaatgaaaggagataaatattagcaaatagataatgcaacttcctgatcttgtgttcttcaggactgaagcatgtcacatagccctttgcaaggagagctaaatcatgggactaaggcaaagatgttgaagcacgagggaacgctcaataacccagccccagcccctcgtgccatctggaaaccatgaattcagtgaactcgggctctcgctgcagggtctgcctagactgcagccataaaatatgtcagccttggcactggcagctttgatggccatcagttaggcagacaggagcttttgtgctacccccttctctttgtcagcttatgtacaaccctagttcctcattaatttagggttggaaagatgtcctgagtattagagttcaactttccagttataagtattttttccatggccacctccgccctccacaccaggtctgagttacatgcccacgccatgtgcactgcagctcctgacacagtctctcttgcacatgccatagtgtattgtaaagtgggcaggcaccgtatgtgcctctatgccccatccccagcaaatggggcagggtcttatccacagtaggaacttggggaatagctgttggatgaaggaatgaatgacaatagtttcacataagccaaaggattccattccttttcttaccttctgtgctttatttggtacatactcagtatgctgagtgtgatactcttcctctaagaacggtgctcaagcctcctgcagaaccacctaatgggtgtgtgtaaaaattggattcctgggtcccaccccagactactgagtcaggcagcatctcttgacccaggaagcggtactcttaataaatcacctgcaggtgattcttttcttctgcactttgagttgagaaccactgctctaacaggtgaataaacattaatataacaaattgcaatacagttgtagggaaggaagataaaggtatgccacgatagaaatacatatagggtagaattcattcatccatgcaacacttatgaagacccattgcatgtcaggcactattctaggcactaatggcagaatagtgagccaagcagacaagggcctggtttcatggtggcggggaggcagactaagtgaatttatagctgtgaattgtgataagtgtctgaaggaagacacgaaagccagtgttatgggtagatagcaacggccaggagatgggcttctcagaggaggagtttactctgaggatggaagagtgagaagaaagtcacctgtgtgcagtcaagggtgggcactgggaagaactgtccaaagagagggagctcatttgtgagagacttgccacaaggaggaaaagagcttgtccgtagcagagtggttgaaagggacagtggtggaagatgaggccaggaagagcagagatgagattgcacagccatgcaggccccatggagcacctgagatttcatgctatgttgaggggacagcaatcagaagccttgtgatgccatatggtgcagtttgcgcttcagaaacatcagttgctgctatacagagaacaaaccagaaggaggataagaggggagacagagtccagtgaggggataactcagtccaggtggcagtgacctgcacagacaagaagtgaactgcttcaagagggaaaaccaagggtggatcctgaaaaggaaatagaaatggatggagggccatgagaagacagctgggtggacagtgggagatgaccaaggaggagggagcagtcccgtccattctaaatggggtgtttggtggtgaagggccaggaaggtttccatggtggggacttgagagattagagagtggtcccaagcagactggggcaggcaggagaaagaggaatggacagaagggccttccttggagaggtttcagtctgacaaggttcaaagatgaatagtactctgaacagcaccttgataattgtaggtttataataaattcttgtcaaataggtaggtgtgccttagatagggaaggcatgcacacagtggttagcagtgtgaactgtagaatcaaaatacttcagcgtctagcttcgccattaactttggctctctgagcctcagtttcctcacctgtgaagtgggaatacagattgaatatccctaatccaaaaatccaaggtgttccaaaattcaaaactttttgaagaccgacatgacactcaaaggaaatgttccttggagcatttcggatttcggattttgggattagggatgcttagtcagtatgtctgatgcaaatattccagaatttgtaaaaatcagaaactcgaaacgcttctaatgccaaacatttcagataacagatcctcaatgtaataacaacagtatctgcctttgtggagatattgtgaggcacaaaatgatccatgcagggcacttggcatggtgcctgacagacatgagcatctagtgaatattggaggcagtgcttgttctaaggtacttgagcagtaaaatgagtataatatttggacttgaagtccaaatattatgggattctgcaagggagtcttaaccttgagcctaacaagttaggtcaactcaagcatcttacttatttgtgccatcagtttcctcatctgtaaaataagcaaatttggataatgttatttgtttctaaactacctcctggttttaaaatgctctaattccaatatgtagaatgttagcatccaatgatgacaatgtaattcctcatctatgcagtttaaactagatgaaccatgtttgctggtgtaatagctcagcagtggaaaaacagcatatacttcctggtctaatacctgaaagaaattaggtgtatggataacagcaacccttggctaaatctgactgtagacatgtcacctcatctaatagtaatatacaggactggagcgggaagaaaagacttgttaaagatgattatagtggactgggattatttcaagcctaattagaagaccattttcattctaagtgaagcaaactcagtatgttgacaatgttattgctgcaattcactaacgaaagtgtgctaacatgaatcayaggattctgaagtcagcattctcaggtagtttaaaaggatgaaggatttgaaatctgtcatttcatttgttgcagaaatatgaccaagataaccacccttttcttcagtgcctcttaacatgaagcactgaaattttttctgaccttaaaggtaaaygaaagttccaagcctaatcttgtattgtaataattataatagctaatatttactgcattcttaggtgcactttgcaactaaataccttccatatattctcagattaatctctgcaactcaaagaagcattttgtggctcaggaaccaaggttcagagagatttctatctttcctgagattactttgctaacaagaccactaaacacatgggtgtctttgttacataatttgggattgttggagcccaccagttttggacaccagaagccctctgtggtcaaacaagattaggtttatttaacttgttgggcaagaaaagtgcatacccatattgccacagtgaagagaaatgagtagatttgggcttgtgctgggtggttctagtagggatttagggaagcaagaacccattttcttttgggtgtcatcagaaagtgggatcaatttggtgtcttggtaatttttatctaagaggtgggaagattgaatagggacttagattgtcatcagtaaagaaagcagagtacctcatattagttggaagagggggacattatttattttgtggcacagagggttctcatacctgtcttggttcagacttgattgtggattgtttctatcttgttcttccatggtcacagagtggccttgtctgaaaattatttgcataagcaaatttttgctgagttataaacactcaaacagtatagcctgacctgtcaactctctgggctctgtttattccttttccttcttcccttccttcaactctcccttcctctatctagttcattagtagttaatttttgccttccaaagaataatcaaacaatctaggtccttcattcttctctgatagagtgttagcatagggaaggttttcagatccggagagatgtagtcttgaatcctaggtcagtcagttgacaactacttgactttaggcaaatcacatcatctttttggtctatctttccatatctttaaaaaatagaaatttattccattgtgtgaatgcaccagagtttatttaatcttattcacccactaaaggacatttccattattcccagtttgagtctattaaaataaagctgttatgaacactgcaaaaaaaaaaataggaatgataattacctttcagggtgttttgaaaattagggttaatttacatgaagtgattggaacacatggttcaatcacgaatagtggccaccattgagaaggcataaacatttgtcaaatgttaatttgcttatactttatatttctaacagcaatgaaaatactttttatacaacaaattattagattgtagaaggtaacagaaggtggggagagccaaactttctgaatgtgattatctactactgaatgttagttatatggtaaaacttgctatagttattgttttgtacatttattaaaaattacaataaatagataacatggtgctatgcatttaattagtgaaaagcacaagatcattttaaagttcttaatggttcattcctgataaatttttatgagatacaggcaagaatgctatacttacaggctgtgcagaaggaatgactatctgatgagggctataaagaagaaatggaagatacacaaaagctatttttattgtaggggtagaaaaagatcttgttaaatatttctgctgaaggtttgtttcttatatacaaggccaagatcagggttaaattagaagaatcaatactaaagttagttctgaattgtgggatggtttttgttttcatctttgtattttgctatattttcctattttccaggttttctgcagaaatattctattcatgattagaacaaaaaaaaatgtagtcttctaaaaatcctgtctttttctgaagttgctaggcctctcagccatggttgccaaaatctggacaccatgcatgtgtgtgtatgtgcgtacacacccacgcctgtgtacatgtgtctcataaaacatccttaagcatgagctagacattaaacagtcttggagattctagttcagaatttacctcaaacgtgtgaattatggaaattcatggttcatcacagatggttgggatgttgccaagatacatcctttagcacgcctctgtttgctttatgtgaacattaataactctgttccaggagaaatamaattgaaaagcatcctgtacatgaaaaaagttattgcaaatgactcactttttgtgtggttccttctctccctttttccctcctatcgtcactttagaagtctggccttcattttcgacacacagataataccgtccagtggttaagagcgatggagtctattggtctacccaaggtaagccttcacscactggaatctgaactagaaaggcaaaggggtagtacacaaacatctctttatgagcaatgactttggagactgggttatgttaatgtagaaatgagaaatgtgaggactaaaaaacatggaaagacctatccaaagtaacatatggcaagaactcagaatgagggatgtgcccagattgagagcagccaggtaaaattgtgcacaaaataaaggcagaacaagctatagctggtagataggtgagctatctaaaatagccaactccctttcttgtgttgctatttgtacataaagattctaagtctcagccacttttggtggctcatgcctataatcccagcactttgggaggctaaggtgagagaatcacttgaggccaggagtttgagaccagcctgggcaacatggcaagaccctgtctctattaaaaaaaaaaaaaaaaagaaatctcattgtattagtatacactttattactgtaaattattataaatttattttttgtaaattattgttattattatttcaagacagagtctggctctgtcgcccagtctggagtacagtggcttaatctaccacctccgcctcccatgttcaagtgattctcctatctctgcctcccaagtagctgggaacacaggcaagtagctgccccatgcccagctaatttttgtttttgtttttgtttttgtagagacagggttttgcctcgtcggccaggctggtctcagtctcctgagcccaagcaatctgtccaccacggcatcccaaaagtgctgggattacagggatgagctaccatgcccggcgtataaattatcattataaatcataatatcacttgtaaaggctagtgggttatagctcttactcctaaaatagatctcctaaatataatttaactcagcaaacattcagtgcttgttaaatttgaagagcaggcatcctaaagtctgtgagagaattaggcaagtggaggaaatgaggaaataattacatttgataaaaattgtagaactatttttttaaacttgttattttgaaataattatagaatcacaggaagttgtaaaaatagtacttctatgtttatccttcattcagctttcccctagtggtgacatctaactgcagtacatgttaaattgacattggtgtattagtgtaaactagactacagacctttttccattttcaccatttcatatgcatttatttgtgtaagtgggcatgtgtgtgcatgtatgtgtgattctgtgcagttttatcccatgaatagatctgtgtaaccaccaccacaatcaagacacagacacacagaagagtggtccttctgattgcatccctcccccagccctgttccctggcaaccactaatatgttctcgatctctatagttttggcattttgagcacaatatataagtgtaatcatatagcgggtatcctttgagtcacatcgtttccactctgtatatggtccttgagacccatctgggtcaatagcttgctcctatgtgttgcttagtatgtacagctattttttttttttttttttgagacagagtcttgctctgtcacccaagctcgggtgcattggcacaatctcggctcactgcaacctccgcctcccaggttcaagtgattctcggggttatcacttacagrcatgcaccaccacgcctggctaatgttggccaggctggttttgaactcctgacctcaggtgatctgcccacctcagcctcccaaagttctgggattacaggcgtgagccactgcacctggcctgaaatctgtttcttatcaggctgttagtttcaagtttaagaaaaagagtaagaaatagtatgtaggataaccccccgagttatcaagtgtaacctcccgagtagctggggttacaggtgggcaccaccacacctggctattttttgtatttttagtagagacagggtttccacatgttggccaggctggtctcgaactcctgacttcaggaaatctgcccgtctcagcctcccaaagtgctgggattacaggcatgagccaccatgcctggcctgtacagctatttttaaaaaattatttaggagtggtctcgctggaggtcaagaggataagctactggcttatgaagacctctgttgtgccaggtgtgcagtgaaaaacacccactgccacagaaacagaagattctttaaatgtaatttattaatgcccatttttaatataattgtgctcatatctgttttaggtcagtctcattttatcttgaaatgatcagtgtttaaattttgttctgccatttttaatcaaactattttctcttctcctaaaatgcccagaacgttaaatgctgtttccttctaggaactggctgtaatacataattcatatttctgsattgtgatttagcaactactaactagaggctggatgataaaccgattaataaaaaacgaatttaaacagaattgttttgtataaggcaacatcaaattcagataatttcattggatttgatagatttgatgtaaaccttttcaaattgtatgtatttagggccaaacaagtggtgttatagagcagattttattttaacattggtttttattatgaagtcattgatatattgcattgcaggggcaagagactgtactgagttgactttgatgtatcatatttaacttgtattccttcatttatcaatattaagtgcttactctrtgctcagtatcatgctaggtgccagaaatacaatgctgcataaaacattctggtgaatgataaattgatctcatctccttgctgaaggaagtcatttataatggctttccaggagaaatataaatataaaagattcttgtttaaagaaaagggaagaggcaattgtagttattctctgcttacataaaaaactttaaaccggtaatactcttttttgttgttttttgagacggagtctcgctctgtcgcccaggctggactgcagtggtgccatctcggctcactgcaatcttcgcctcctgggttcaagtgattctcctgcctcagccacccaagtagctgggactataggtgtgctccaccatgcccagctatttttttttttttttttttaatttttagtagaggcgaggtttcaccatgttggtcaggctggtcttgaactcctgacctcacgtgatctacctgcctctgccttccaaagcaccaccatgcccagctaatactcttctgaatttagggatcctcttctcattgatactttagtagcaaatgcattaaaggaaagktggaaaggctttttaaatttcttaggctactgccatttctttaagtacttagtaattatatattttgtagctcaagaaactttgcttctttcttttctcagcttttctcagtgaccaataggaaattgcacttgagtatcacgtactaccatatgatgcattattttagtttttgatgtcagtttttataaaatatttacttaaagtaaataatgtctaaatgattatcttaattttaaaagcctcaagcttaattattttttgtgtgtgcttaggaacagagaagtttggtgcctcactctgaaatctgtttcttttgttgatttgtttgttcgtttgttttgttttgagatgaagttctgttcttgtcacccaggctggaatgcagtggcacgtgcttggcttactgcaacctccacttcctgggttcaagcaattctcctgcctcagcctcccaagtagctgggattacaggcatgcaccaccacgcctggctaatgttggccaggctggttttgaactcctgacctcaggtgatcgcctgcctcagcctcccaaagtgttgggattatgggcgtgagccactgcacctggcctgaaatctgtttcttatcaggctattagtttcaagtttaagaaaaagagtaagaaatagtatgtaggataacctcccgtgacacacatttacctatgtaacaaaccttcacatgtaccccaaacctaaaataaaacatgttagaaaaaggaaaagagtgtgaaggtgtattcaaaactttgatgttcagacctttcagtctagtaatttcatatttagatgattatccaaaataatcagatgctcagaaaatacagaaatattcattgcagtggcttataatagggaaaaattagaagcaaaacaaatgttcaaccatggattaactggctaagctagggttcaaaaatataaacgaatcatatacatctattaaaaataatcttatagtataatgaaggggatgggaaataattgtgttctgtaaagtgttttaaacaggttacactaagtacaattttgttttcacatgcacacatatatataaacctaaaaaaatcagagacatacagaaaaaaagaccagaagaaaaatagggacaaaattgctaatagtgacaatctgggaggtggggtcatagatgtttttccttcataccttatatactttccagattttatttggtgaaaatgtcttactttaaacagattttttaaatgtgtgtgtgtgtgtgttgtatatgcatgtatacatgtgtacagagcacatatgccaagtttttaacaatgcaataaagtggctaataacaaggacacccttctcaggcccatgggacctctgggaagtcacaggagtgtgaaggctacaggaggcagagcccacatgtgctcatatgccctatgaaatgaaacactgccactagcactgtggacacagccttcttggagtagctggctggggaccccaccatcctcctgtggaccactaagaggcatgctgtcaggcaggggtccagatatggtgattggtctatctctacagcaagatgaagcaatggcagagaggttcctctatatttaaataattataggatagcaaggacaatcaaaatagggtcattttgggaagttaaaatacttgtgagaagcaaaacatataataaatattgtttcttttgttttccagatattttatccagaaacaacagatgtctatgatcggaaaaacataccaagaatgatatattgcattcacgcactgaggtagggggaaaatgcagctaaaaggtgctctaagaagtagatttaaataaaactaaaatttcaattttaaaagaggttttaagttactttaatagtttgaagaactttttattaaattccattgttttggatttgctggtacaaaattaaaataatggtcacatataagcaattcttgaacttgaaaaatgtttttctgatttttaaatctaactcaaaatagaaaaccagaaaatgattgaaaaccattaagtacaataaagagaaaatttaggttgaaacttctagaaatccaattgtaatgtactactatattcttgagttatgacctagtttacaaatataatgcagatatatcaaatgagcaactttaatagtcataattttggtttaatgagttaaaattataatttagttcaattcttacaaattaagaaaatagaggtaagaatggtttcttttgatcttctgttcaatagaatttgtaccctaaggataaagaagaaacatagtagtttggtgtaaattagtcaaatcaagacacattcattattttaaagcaattgttcaataacttaatttttgaaaatgctgaaattctgctagttcacagattacattttatcttattggcctggaagaaatgtgatttttagatggtaacaaagattattctaaaaatccagtttgtggctgttgtcttgaatgtacacaggtaatggttttggaagacttcatgtctgattaaattttaaattacttttagaacatctgccttgtgttttcatcactagaagtcattttcctggcagagtactctgcctagaggtttatgttgacttcttcctggctcttttcctctccaaaggaaaatgcttctacaataattcatggtggtgttggctttctagagaagaaatttgattatgtcatataatttgactttttcccccagtcagtacttatgggattgctttggaagatgacagttgctagaaatatagaccaagtgtaggtgcctttgctatgatttttttttattctagtaacttagaacaactggttaaaaaaagaaaaacagcaacagtaaaaacaaacctacttcatgctgccttctcagatgtggcgagagtatcattatgccacaggttttctaaaagctccttgtgcaaaagtgcttatgttgaggaatattttcaacttgtgttgcctgatattctttattaaatatttttctgatcttagaatgataacactatagttagtactgggtctatgagctgctaagccagccacgactagttaatgccattgctacatgtgtgcatcacagtgctaatctctagttctgtcgcatgctcgtgggctgtctcgtataagtttcaattgattttctgaaatagacaactgggacattcatgttaaggagcttataaacaaatggtatgctaagttcctttctggtgatatcatggttctcctaaaggagctatctagagctgcacttagacttacatgtgtatttgccatggttttaacaatggcttgaatagcttggtaaacaaagaaaaaacaactttttgtttattattaccaattgtatacaaatattgatgtgatattttccaggactgtgtttttcagttattcatcatagacatctccattacttttactcatcctggaggggattcctgttgggtcatgtcattcaccagatctgatcttaagtaggatattttatcttcaaaagcaatatttatttagtaaatagcattctcctcgcttttctttgttctaaattattgtatagctgcctctcactatggagccgagaagtcccaagtgtatcttgcagctttttccaccaaaacttgttcctgctatgatttaaaatgcagtcagtcactcaaaggaggctgatattctgctttgttgtgcaagacacatttgaaagctgaggaacaatcctctaataaatacagtgggtttgataaatactcttgctgcatagttagaaatgatgatggaaatgaactaacatgtcttcagcttttatatcctggctgcaaatacagcactgctgctgtatttgagagttgttattacctggtagagtaattaggcaggtcagagattctgattataactcagaagccagcaaggaagtttccctaggaagttaagcttgccaggcgctgccttcttcctgccccagcctrtgggcctgacttgatctaaaaagttagctcttagccctgaccaaacttgtctcctattccctgtcatcttgatttgggcttaacaacctaacttctgggtgcttatgcttgcttcctgtttgtatctgtgttcccctttgctgcctgcccctcaccttatcattttatttctgatcccagtctcgtgtcctaccactcaccaatccctgtgtcagtttagcttggtgttctcaagccagactccatgaacattaccacagcagcaaagggaggaaattctcaagcttcacctaatgtagacagactcaccttagcggtggatggcatcttttttttttttgagatggagtctcactctgtcaccaggctagagtgcagtggtgcaatctcagctcactgcaacctccaccttccgggttcaggtgattctcctgcctcagcctcctgagtagctgggactacaggcacgcactactatgcccagctaattttttgtatttttagtagagacggggtttcaccatgttggccaggatggtcttgatctcttgacctcgtgatctgcctgcctcagcttcccagtgtgctgggattacaggcatcagccaccacgcccggccacatcattctttttctaaagaaatgtttgtctttttctcattttttcaaaagtaatgtatgctcattgtggaaaaaattggaaaatccaggaagaatgttaaagaaaaagctaaaatacccactatctcaacaccaagtaaaaaccactgtaactattttgatatctttgaacttaaagtgtatactgcgtatggcatgttttacttttgtggcttcttttggaatgttataaagcctctgccttgaaaaggaaccagtttaagagtgagagccttactaactagttactatactaatttttaaaaaatatctggaggccttttacgtaagggtaagaacacttttttgacatgttgtttagtgcccaccttattaaagatgtataataaatgatattaaacaactgttacttgtttaaacagtcataaaagtgagttccttgaaagagttggaataatttagtagaaatgatgttttgagtacttcagataccttaaagagcaggtgaaatgcccaggtacgttattacaaacttactacactggaacctattctgtaagacccatactacaagtttcactcattttgtttattatttataactagttttgagttgtccttggctattatattattttgatacctacccagaattgacataatcttcgtggcaccagaaacaaaagaataccctttcaaacctgccatgattacagatctgggtttcggatggatcacttgtgagtcagaacatggcgcaactttgggttcttctcccatggcgagtcagaccctggccacaggcatcaggctaaactttctttgtttaaaaaaaaaaaaaaaaaatcagaccgcatttaagtacccggctttcaggtaggtctttatttacaatctggtccccacccctgccccccttccccattaccctgaaataatttactttcttaagtctcacttgaccagcattgtataatccattgtcctgtcataatgatgtattggcctgatccattaacattattaaaagcttatgtatgccttttaaatattttttttttaattagttgggctttctagaggttttcatcccctgggagacaagggattgactgtacccagtgatccttaggcttttgggctgatttatcatctcagatcatgtttctagtcctgcctccacttagttagtggatgtgaccaccagtgctggaccctctttctacccggtgtttctgtcaccacctatgctccttggttcttccttatcttggggcacttcctttgttttctgggactatttagtttactcaaagttcttggtctttattctttcatgtagtataaatagtataaaaatatctatatataaacaaatataggccaggtgttgtggctcatgcctgtaatcccagcactttgggaggctgaggcaggcagatcatgtgaggtcaggagtttaagatcagcctggccatgatggtgaaacctcatctctaccaaaaatacaaaaattagccaggtgtggtggcaggtgcctataatcacagctactcgggaggctgaggcaggagaatcgcttgaacctgggaggcggaggttgcagtgagctgagactgtgccactgcactctagcctgggcaacagagggagactccatctcaattaaaagaaaaaaaaaaaagcatggtggcacacgcctgtagtcccagctactcgggaggctgaggcaggagaatagacccaggaggcggagatcacaataagccaagatcgcgccactgcactccagcctgggcaacagagcgagactccgtctcaaagaacaaaacaaaacaaaacaaaacaaacaaacaaaaaacagatatagaagaaacaaagtacttgtgttttaataatgctccccaacttgttaaagtcaatataaatacacattcgctatttatctcttttttttattacaacttcctttttggacactgtatattattctcttgattattgttttgaacctgtggcctttctcagacttaaccaagattaatatctctttctttttgatgaaccagattgtttcagcttggtcagtctgagctctttctggcccacttccttgtccttctagcaccgtccctgacattctttgaaatatccttgctcgtggtcacaacaggatgttccagtcctatcctgattatttctgctttgagatgtggaaccaccactctctagggattcctcttaaaagtcatgtgtttatattaatttttcaagtttaaccttattagcttactggattctgcttttcttgctgtctagttcatttgaccattgagattcttctacatgggcagccacaaacggaagctatgtctgcctctcctctgtgataggattactcttcccgctgctgatactgtagctgtgtcgcagcagccatgttttcaggtgcaatggtgatgccatggctctggcagacccacttctggttcaccagccgtccaggtactctgggagctttgtggagtagagtttgtctagccagctcccacacagccaggtggctgtcttgcttaccaggtggcctttgaacctgctcctcaggcattaatgcataactttccttgtcttaacactctgttcccttagaaccttttccttccctaagaaactgattgaacccttatatcagattgattatatctctaacagtgaacatatttgcatttataaataagatttccaaagacagtttcttagctcaaaggacaggctctaatcctaggttctcagaagggatatctggagatggcagtatttggaagtaaggtgagggaggcagttgcacctgcttatttctttcaagtccttccttgctcagaattctctctgtgctctgaaccattcctttccctttcctcctctttctgtcctaaattagtatggtggttatgcctttctgtcttcctaaattctgagctcttaagagactatgaaccacatcttgttacttcatacagcttacgtgctattgattccaagttaaagtctctggagtttgtatatttaactcttcaggaggtttaattgaactaatttctctatgataaggctacctcaggattcctttggtttggggctgaaaattaggtatagaaccctggattttgatatgatattggcagtgatatatgtgactaagatggaaaaatttggttcagtaaataaaactatttcaaacatggagtctgtggtgaaatagagattcttggcattggaaaaagtaagaaaaccactttgataggttatcaataagtgtttgtatacaaaggacacatttatttaacaaagaatagtaagaacaaaggttaacacaaatggagcttttaactatgtgcctggcactgcacaaaatactgtactggtataatctcattttatcttcataacatatctgtgcagtggtcactattattactcccattttatcaccaaggcagttgaggcacagagaggctgccgaaggtcacacagttagtaaaaaccaggatatgtgagaactgaacctgtgctattatgaattcagccagccaatggcttcaaaagaagtcaattatttccctacttctaagaaaattaaaagaacactggtatcagacttgaacttcagcacaggcctctcagctattatatttaacatgttttaaatgaagaatcatggaacttgagaaggggaagggccttgggaagttattgtagtctaagtcattcatttcacagataagggaactgaaagcttgggttacgtgacttgctcttagtcacacactgaggttttaccagttttgggaccaggattcagcgcttctggattctagtcctgtggtctttctgctctaccatgaggctttgatatacaaacattcattccacatgttatagtacaaaatgagctacacataatgtgatccaagaaagctgaaataaatttagctcctgccttttaagtttgcatttcattacgatagtaccttttagtgtatatcctgaaagtatagaaaaaactaataccactagttttatcttgaaagtggtagaaaaaactaatgccatgtgatattggcagtaatgtatgtgactaagatggaaaaatttggttcagtagataacaahtactactactactactactatatactactttcatgatatacactaaatggtattttttaaaactttctttattgcttcctggactttaagtgatattatttgtacaagtaggagcacatgggtcaatgagtcggtagctacctctgggcaacccctccgttgctggcctcactcagctgcacaggtgtgctgtagcttttggtgtggtaggaggcttgctacctcacaaaaagtgctctcttagacatgagaagcaaaggtgacattaattccatgacttcctttggaatgctctcagccctttgacttggctgttaggtaccaaacggtgcttaataaattaactgttgaagagctacatgagattggcactttttctattcratgggcttttttgttttttagattaagacttgatttcctatatacttcaggtaataagcagcctcatttgaatttaaatgcttgggaaggaagtttgctattgctgtttcttttcagcatgggaatactgggtaaacacagtttcctgataaacatttgcccgtttgagtaatcrgctgggaagcacctcccacacagagattaggtgtaaaacgcccataccatgaaaagtgatctttccaaagctaacagtttaaacctcaacatcaatgatttaaaaaaaaagaaaaaaagttgaaaattgaggccaaacagaaactatacaatattttttttaattttttagtaaatgagattttttgatatatgcaaatgagatctttacctgatcaatattagcttaagaaaatatcagacttaaatttaaaagcaaagattcttccatgttcagaaagctaacttctcagcaccaccttgtggtaacttttacttaagccaggatgtttgtttattgtaagatttatattaatattacattgtacaatggagaaattaaaartgtaattggaaatagctatctaacttctttatcatcaaaggggaaaattaacagtttagtataaacattttacttcatgttatcatcaaacctatattttgtggtagcctaagtaccttaatttagggatagcatggtagagaaaattttttttttttttgagacacagagtcttgctctgttgcccaggatggagtgcagtggcacaatcgtggctcactgcaacgtctgtctccctggttcaagcaattctcctgcctcagcctccctagtagctgggattacaggcgtgtgccaccgtgcccagataatttttgtatttttagtagagatggggtttcaccatgttgaccaggctggtctcgaactcctgacctcaaatgatcgcctgccttggcctcccaaagtgctgggattacagacgtgagccactgtgcccagccgagaaaaatatttttatataggagctgttccataaatagtaattaaatgaatgaatggataaacagagcataatgtgaaaacagttgcatcaagatcattgagcacagctgtcttatcccctttccaaaactaacatgaaattaactacagtaataacttttaaaaaatacatttgcgataaaaatgccatctactaaccagaaatttgaacaacccctaacatgaagtaaacagacagaattcgattgactgagaaacaaactgggagaagatcacagcccacaaaacgctgggggttgcagcagaggtaggagctgtcgtgaggtktgctccaagcaaaggggacagcaaggaaaagaagagcctcaaagtgagcaatcgtcagcctaggaccagcagaactatatggcccttccctaaagcagcaagtgtagatgctgatagcgggatagcatgccggtacccaagacagctaatgacctcaagaaggaacagagagtccccagtctgagaaggaaagacactggttcccttctggcgtccgttccattgctctctacagcttcttaatgctggctcctgacatgcggatctgcagtgaatgaccaacaaacagcaagtctcaaacactaagatgagtcccagatcagaagatgtcagacatttgaaggaaactgccactgaaggaagcattagattcaccaaacagaaccaagacccaaggaacaaatgaaaatattaaaatatgtgcaattgatgattcattcaatttatgttcaacaaatatttattgagcacttacatttatacacrgaagaaccaaagataaaactctaagaaggaaaatttggtatagataaaatcagaaaaacagttaataaaatttgtagatatctaaattattggtggatataattaaaaaagcatgaatctaaaattctaaattatctcaatattccacaggtgggaaagttagaggtggaagcatctaaggataatagataccaattagtttaggctttgatagaaaaatgtaaaagtatattaaaacttcagcaggatattagtataggtaatatatattaaagatgcagcacattaagtacttgaaataagtataaaatttgttgcttgaagacattttatggatgtctgcttacattttactgtataacattttctaaatttcactttttttatagttttctttgtaaattaggtatatttttgaatttgtaaaaagaggaggaaagtgcaaatcaggtagtatgaaagaaattgaagtgatacaattatacatttttgattatttgttcatctattctcatttctttttttctttttttctttttttttttgaggtggactttcactcttgctgcccaggctggaatgcaatggtgcaaattcagctcaccacaaacctccacctcctgggttcaagcgattctcctgcctcagcctcccgagtagttggggttacaggcatgtgccaccatgcccagctaattttgtatttttagtagagacagggtttctccatgttggtcaggctggtcttgagctctcaacctcaggtgatttgccygcctcggcctcccaaagtgctaggattacagtcgtgagccaccgcccccagctatgtattctcatttcttaaatgatggcttgatctccattcaccccccaaattcttttgcagtttatcttgcctgttaaattctgtttaattttgtcgttcccattactagaaaggagcaagtgaagaggttgacatttcattgttccaagtaatatgagcacccttttaactggaattttttccctatgtaataatgagttgagaattggttcataaaatattatggttttgaaaatgtcagcatggtatcttaatgatctagctttaattataatgacttgttggcatgaacctttggtagtaaagtcttcagaggctgtgtaaagtaaacagttttatatccatgataatgtctaaagacctagaactttaactaaggaatgtatcctctcttgctagtttgggattatgaatacataatggctatttcactttgaagaatgttcaaagtctaatataaaactttttcctctgtggataagatataaatatcacattgaaatttagtattaaaactaatgttacacatatggtaaaaaaaaaaaaaatgttctttgtcctttgctatggttttaaaggaaaagcaggaaaataagaggcaaattcttcccctaaaaattctttaaaattcgaacattcattaataggcatttcgtggaagacatatgaatggccaatgcatgtatgaaaaaatatttaccctcccaaccaccataaggaaatacaaatttaaataacatcttgttgctatcagttgctagtcccttgaaagactttattgataatatcctgtggtgataaggggacaaagaaaatggcattcagatgtattcgtggtctagtgggccatgcccatcggggttcttaggtttagctaaatattcagattgacccacctgtcataagccacatctggcacctgttgctcagaagagaggtagctgggatagccagcatgctggcaggtgttgctcttcagtgggagcctgcgtgacactccacttagttgtccatacaaccatctggaagccaccattcttggtaccccaagatacaactttgctgctaagaagtgggtttgagccttcctggcttgtaagcctcgtgcccccaggagccaatatctatagtaacagctgtactgcatagcttcccagttctctgcaaagaacataccagttataaaagtcattgaacccaggaaggcccaaagatatggtacctattaggtatttatggttttttctctcaagatacaatttatcaattgggttattttttcctaagcaatgatgcttataacactgttgacagtataggttcctaagagaacagagctagaaagttaaccaaaggtcaaattctcatataaaaggaaaaagggtgttttttaaccctttactcataaagaataaatgagcataatctctttttaagatcacatttggacagtaaacattgaaaacttttattgtgtgtgtaccctttcaagctggcaattttgttttcatggctttattgtaacaaatacgaaatatgcacaaagatgtgtctgtgtctatatgtaagtaggtttattaagcattatttgccatagttattaattaataacaatctaaatgctcagcacttgcttaagaaaattatagtacattcatattctagaataatatatacgtttataaaataggtatgtccagaaacaactttaaaagaacatatataccaaaatatttagtgtgtaactgagtggtgattttctgtgtaattttttaaaccataagccactaattttttactttgatcatgtattacttttctaaataattgctcttcataaaaattaccagaaaattggccagacacgatggctcatgcctataattccagcactttgggtggcagaggtgggtggtcaggagttcgagaccagcctagccaacatggtgaaaccccgtctctactaaaaaaaaatacaaaaagtagacgggctctgtggcatgcacctgtaatcccagctagttgggaagctgaggcaggagaatcgcttgaacccagaaggtggaggttgcagtgggtcgagatcacgccattgcactccagcctgggcgacagagcaagactctgtctcaaccaaaaaaaaaaaaaaaaaatcagaaaattattgtcagttttaatgcaagctacttacattaaatgactaatcatacattttaagagtttgttttaataccattaaaaaagcttgatcttgaactttcttaatgcatttaatgaaattctatgttctataaactatggagcttcatctcacatcaacatctgaagtgataattttgaagtatttcaagccataaaaatcattcagttcactttctcatatatactattacttgaaactatgactcagtgataaaagtggggaaagcacatatattttttatagaatttagatgccagctctcaagttcttttctcaggttatgggtaggttaatggatgccatcattactaccttatggatttgtttttaaatacatccaatttattctccatcttccacttgggtaatatacacacatcatagtttaacattacctcacccactgatagtcttgccactctatttattggtttagaaaatgtaaaacaaatatttcctcaaggggtatgtggtacttggaggaatattaaaaagcaaaatataattcatgctgtaccttcaataaaataagaattatgtgaggaatattcaaagaaatgtttattgcatttgttacctgctgttttgtattagctgtgtttcttgttctccatacaaatggatgatgcagagttagctggctctgtagaagtgctgtagaagtggattacagtagaagaccagtctttgggacacagattggaattctgatcctggcctcaccaagtactctgttacccagagactcagtttcctcatttacaaaatgaatagactagatatctcttaggtcttttcaactgaaaaaactattaagaattatgtaatttataacattaagacttatgatgataaaatttctgataattttgtgtttttttctttcagtttgtatctgttcaaactaggaatagcaccccagatccaggatttgttgggcaaagtagacttcacaggtactactctttatctttgtaattttttacaatctagttataaaaagtaccaatacctggccgggcgtggtggctcatgcctgtaatcccagcactttgggaggccgaggcgggcggatcacaaggtcaggagatcgagaccatcctgactaacacagtgaaaccccgtctctactaaaaaatacaaaaaattagccgggcgtggtggggggctcctgtagtcccagctacttgggaggctgaggcaggagaatggcgtgaacctgggaggcggagcttgcagtgagctgagattgtgccactgcactccagcctggacgacagagcgagactctgcctcaaaaaaaaaaaaaaaaaaaattaccaataccttttttccccattttgatattattgatttcccttattcctgtatattgatgagaagagaaaacagacctatcttgtttgttcttgactgagttctccttctccatgtttgtgaaatgagaaacttgggctaggttcttcctaaggctcttgtttacaaacarccccacttcctgatgaagacatttcttgatatgattgtactcattcctgcatccatctctgtctgtagctttctctgataatgattatgattattttgttctttgttagaggaggaaatcagtaatatgagaaaagaacttgagaaatatggaatacagatgccatctttcagcaaaataggtggtattctggccaatgaacwgtccgtggatgaagctgcatgtaagtccattcaaaatccaaacttgccatggatgtgagacttacctgtactttacctattgattttgattactcgaaatagaatatttagaagatactttaagcaccctaaaagtttttattatttgttttatagatgattaatttgaggatgtcagaatataaccaagtaattgattttggtctttagacttctacttgtacaacatgaattgaggttctagaaataccttcattgtccatagttctctactttctgtgtctgtagattttagtggtagagttcattgttacaggtcttttagtattgcaagctaaattgcaagtatttcttggaaccaacatgttactttaaaattacccatgtcgccctgaccagagggcaaggattgacttaccttctaactcctgtggttgacatagggcttgcttcattttagccattcagtgatgtataaatgagtcagaattacttaacagatgctgagatcaggaccaaagacagccatgtggagaggttgtcaggtgctccataatatgtctcagttctctttttgacatatttactggaagccaagaaagaaagtaaaactgcytgagtttacacagggtcartgcaactgtccatgttgtcttttgctgataaaaacctttttytctctctctctttactttttagtacatgctgcagttatagccattaatgaagcagttgaaaaaggaatagcagagcaaaccgttgtaacactaagaaacccaaatgcggttttaactttagtggatgacaaccttgcaccagaatatcagaaagaactctgggatgccaaaaagaaaaaagaggaaaatgcaagactgaaggtgcttagattctgastaataaaaacagtaatgaatgtgcttatgagttactagtttgaaaagccttaatgttgaaagcaatacttttaaatcaattggctattttctctatagccgtagacaattgatttgaatgaaatgtagcatacaagaggaccatacactaggtaaggcaattagattatatccctatataaggcataaaaaggaattttatagtccaggcatggtggctcatgcctataatcccagcactttgggaggctgcagcgggagggtcctttgagtccaggagttcaaaacgagcctgcgcgctatagtgagaccctgtctctaagaaaataaaaataaaaataaaaaattagctgggcttggtggtgcaagcctgtagtcccaactactcgggaggctgaggtaggagaatcacttgagcctgggaggttgaggctgcagtgagctgtgaccctgccactgcactccagcctgggcaacagactgagaccctctctcaatttttagaaagggaattttgtgatggatgttatatattgacagaattaaaagtcatgttgcaaacttactaatgtccccaggaagtgtagaagtagcaactcatgatcatcccttgttagacatcaacagaccttacattagccaagttacttttacatttggtagtagaggttaataattcagtgtggtgaagttcagagaggatgtttttgaatctacagtcttcatattttcccaatagtcaatcctttatatttgaggatgtccctcctgtacaagacagcctgctcctaatcgtaactccatttgtaaccacctttctgtgtagtccattattgaaaaatttgtctacgctgagagcttctacttcctcaccagcttgtctctcattaagctcttgccatgtcagtttcagctccatgactgaaagtaaccactttaggttttggcattttctcaactggtggcttccaccagcatctggcagggttggcctcctaccttgagattctctgcttcactagcttatgtgcgtccttgctgccacagttctcctctgtgcctctttctcctcttccttctccctctcagtatggggattcttcaaggtctgacatggaatcccttctctgttcttcttccattgagctcatccacttgttgaagaaatcagccatcagctttatgccagcccatcccaaattggcctctctcctccttctccagataactttgtctgtgtccctctggctttgtaccccattatatcagaagagttccccttgctgacttccctggttcagaatgatggccgggtttgtctcagaactctttttatgccccctgtgtcccatgcattgctagattctgctgcctactcttgttggagttgaatctgtcgccaaccttctagtctcaccagtcttgcctcagtcctgccccttctgacctcattgcatgactcttctatcaagcaccttccttgtgggtctctctgcctcctgttactctctaagccaatccctcttaaagctagaggttacaaaactgatctttaactacaaatcttgtgttaacccaccagagacatgccccgattctctattacctactgaattaaataccaaatcttagcttagccttcagctgaccccctcatctttttggctcaccatggacacactccaagctgtagcctaatgtgctaagctttccatctgtgtaaccaaatcctgctgtctgtttcctattcttgacattattctgttgctcgaagccctcattgattatgatctctttgcaaaattttcttcccaactaagtatgaatactttcttaaaaaatgcttatagtacttctcttatagaacctattctgttcttctaggtatatttattacttgtgttcttgattttattagatcaaatcaaatgaaattggcactattcaactgtttttgatctaaaaaaagggcaataccaagtggtccaaactaatgttttccacatttgaaaattagcccttttcaaagagtcaccgggtctgtcattcatctttgtagtctttgccagcattctcccctagtcccctgcacagagcaggcactccacaaatgcttgcaatgaatttaaataattagggaatggtttttgtcactcttcacatttttccatttgaatttcragttttggaaatattttatttaacctcagaaatcagtgaagactttgttttgcagaatagctgtatttcagaagaagaaagagatgcttatgaagaactgctgacacaagcagaaatccaaggcaatattaataaagtcaacagtaagtaatggatcgtatgaaggaaattgatatttccrtaagatacagactttccttgccagaatcccaacacaactctcaatttgtatacttggaaaactgccttatacaatgaaaaatctactcagtgtcagtgttgctcttaattatggtgcagcatttggcagtttcccactgggctttttttggtgatctcagtccacacaaagtatcctgaagctagtttgattctaccttcctgtttcattacattccacattttaattctgtcacttttggggctaatactgaaggtcatttagtaaaagattataatttacagattgtagttgcttgcccatgattatgcgatgatgttctattggaattgtaaaaggtactattgacaccactgctctctgtgacttcccagccattagtctgttgtttgtaagatttttcttacacttgtgtaactttggtgccagtgaatgggactatggacaggccagatgaaatctcatgatggcagctttgagtcccacacccctgagcctctgtggagtcaagcagatgagttcctcttagtacctggctcaagtgtctgattgtaaagaacagcagactcaggtaattaaaataagcgtatgcaggttgagatacatcaatttttttattagtcttttctcccctctggcaaaacctatttttacttgagcatcagaagagtcagtaagaaatttcatttgatgtttatttttccctggtcaatctagataatccatatatacccaaaaaactaatacatgaaaggccatttagcctgcttaataaagcatgtgaactccctgcgaaattaaaatttggagtatccactaattacaacagtcctaaaccttgccttccttttaacatcctcgttgagttttgaatattcttttttgcttgtaactcttgcaaagaagtgtacacccacggtgttactaagaagtctgctcctaaattgctggagagaaatatcctaaggggctcaaacagtaattaaggaaagccccagagggttaatgtaaatgtctaggagttaacaactgaatgtgtttgagaatatgcctcacatacacataactgggctgaaaactctcaattgcctttatttttttaaggtaacaccttaacattttagggtgcatgtgcctgttgttttattcttgtgaaatcttgaacatgttactgatgatacatgaagtacaatttaaagtttgtctttttgctctatgcgaaagctgagaayttcgtgatgcttgacagaaatgaattacaggaggaaattaatgttgccagtgagacatctgaggtccataagcctagagaggaaatggctccatagcctttaaccatcctttatttttgaaatatttataaccatgaaaacagttttctttttcatgttaaataaaatgctttatataaatgttttagttctttactcagtgccataatttcctgaccrcaaatttaatgccaaattggctatactttttttttccatttttaagtaaaaggcattggatgttttgcactaatggtaaaaccggctgaaaatatgaaagcaaggtttgatggctttaaatgtgtagaacatgattattctgaagtctttttatctctccccatcttaaaatttatagtccagtagaactgaaagtaaccttaggaaaaaaaccctcattttgatgacatgacaatgagacaattgtacactttaaaatacgtaagaatcagctgggtgcagtggctcacacctgtaatcccagcactttgggaggctgaaatgggtggatcacgaggtcaagcgttcaagaccaccctagctaatatagtgaaaccctgtctctactaaaaatacaaaaagtcagccaggcgtggtggcgggcatctgtaatcccagctacttgggaggctgagacaggagaatcacttgaatgtgggaggtggaggatgcagtgagctgagattgcgccactacactccagcctggatgatagtgtgagactccatctcaaaaaaaattwaaaaaaaaaaagtaagaatcattactttgacaagattttcctcaaccatgtaggttattatattaaaatgttaaggcatccacattcatagcaaccatagtaatagcatcagtgacaatgttggtggtaatgtcaacagatctgttgttagaggcctcagctttgttcacattataaccctttacctttcaggttcagcaaatgcattccattcattgcatgatattttctgttaagatcagagctggacattttgcatttctttgcttttttttttttttttttttttttttttccggacagggtcttattctattgcccagtctggtgttaaactcttgggctcaagtgatcctccttcctcagcctcccaaaatgctaggattacagacaaaagctaccacaccctgcctggacatttcgttaaatgcagagtgtaaaagagtggttgatcttaccttatttttttagaagaaattgtttatttaatagtgtttttcaggctaggtgcagtgactcatgcctgtaatctagcactttgggaggctgaggtgggaggatgacttcaggccaggagttcaagaccagcctgggcaacaaagagagactcagtctttacaaaaaaaatttaaaaattagccgggtgtggtggcacacaactgtagccccagatactgtagagactgaggtcggaggatctccagagcccaggaggtcgagactgcagtaagccaagattgcaccactgcactccagccttggcaacagagcaagactgtctcaaaaaaagaaagagagagagagagagagagagagagagagaaaacagtgttttaaagacatgattttctgatgtttgaaatatagctgtacaaacccatataataaatttatcaaaggtaaagcaagatcctacctagagtaatccgagatacagctgaaaggccttggagtaactttagcagaacagcaaataccacaaacaaccactagccttcctttctgaaattttttggtttgtcacattaattttaaagatagaaatgctaaggttctcagggtcctttaggttaagtgtgagttttctgggggatgacttgaaggattccattaatcataagtatttcctgttattgaattatatctcttagtaaaaatattgagggaagatcctcgtgaatgtatttagagaagataaattgtcatcttgtcaaaaagggttagaagaatcttagctgcaatctagtcacgaattaggcagacaggctaacccttgaaaggctctaaaaatgtatgggtatgtgttacttctgctacccagatgccttctctataaggcaaaactctgcaatctctgtctgatttgctctttcctggtggcagagttcatcattcattctcccatttactcagcaatttcatttttgttctctgaaaactatgctgaatctactgttccaagcatctcagtttggtaaccaaaattcatttctttataatctgcaccttacaactggttgagagatcacagagtgtattagtccattctcacactgctataaagaactgcttgagactgggtaatttatgaagaaaagaggcttaattgactcagagttctgcatgtctgaaggaggcctcaggaaacttacgatcatggcagaaggtgatggggaagccaggcacatcttcacatgcccaaagcaggaggaatagagagaagggggaagcgttacacacttaaccgtatctcgtgagaactcactatcatccagggggaaatccgcccccatgttacaatcatcttccaccagatccctcctccaacattggggattataattcaacataagatttgggtggggacacagagccaaaccatatcacagagtttatggttgtctcagatgttgcagcaatatgtccgagtgcttgctgtaggcttaccgcagtgcttatgtgttaggaagatataacagtagggcaaggcttgcttctggtcttcttgtcacttgaagtctccttggggagacagtactaatgcacaaggagcacagggaacatgcctgctggaactacatggcccagctttaaataactatggtgttcacatgatgagaaatccttaaggactggagcaatctgaaggcttcagggaagaaatgagaccagagctggtcctataaggaaggattttggaaggaagtcatgctactcaggaatgatctcataccctaagctccatcaatgctaaggttcttgtaggcactaattccaaagattggattagtttgaattactgagataacattttcaaagccttacctaccctctgcctgcagcttttcagagttcatgaaaagtaactgcttaggttcaaatccttgggaagaagggctggttgggtgagactgcagtggaaagagcaaccattctgacaaaacatgaacccccatcctcagggcaggctgcagtggaccatatcaatgctgtcattccggaaggtgaccccgagaatacgctgcttgcactgaagaaaccagaggcccagctgcctgctgtttatccctttgctgctgccatgtatcagaacgaacttttcaacctccagaaacagaacaccatggtaagtcagaggagaccccagctgtggggacggtaaccctgcgtgccatggcgcactagggaagcctagttaggaaaggggaatagggatcggggatctctaatttgtaccagtcctggtctcactggcccacctgtaccaattccaaggccttcttccttgttaattcttgcttttagtctacataaagaatctaagagcatagttaggaaattccagcagtggtctatacatatacctgtgaaaataggttgttcttattttctgtgtgatatttgaagacaccttggataaattttagctataccgatgtggtattttttttacaatatataatgtttttatgtagaaaataagctcaatctgcaattttagaaactgcaaataagaccattagcaccatggctttgatttttgtgaacttgtgcaccttaatatgacaacagcattcaacaataatttcatacaaggttacagtaattaagaacatgtttactaacactcttgtaagccaaacaatgaaacaaaatgaaaactactgaaagcagaaccaagaattcagcatataacaaggctcgtatttcaagaaggtggggaaacaactatttaataaatgatatccttgcaagtgtttaagctttgttaagaaaacattaactcactacacatatatcaaaataaattttcaacataaaatgttaaatataaaaaataatttaacaaattaaagttctaaggaaaaacacaggacagtcattggatctttaaagtcacaatcagcacttatccacacacaataaagagaggccaaaaacatgagcaggcaattcataaaacaagaactatacaaatgacaaacaaaaaaaaagtttaaactcaatcagaagtaaaaaatatataaattaaaacacagtacacttatgatttaaaattagattggtaaagattagaaagatttaacccagcgtagggatagatatggggcccaaacatctcctacacagctgctgggagtatgaattatacagattttctgcagggtggtcttagtaatacagatcaaaagcccatgatgctgacagttacgttctagaaaataagcctgaaggatatgaaccaaatagctttggccacagagatgtttcacagcattgtttagaatactgaaaaccaggaaacaaatgtttaattaataacagattgcctataaattaataacatttatggtgcttgtacatgtgagaaatatgtgcaaccagtaaaaatgataatgtaaagaatgactggaaaagatatccatactaatattaagtgggaaaaataagattaagatatatagcattatcttgttttttgcaaaaagaaagtgaagtcagttataaagacaaaacctctgcaaatgtatatatgaatttaaaatacataaaaggatatayacaaaagagcttgagtggtagcatttgttttcttattcttgcttactaagacttctgtattggctgagtgtggtagttcctgtctgtaatcttagcactttgggaggctgagacaggaggatcacttgaggccaggagttcaagaccaacctgggcaacataggcctcatctttacaaaaataataataataattaaaaagactccctatgtttcctaaatagaaatatagtatttgtaataaaagaaaaatagcttattttcttaatttcattyaggttctctcattaatattttcttccacttctctggctctgaagctcaaggctacttatgcttgaggacactcattcatcctcaactggccatagttaacctgtggctgtccarcctcatttcttcttcctctctccttaycctttttgctgtaaaccaatttaggtatccacggacaggtcactgaaagagatagaggaggtgaattataaacgattccattctgctcttataatttgatactttgtatgttaaacttgtatttaatgtaatatatttaaataaaatttacttacatgctctcgatggtaaccccttcttcccatttgctttgaaagattaaactatccctttttattctgaaatcagtttgctgcgagacttctgtggagatccagaaagatataataatgcattttaagatgaacattatgttatatattaaatacctgtaatatcctaaatgtaaaatatgtatcagcttttccttagtggttctttttcatgctcctgctccttatgtcccttcaatatgatgaaaaaaatattccttttgaagttgggccaagataatataaaatggttaaatggaagaagatattaaaggggaagggtgttctgaaatctaagacgtatttttttggataagctaaatccagattttaaatcatataaacctggagatctggccaggtgtggtgattcatgcctgtaatcccagcactttgggaggctgaggcagaagaatcgcttgaacctgggaggcggaggctgcagtgagcctagatcgtgccattgcaccccagcctgggcaacaagagccaaactccatctcaaaaaataataataataaaaataaagcaaaccaaaccaaacaaaaaaacctggagagctttacttgctttaccaaaagatcacctcagatttcttcaaatatcttgacctggtagtgtattttaaaatttctattttaaaatttatgaaaatgtcactttaactttttttgaattaaatcagtagtcttggtttgaagaccttgctttgtgcttcagattataacttttcagtgaaattctcccaaccttcccttaacccttaattcaaactggaaatcgttagctgtgctaaaatgttacctggcactctcagtcagtgacaatgttatctagtccttggcttaattatatggctggactgagcctttaagcaaccagtatagctaggagtagggatcagcaatgggaatgcagatatttgtggaatcgtaacttttcattgtaatcaacccagtcccaaaaaatgatcatctaatgaaagcccaggagccatatacctgttcttaaagccagtggaaagcaggtggccacgactcctctttctgctgagctatcaagttctttgactttttgttgtttgttgaaatgtgcattgtaaacctccatcatgcacatgaggtgtgttgtgtggggagcttatgttgccatatgttttccaacagaactacttggcccacgaggagcttttgattgctgtggaaatgttgtctgctgttgctttactaaaccaggccttggaaagcaacgatcttgtgtctgtgcagaatcaactcagaagccccgcaataggcttaaacaatctggacaaggcatatgtggaacggtaaggaacattttccaaaccttctttcaatgcagaaatgcatgtttggcagatcttaaaagtgaggaatttgcctgttggtggagaaatccatataccatgctcatgtttcttgaaaactagtctgttttaagagtccttctaattagtatccttgtttacagtattccttctggggaacaagaagaatcagaaagtgatcatcctgtggcaattaataaatgactttgtcgttggcaaagattatttgataggctgaaaataaaggaactattggaaacatacctttccttgggcgtcttttggaaaccgcagaatgtagaagagttggaagcaactttaataatcatccagtccaattcttttatgtcactgatgcagaaacagaatccgggttatggacctaaaattgggcagttgggccccaaactccactcttctgattattaagccaaagaaatcctgagaccacagtgggtcatggcagtgggtaacaacatccatttatctttcatttcatgtttctgaagtgtgctaccagatagtacaactgatagcattgttataaaacactatagcggatcttgagagaaaatcaaatggccagaattgggagccagatgagagagtcgctgagataaaagccccagttaaaatgagtgaatcttggattcttgtaaccaccagggggagatgtctgcacagatcttgacaaaagctcttttcagctactgattttggaacggctctaataggcaggttggctaattctcttgggtcatgtacagttgccaaggaaaaaccagagatttcttaggttaaacaaatggtatttgaccacttgtctatgtagtgaatggccaaaaggtaatggaaggatggtgggttttccttgtttttagtctttttggagaaactaattctcttgttctacttaaatttggccatctggttcatatgactccttagagtgtgtttccaaggtaatttatatctaccaccactgtttctgttacttgttaatggcaccattctctcctgtaagcttagaaacctgaagcccaatttgagtttccctctgccctcagccgggcaccctcgtgctctaaagagcctgctgtcagtagccagtctatgtgccttatacctctgcaagatgtttccatttccctgcaaccaccctcacttagacttctcacttttgcttctgtagtaacccctaaattggtcatcctacttcttttctctccccattcattaatcattcctacctaaccaggctttgccatactttctcagtgctagagtagaagacagacccggtcaatcccttatgaagcttacaggctaatggggcatcttggtgagataactgtcaagactattccacatatttagcatccctggcaactgtcctccacatgacattagcccctgactcacccattctgattatcaaaaatgcctgcttcttcatttacaaatacccttaaagaagtggtcccattctatttgaaaaccatattcatacctgtagtttccagctgggacctacagatggagcctcacagttcgagtgttctgtgtgaagaacttttaaaatgttttgattttttttttttaatttaaatacattctggatctggaagacccagtactgacatgggatttaagggcccacttgggttcttgtattgacacttgtattggccccaaatgatcttctacagccttggcattttacttccaaagtcagcatcttaacttgggatcttggaatcccagttttgcagattatcaagtttgagaaacacggctctgtccagggcctctccccatagagtgcaggttcttcatagcacaagtgtgctgtgcatggccaccttgacaaattcatgcaaagtctctccctgttcaccgtggcttctactcttggggctgtgtttgcccagagagattcttttgtctaattctcacaaaagtattgtatgggttaacattagccttgggcatacactgttcccagattaactgttctaaaatgtaaccctattcataattctgtttgattgttccttgttcacatccgaattaagaacagacttctcattctaagcatgttgctctgaccttacctccagctccatccctactcgtattttgtgctttagccaagtccaagtgtactttctggtctctgtgttcctatgcgtggtcctctcaccatcaggaacttggtgcctttacccagctcagctaaacacagtattggagcttctgagccctgcctaccatacattatgttctgtgaggtatatccgtgcttctccccaccctagcatctgatgttatctctcctgggaggtagcatgatgtggttaaaggagcatatgccttggaaccaaaaatatctgagattgaccctccctaactaagcctttttccttcatctataaagcwcaaaaacaaaagaaacaaaagccccactctgcatttgcagaactgttttgaggatttagtgtttggttcagtgcctgtcccagggagggtgctccaccaataagggtttccttccacttcttgctttgaaccccattatatctactcttatggactctttaatggtccttcctgtgctctgcttttatacctttttggaatttttgtcgtcttacccactggtctgaaagcataaaggctgcacctttttcctcctaatattcctgtagtgcctgccatgttttacatgtagtaagtgctcacaaacatctgctgaactaaattggattactgatcttctcagagcttcccagggctcttagattagtagactccttactagtctgtccatagatgaggtgaagagaactgagaggagtgagaggagaggacattgacctgtttggggaaactayggaatatttcccaaagttggtaacttcagtactggagagaaatactcaattggaaaagcctgtggagttctcttgtgttactttaaaaaaaawttttttttattattatactttaagttctgggatacatgtgcagaacatgcaggtttgttacataggtatacaagtgccatggtggtttgctgcacccatcaacccaccatctagattaggtatttctcctaatgctattcctcccctagttccccaccccctgacatgcctcggtgtatgttgttgttcccctccctgtgaccacatgttctcattgttcaactcctacttatgagtgggaacatgtgttgtttggtttttgttcctgttagtttgctgagaatgatggtttccagcttcatccatgtccctgcaaaggacatgaactcatcctttttttttatggctgcatagtattccatggtgtatatgtgccacattttctttatccagtctatcattgatggacatttgggttggttccaagtctttgctattgtgaacagtgccgcataaacatacaggtacatgtgcctttatagtagaatgatttataatcatataatgggattactgggtcaaatggtgttacttttaaaatcttttcctttatagcttgtttttgttcatttctaaagaaatgatgggtagttgtatttctttctgtgtttattttttactttctcatttcactcctgttgggtcagcatttagacgttaagtgtatgggatgcccataaggactttgcgcttttggaatggtctccatctgtgagggacactaaccagtgcaagttaccgataatccaaatcgttattgtggtcagtattatttattatacattactagtgtatttcacatctgcacttggcgaggcctcattcagctacagaaaataaattgttaccaccatttcctatttttgaatgtttttctctcaagctactctctatggaagacaccgcatgtcaccttgaagcatgcagaattttgaaaaagtttgtcacaaccaagaaaacagttttagacttcatayaatgtttcttcttttaacctctgccattactagatccctagagactattcagaattcaaactgcagagtgactcattatgtacacagaagattgttcttcattgccctggtgcaaagacataaaagcacactaaactatctagttttattaattttcgctggaatagttcatgttagcctatggttgtaacattggttctgtgaaaattggaaagtgggaaaattgataattgagaagtaaaagtttcttaatatatcagtatgagtaagtttttccctgaaatttccccaggcagaaaaaaagtaattggagtggttgactaaactgtatcttccagagggctatgcacagtgagaagggtcattggtcataaacaatgggtgagagggccatttttaattttaattttatttttttatggagacagagtctccctgtgttgcccaagctggtctttaactcctgggctcaaacgatcctctcactcagcctcccaaattgctgggattacaggtgtgagccaccacgccaggcctaagagagatttttgagtattggctaggagcctttggagaaatgggcaggtgaaaaggaatttcagtatatcctggtttaactcatgtgccacctcttcaggacaacatacggtaaagattgtgctactcagcaaggtttctggaactgcatttgcatgttatctgattcctcagtgtcatattaggcctcaaagtggctctatattagggttgtagtagaaaaggtcttttaaaacttagattttggaaggaacaagagaaataatgaaaaggacacttgatgatagaaagattgagacccatagtaactctgaattttgccctgtaacaatcatctgaagactgagaagaaccaagacatacaaaggggaggaaaattagtaactagggaaaagtaatttcacagacttgaaagtttccagttttgcttgagttaggtatgagtttcgattttgaagagctttcattaacagaatttgttcataaaaatactttaagaaaacaccattagtacaagtaagcctggtatatgttgacagagctacacaagacaattttatttgcctttctactctttgtctaacttcataacaactatgtttgaccatgtgtcatagttgagaaacaacaggaacgaagaatgaatgtctctaattaacatcaagattattttctcttccacagttatgcaaacacactactctctgttaaactagaagttttatcccaagggcaagataacttaagctggaatgaaattcagaattgtattgatatggttaatgctcaaattcaagaagaaaatgaccgtaagtataagacactttccttctctagcatagtgggagaagaaggtatctggacaacttagttttctagattagggctttaagtttttgctcaaggaactttgtgagagcaaactccgctaatatgcatacctttatttataggtagattttatgcctataccactgtaccaatatgttataaacgttacaaagcctacacaagaattcataatataataaaatacacaagtaaaaggcctgatttttctggttatttgtacttcagagacagctaaatacagagacagctaaataactcatatttttaagcacccaattttattttgaccttttatttgggcatctttttttctgaaatatgacacgatttttctgccccacaaatggaggaattggaacacratctaactgttgcttaatgatcacaaatcatggtgatttgctgtgtttctagaaattatgagctgccagcatgaaagcataccaacctcaggaagatatgccctgaaacatgctttcttgaatgtcagcttgctgctttatcatttgcatcttgcttatgaaaatagagtgaagaatgaggarctatgtagcttctgcagtccatacattcactgcttttctgtagtatgcattaccaaattcaagcttcgagctgtgttttccaccatgaaaacaaagcaacaccatcttctgtggcttatgagcttttgacttgtcagcaacagtgggtgagtgttgctaaaatcattgatctctcctccaccttccagctttgacttttctaactcatttgctccaagctcgcggatagagtgggcagatacttctctcacagtttattatgttttattttagtgtgtttgggtaaggtcttaggtctggtcttctaatgctgtatttaacttaggaatactaagatcactcttgaaataaaacatatgactttgttaattaattgcatttgcaaagttttcttctttttctttgctgtttcctgtgagtgctgggccaaaagtcaaggccagttttggttcttgttttttaaacatattctcactttaagcccctactataaaacaggatccaggtgtgctaccctatatacggtaccatggatgtaccactgttacactgatccctggacactttcattttgtccttttcaagttgtgcacaaatctaaatttctttcgagacggcacagcttccctgttgcctctgcatttcctttcagtgaagcatttaaagtctctgcggtgagacggcttgctcacaccccacttagctcttttctgatacttggcttgggagtttatggttcttgccagacgttagtcaagacgcaagctctaatttgagcagatgttcaacatcatcaggtgggggttgggggaccaccactgctcctagtgtcccgctacagagctcagtcccccaggcttctgcccttctccacaacctccgtcttaatgctctgaatctcctttagcagtggtttggttgctacagcaactgccacccaagaagtaggactcctttcttttggtaggcaaaacaaagactcacgtcccatctttgctttctaactttttccccaattcttggcaatacccatgcttcagttctgctttggttatttctgtatgtgctgcttacacaaatgaaggtatgttagttctcagtgctgaaagattgtagggttgacattgattaacagggggaaaatgccagttttgttcttggctatcaagtacagcctttgctttagttggttactggggggaaaaaaagcaagtaacatttgcataacttagaaaatagtcttttgtaagtagatattatttttaagcaaaaatctcatttgattgctgtggcttttatctatcaaggtaacagcactactaagttattctccctaggacatttcacacagccactataacacttctgttaagtatcttgtcataaaggacatataccataaccagaaaaggtatttcagacactaatatttcctttctggaatttgggaactttaatacagagtatttaatttatctgtgtcttggttttatttttttcttttgtcagaatgagttcctgaagtattgagtttgatatcatgtttaggcaattcttcaaaatctaaaatttctaaaatacaccattgtaaccaggcaggaattgctcagtatagtaattaagtcatctgaggagctgagaatttttcatggacgttttgaaggtgcattactcttgcctccccaccttattcttgccacatgctctgagatctaattccatatctgagttgtgatgtgggtgaggtaagcagctaatggaaaatgagaaatatagaaggtgaatttaatggagaagctagctgctgaatgcatttcctcaggctctgttgatttcttactgaaaagtttacttttcccagtagaaccataaaggagcattattttaaccttatagcctacatcaggaagttttcttctttgagtttttgctctttaaatttggtaggtacaattctgtgtaggttacctcatctgctgcctcaaatacatgaactctaaaagaacgcccactctcttgtggactagaatgttatagtaacatgtgttgatgtaaagaagtggaccgtgggctgagtgaagctcagcaatctttcttcaaataggatttcccttttatttataaacagaggaagtgatgcatatgttcccagagggcttctgggtaatctttcagctcctatgatgtcattcactatgacctcagcagcttgtattcttagaaacgcagcagacagcaactttagcaggtgatttcaatcaagtcagctgaaatgcactcacttccaggtgatcggccttggttctgttaagaccatttttggatggggtgttttaaaggtatttagaacagcttacccaaggggggtgaccagagaatggcactaaatattccatgcactccagtttataaatcctatagggtaaaacgacagtaccttgtatatagataatacttagactttccagagttctgtcaatgtttacagataatataacctgcacattagagaaatacttctgctttttcttcaaacatatttaagtattatagtctggaatgatttctaggagttttagatggtttcattcttcttacaggtaaatcttttcattcttaacgaagtggtggttatgggctcatctattcaagaaatatttagctaaatattttatctttacttgaatgtcaagctggagatactttttttaaaaatgagaagtactcattctatttcatggcatatcacagttgtgaagtgacgggtgatcattttagattaaatctaatggaaaaaatgagaaatatgaagtttgaccttaaaaatgcttatattctaagcttattgttcattaatatctagtttctttaacagttcttatccatcagtactaacctaggaagcaaaagctccttggcagtgtgtgtatatgtgtgttttatatatatatgtgtgtgtgtgtgtgtgtgtgtgtctgtgtgtgcatgtctatctaaatgcatttttttatgaatggatgatagtttattttttaataataaggtattgagaagtaacctccagatagatccgtttcattagaattgtaaaagcaggtttcatagtttgacttctgtgcttttcatttgtgaaccctatagtcagtcttgttctctctttctctctctctctctctctctctctctatatatatatatatatatatatatatatatatatatatttttttttttttttttttttttttttttggtggggggaacagagtcttactctgtcacccaggctagagtgcagtggtgcaatcttggctcactgcaacctctgcctcctggattcaagtgattctcctacctcagcctcccaagtagctgggacttgaatagacacttcatttctttaaagatgatgtacaaagggaaaataaacacatgaaaagatgctcaaaatcattagtcactagaaaaatacaaatccaaaccacagtatgataccacttcacacccactaggatggctgtaatgaaaaagacaataacaagtgttggtcagaatgtagagagctactcaggaggctgaggcacaagaatcacttgaacacaggaggcggaggtggcagtgagccaagatcatgccacagcactccagcctgggggacagagcaagaatctctcaaaaaaaaaaaataaaaataaaaaccagcagctgggaccttgatagaagttgcattgaatctgtaggtcaatttaagaagtatttccatcttaacaatactaaatcttccaattcatgaacattggctcttttcatttatttgtctttaagttttttcccatggtgttgtatagttttcagtgtacatgtcttatgtttctttcattaaattatgtctaaatatttatttataattataatgtatttgtagttgcagtcttatgaattgaatgtgttcttaattttattttcagattgcttattatgagcgtatagacacataattggttttgtgcttgcatcttgcatcctatagccttgctgtactagttaattagccttttgcaatcggtgatactaaagaagttataatgtactgtgacttaaaaggaaaactacttcttcattttctaggagttgtagctgtagggtacatcaatgaagctattgatgaagggaatcctttgaggactttagaaactttgctcctacctactgcgaatattagtgatgtggacccwgcccaygcccagcactaccaggatgttttataccatgctaaatcacagaaactcggagtaagttttagtatatctgtttcttttaaattttacaggctgggtggcagagggagrgaaggaggaggatttgacccatttacgttaaatctcatgagcttcttgtcccaacaattacccatgaatcagaatggaaataatagagctgttattttcctggtaacaaacattggggggaaaccagctccagagctatttattgctttaattctttgactaaaaactcagttgtaggtgagttcttgttcagagttcaattcattgactatttccttagtagatactatgtgcacacttcagtccatagcttctggtagagaagatggggatacagagggacacataataccatttgaatgttctctgaccttatcttcaaaatgcttagaaactgattgaggcagtggacattgtcacatggaacagtcaagtaatagtaaagataagggtgtgcaaagtgtcaaaatgagagatacacagattgattcacggatgtttgagattgtcggggactagaatcctaagagaagttggtgtggaggtagagcagaagctgtcctctcgaagactagtggctttttctgagtacagagcttgtaccgctattataaggagccccacaaagactggcctctgtgataaggccaatgggctgagtggtgaggctgatatgatctgtcacctaagagtgggagtgatgccacctgggacctagctacttatggctgccatgtcttcaggtgcaaacccaactgaaagggcggtcatctcctctgtctaggtctttagaacctaggaactgcctcattcgaaacaggaaaaacatccttggttaatgcaaacatttattgagaacctactatttgtcaggcatgatattagatactcatgtgtatcatctcatttaatcatcacaacaattcataacagccttctgaaccattttgccatcattattgccatcttacacataatgaaaccaagattaagtaacttgttgaaagctatctaaaatgtgaccgggcacagtagctcacacctgtaatcccagcatttcgggaggccaaggcaggtggatcacttgaggccaggagttcgagaccagcctggcaaacatggtgaaaccccatctctgctaaaagataaaaataaaaaataaaaaattagccaggtgtggtggctcacacctataatcccagctacttgggaggttgagggacaagaatctcttgaaccgagaggtagaggttgcagcgagctgagatcgcaccattgcacccccacctgggtgacagagcaaggctctgtctcgaaaataaatacataaaataaaataaaacaaaatcaagctatctaaaagataattagtcctgagactacatgcagctcaggtctgtctgattcggaaacattataattatgtattaaggcagatgggaaaagatgtttattgcagctttgtttgcaatcacaaaacatgaaaaacaacctaaatgttgttaagcaaaaaaaaaatcatgctgtgatgtgcacatagatggaatatagataggcttgtgtatgtgttgggggaggggcgcacacactcttacatgtgtctaaaatatttctggagggaggataccttctggaaggtgaactagaaggctagtatggatgggagatttattcttcactccgtttttgtactgcttggatttttaaattttttaaggagtgtgtgtattaaataattactgtttctaaacttttaaaaaccaatgtaaatcctatcctcactactccactgcctcattgaaggtggagaaatgtatcccccatggtggcgccctctgcactgccagccttccaacaggaacggcagtggcattgcctgaccctcctcactttgccaagcgcccccactcacatcagtctttctcatttaagcctcataccacctgtggaatgggtgctgtctcatctgatgtgaaygagcctgaggctcagggcgaatgcctggccaaggtacagccagtgagtgggagagtgagggctcatacacaagcctggagtccatacatcccaggggcaggagagtgggccttcaccttgatgtttccactgaggtggctgtggccatggcacatggtaaacttacaagcattggaagacaaagttatttgctttgaagrtagacatcattyaaatcctggctttgccacaaattagttatgtgatcttggtcaaatcatcaaatctctatatgcttatttttgcatgtataaaattggaataatagtacctgtcttataggattatggtgagggttcaatgagaatatacaataagtaaatatatatcaatatataactataggtactattaatgaagaatatgtgcacgtgtttgtgtagctatagcatttagcatggagcctggcaccaaaaaaagggcttaaataatgtagctagtattattgtgggcacctatggttgcctcccaagtaaggggtgagtgatgtcagtatcttaaggttcttttttttgtgagatggagtctcgctcagttacccaggctggagtgccgtggcgccatatcagctcactgaaacctccacctcccaggttcaaccgattctcctgcctcagcctcccgagtagcagggactacaggcacctgccatcaagcccggctaatttttgtattttgtagagacgaggtttcaccatgttttccaggctggtcttgaactcctgacctcaggttatccacctgcctcggcctcccaaagtgctgggattacaggcatgagccaccgcacccggcttcaaggttcttactagacgtagagtctgctgaatttacacaccaaagtcaggatcttctgaggacaaatagagacagacctgggtccctgtctgcccacagccacatgggggtttgtctttgaggtgagcctgactccacaaacccaaggcctttcataggcaggcagtataggtcccttctagactgagcattccaatctagattgagatggaactccacaggcgtcctttgaaagaagcccctgagtgcccacaccatgccagctctgtgtcaggcatcctttctaggtgtggaaacagtagctttcatggtgtgattagagcattratatggagcctagggatctgggttctagttcaggcgttaaaccactgttagactatagttagaggtttgaaatatactggcaattactaacagatttaaacagatttaaaatactgcaggtccaagcgatgaatcatatttggttaaattcctgtttttaagcagttttctttctctgttcattgactttgaaactttcttttctcagcctgttcttttttcttggaaaaatcctaattctgttgtttggcaatgtctttaatgtctttgtttttcccctctgctttttttttttttttttttttttttttggagacaggatcttgctgtgttgcccaggctggtctcaaactcctgggctcaagtgatcctcccacctcagcctctcaagtagctgggattgtaggcacaagccaccacattcagcatcctctactattttgattcctagaagtttccagttgtgtgtttatgatggtatttctgtgccttgtcttcccaaggtctggccttggaaaataatattagaaaattatattgctggtattatcagtataaagtaaaactgtgccaaaggctacagccattaaaggtcacaatgggtaacatcttcatagaatggctgcccagttttgtcaaaggtggaggacagtaatggaagttggtgaagattctgggtcctctttagcagtatgtcaagtataaccttgtgtagctacaaaattccttttgcctcttggaaagagacttgagtaatggtcatgttgactttaacactttttctatgtctgttcactgggtggtgtgtgctattttacaattgaaggttttgcttgtgaacatatgagttatactccaccaaaaagttctgttttgctccttgtatataccataaaaactgtgtgcttttaacgaatattgctgtattttttccttaggtaaaactgtgttgtaattgatgacttagttttcagaagtcagctccttccatttaagtttctatcttcttgaaacttactttaggtttgtttttcattctcactttagtgtttacctgagttttgctctttgcataaccacacacatattataaagggtcttcatgtggaagctttttacttaagtctgatgaaatagaaaactgtgtacatttaaaaatatgcatttaaaattgttttttattgttttgttgggcagtatgaaatatacagtcaaggcagattcgtacagacttgtaaagtcatctcaggaaycttttatgcttaaagtttcctcagccccatttatattcactactatcattcactctttaccactmatatcttccctgctgtctaatcactaatatcttccctcctgtctaatcactaatgtcttccttcctgtctaatcactgagttaagggaaaaatagtcatttacttacaggaatataatgggtattaataacaaaattccatttccccattaaaagctatgtctaagaaaaaaaatagtggaggcattatttaaaacttctaaatggcctggtgagtatagtcttagtttagcttccttacttttttgtatkcccaacctgaaatgatgtcatcccgtatcatcacagtatgttgctttttcagtacgaagttaatgggctttcctgctgtttaactgctttgagattttaaaaattcattcagccacatagtattcaaagcatggagctgggtgccacaaagacttgggcctggcatcacccagaagctcaaggaaggcagaggatgagcaccttctccattatacttggtacttgattgttcatggaattaaaatttaaatataaatgaactatatataaaygccataataaaaatatacgaaagtgctttggaagtacagataagaaaagtgacacttctagcctgagaatcagggaagaatggtccttcaaggacttgaaaaaatgaacagaattaaggcaaagacgttaggactagcttttcagtctgaggcagagtggagatatagcagagcaagaggtttggttggtgcctatatcataagcaaggtttaatgggaagtgtgattagcaagttagccttgaatgccaggctaaagatttatgatttattatagaaacagtggagttagtggaaatgttttagtgatgtatcctaactgatatctaaggaagattaatctggcaggacttgtgaagtggtggagggtaggctggcagtggagagaatggttagaaggtagaggtggcctgggcgtagtggctcatgcctgtagtcccagcactttgggaggctgagataggaagatcactcgagaccaggagttcaagaccagcctgggcaacagtgagactccatctctgcaaaaaataaaaaataaaattagttgggtatggtggtgcatgcctgtagtcttagttacttgggaggctgagacagcaggattgcttgagcccaggagttggaggctgaagtgagctatgatcaggctactgcacttcagccaggtgacgaagcgagacactgtctctattaaaaaaaggaaaaaagaaggcaaaggtgaaactagataaaagaccctggtgagggaccctacaaagatagaatcagttgatgaggcagccaccagcatgagagtcaaaagagaccaaagaataaaaaatgatgtcaaatgtcaaggatggcaataccactcrcagaaatagggaagatggtgatttaaagagcttgaagtagcaataaggcaaatggaaatgtcattttccatagagttgtgatatcttttctcctgcattaacatttttaaaatactgataaagtgtttttaaaaattactaatgctggctggctcagtggctcacgcctgtaatccagcactttgggaggctgaggccggaagatcacttgaggtcaggagttcaagaccagcctggtcaacatggtgaaaccccgtctctactaaaaatacaagtatttttagtagctgggcatggtggtgtaatcccagctacttgggaggctgacctgggaggcagaggttgcaatgagccaagatagtgccactgcacgccagtctgggtgataaagtgagactcagtctcaaaaacaaacaaacaaactactaatgcttttgtaatgtttgacctttgaagcatatytcttaggagctcggaaatggagctccttgcactatgcttatgttgttcttgaaaacagacgttctctgtgatggctgtccttgttctctaagatcatttcactattttgtaaggtaagcagtggagtgatttctggtttttgacatgagaaaataaaggaatggatctaagcaactattaagactacccaggcacaaagctatgagatatataaaatataagccatcagtgttgttgtagtagtagttagcatggtgaataataagaataatattgcttggagcaaagcaaatggtaaaaatcacaaggatgaggagactcgccttaacataccacaaccatctatgatcgtatgcattaagtgtccggatgatggctgcatagcagtagatgataagcacaaatggaattaagaatccaaagaatgccaaggagatgaagtaatagagttggaagggagatgaggactcgcaagtgtygtgaacatcatggcaggtggtgatgtctggctgaacaagataatattcctgcttcagtatgaaaaatggcagcatatataagaaaactgttgcccacaccrgtccacatgttaccaaggcataggtgtgcttgggcaggccccggtaggtgaaaggatggacgatggccaggtagcggttgatgctgatgcaggcaaggagcagaatggagcagtacaygttgccatagaagatgactgtggtggcccggcacaggacctctccaaatacccagttgttcccattgagatgataagctatcttaaagggcaatgtaacacaaaaaagaaaatctgcaatggccaggttggtgtagaatacagtggtacagatggatctggtcctgaagaaaagcatccacagggtcacagcattggccgggacaccaactacaaacaccaggaggtagatggcaggtatcagtttagtacttaaggagctggtcaggtaccccatggtagcatttttcacatggagatgtgaagcactttcttcagggcacttaatttttacagtaatcgtggctcctgtccagccttccaaggcagaaaaggggaactcttcaaaagaatttgggggagctccacgaaaggtcttaatgggtaaggttggctttgccaagttgtttgtatcattttccatgcctgtaattgaaagaaagtattaacataaatgtatagttcaagagaaaagaaagtgtgtttaattatttgtaaataatttctgtgattgtagaatttaagatcatttttattttaaaaagttattgtagattaggcagtcaacaagcatatatttaatacatatcatatgccccagaacaacactatcttgtgcggaaacaaaaactaaatgatcagtccttgtatgtaaagtgtttataatactattagaagaaacaaaaacagcccatcagaacattataggcrtgttgactacaaactatacaggcattcagacaatacttaatagattcagatgtttgagcaaaatgtcaaggaaaagatgaacttgagcaaagactagcaaggtwcctaaaaagatggaatttaatgagtaagattctgctggtgatgaatggacagaagcatagtgtgggctatcatgggatctgggaatgccagataagttgatttagcaaatttttattgtacattgatgtgtcagtggtgtaaagttttaaataaaatccatttctatctgtaagtaatgctactcgtggagaagatgcataaaaatgcattgtcttatgcgaataaagtgcagctgagaaaggaaattgaaagagtgggtgacagctaaattcctgaagggcctctaaactgtcctaagaaatcatatgtctattcacagatgatgggattgcacacacaattttgaacagaggaatgaccattgtgttaggcagaatagtagccccccgcaaagattctacctgctaattcctggaacctacaagtatattcctttacctagcaaaagggattttgcagatctaacttagttaaggatcttcytttttttttttttttttttttgagacagtctcactctgtcgcccaggctggagtgcagtggcacgatctcagctcactgcaacctccgcctcccgggttcacgccattctcctgcctcagcctccccagtagctgggactacaagcgcccgccaccaggcctggctaattttttgtatttttttagtagagacagggtttcrccatgttagccaggatggtctcgatctcctgacctcgtgatctgcccgcctcggccacccaaagtgctgggattacaggcgtgagccaccgcgcccggccagttaaggatcttaaaatgagattttcctggattgcctgggtgggtcaaatataatcataacagtccatataaggggaaggtaagagggttgtcaaagtcagagatttgaagatgctatgctgctggctttgaagatggaagaaagggtcataacccaaggaatgcaggcagattctagaagctgaaaaaagcaagatagccgattctctcctagagcctcsagaatgaacacaaccccaccaacagccttgattttaagacstctgatctccagaaatataatctgttattttaagccactcagtttgtaatgatttgatatagcagcagtaggaaacgaatatagccgttattttgacttgtttttaagatgacttaggtaatagtgtagagaacagattggaaaggtaagaaattacaggcaaggggacctgatttggaggctactgtcatcattcatagctcagtgagttactgagctagaacagtggttatggaaaggcagaggcgaacacgtgagactctgatggcggcttaaagggacttggttctgattggctttggggtgcagtgagggagaggcaggaagcaataatgactcaggtttctactctagatgacttggagggagaggatgccattaactgagttggagggagacaaggagacaggatcggggagaagctacaatctgtttttagtctgactgaggatgagttgctggtggaatattagtgtgtaaaatgtccagcaactggttagaagactggatgtgggtccaaaattccagragcccaaattagaggcatgatttattgtagtctgcatggaggctctcgtttaatttaatgggagtggttgagatggcctagggggagttatgagaagaaagaatccaaaggtggactttaggggtaatgacagattttaagggaagaggaaacaaaggaggaaaaatcggaagatgaaatcggtatgaggacctaagaagttggaaatgaattctttaaaagatagaaacacatcaactatatgctatcaatatttggtgttacttggcatgttgatgttaataatcctaattcctgcaatttcaaaaacaaaatcttaaagctcaaacctgaacatttattattatataactttttgtaaccctttcacatgtatagaaaatagattctcccagatttctaatgttacctttaagatagacttctatgccaaatataaacctcattcttatcgatttaaaatgccagtactgcgccattatgtcttgtcccatggcctcaaaattcctccatattgaatacttgaagttagtgtttagtaacctatgtttcattcagagccagtttctcttcctgctttaatctctagcagttagctcccgggtgaaatggaaaccctccacgtaaacctgagattgcacaagctgaattcacggtgtaaaatagaggaggtgtgtcctagtaactgaggggtatggaggtgatcaggtatcatttaagaaaaggtagattaaagaaaaggaaagaaaaatttgggaggcagcattcttctatgcctgtatttagaggtgatcttagaagctgtgttgtgtgacacacaaacccttctgctcacttttgcattttggaaaagttcttgcatctgacwtcacccaaagagaagtgcctttaaagataggcacaaagttagagaatggtgcctgaagagcatgccgtacaagttattagcctgattttaaaaagctgttaaaaccaagtgtttgtccgttttcagaaagtttctgggatttagcaagacatcatgcctccagacatgccaaacagtgcctgtgttttgtggaaaagttgatttgattccattttccgtgagaatgccagatctgggtccacttaaataaggcttttattcctcagagcctggttttccttatgaattgtactcattgttaaatttttttattgtattttaattctttatrgaggcttccattgggcataatatttcggaaatgtttttctatccgggaaaaggccttgaagaactaatccaaagagaatgaactccrgcctctcaggggtgtccaagggagagaatacagtcatggattcatagtttctgtttctagttgagccagtaaagccccttcctcatccctcttttccatttacctctagagacagaaactaaaaaccatggcttcaggctgctaaaagcctaaaacaaaacaaaaccacaacgaaataaggcaggttggacaagcttgcttcattcttccttcacatttctcccccaccccatggaagaaagcaaattcactgcctctttgtttccttcagaggcccccgttttcacctccatcaaaccctattagcgtcttgaaggaaccacccccgaaaaccttgcttcttttgcaattctgcttctcaacatattggcccatctactcccagaaagagcgtgcacttattatattcataaatcccacatgtgcttactgctaatcaccacagattctcttagagctctctgcaaccgctcagggattccaaatgtgaatttaagcaatgttcctttagaaagcattgatttctgtttttgtttcccttgctatgtccagtctttgcctctcccactcctaacaatgttgactggagtgtgtgacctaacaaagagtaacaggtacagacctatcccaaatttgttatttttggaaaaagcaggaggtttcaggctaacattgtgatgggtaaagtggaaagtacattcaaagttgaataatagtatttgggagaccttatttttaaaattaaaaaatcatatatgagggtagggagaactccccacttaaagtcaaaaaaggtcattcatttcggaaatactgacttattagcattgccagctattgaaagcagatgactttctctttctggcagtattcttgtttctcccatttatgtctcaccaagaggtttaaacacaggatatatattttaatccctagaaaaagtgccatctttgcttaaccagaagagaaattcttacaaacacaaaaacgactttcaaaattgctccctgacttaatygtagacatctaaaatcttgaatatgccacacatttttaaacatcaggagggaacacttagtctatgaccaggtttgaatagagtgaatgaactatagatgttcatttccatgattctaccttttaataataaagatcaaactgcctttggggtttacagtttgtgtgagatgcaaagaaacctaggttcagttgactcttaatttgtaacagaaacccacatccccatcctaccccctgagaaaattgcttaccactctgacaaaaagtgggcaacagaagcaggaggccagcagctgcaaagatgagggctttcattttgatgacctgagtcccgtctcttaaacgttatgaaatctgtaaaatcatggagcacaatttcacctcagttccatgtgtcagcagcaaatggaagccttggtcygtctgtagaagtttgctctcctgtgccgtgcaggcaggaaacttgccctggtcctccgcagggaaaggatgtaatccactcgatgcttcagtaagcatgactcaggccaagcctctgaacgtgttacgttatccctggagaaaggcatttaactcttacccacccccaacaatctattctgaataggtgctgtaattctcccctagtagatttgcttttaaagaatggcagaaattacacaggcctttacagaactaagccaaaaacagatgttgaacagcagtaagttttgaatctgtcccacatttcatttcttatccgttttaaaaatgcagttccagagtgtaatttctacttaataaattatcctttcctttatcttcccagctatttcaaatcttaatccttaaacactttacataattataaattaatcatggaaaacaaacttttaagaaattcaaattgagcggtgaatcactttgaaaattttctatcaatgtaatattgatttcagtttgtcgtcagtgcctggccagaacctggcttttgagtggtggtggtttttcttcgccgggtgaggatggcgtttgttcaggctttttttttttttttttgccttatcttgatgtgttttgagccattcaataacccttagggtcagataactggaggaacctcccaaacaacgctgttcagttaaactaaaatcatagcacatcatgaaaatgaggactccctttattccatgagtgttggtgaataagtctacaataagatatttttaatagtggtaaaatatacgtaacataaaatttactatcttaaccagtattaagtgtacagttcagtaatgttaaatacattcacattgttgtacaacatataagcttttatgaattgttatattctgtagagtatgacttaatatacagtaaaaaaatgcattataacacatttttctgtagttaataaaacttaaacttgaagcctgaccatcccacagcctgctctttacaaaatgcagcaagaatcagaaaatacaaatttcacatgagacttaaaggctagggatatgctaggaagaaattgatctgcggaaacctttcacatcttgattaaattacattagaccaagatttttacaaaggtcagtgtttaatacttcaactacataatatatggttatacaaactgagatagaatgttattatattgcagaaatataaaacctaaaatattgacaaaggttttttttgtttcattagaacttttctgggagttatctaaattcaggaatttatgacttgatttgcacatggcctagtttctggtcatttaattcatttgtaactcttatgttgaacctggctgtttaactgaagtggaggtgtggccgtcccataaatatactattattttcagtcttctggtgaacaactgaaaaagcagacttggctgggcacagtggctcatgcctgtaatcccagcactttgtaaggctgaggtggggggatcacttgaggtcaggagtttgagaccagcctgaccaacatggtgaaaccccatctctactaaaaatgcaaaaattagctgagcgtggtggcgggcgcctgttatcccagctacttgggaggctgaggcaggagaatagcttgaccctgagaggcggaggttgcagtgagcaagcctgggtgacagagcaacactccatctcaaaaataaaataaataagaaaaagcagactttacattgataagattcagcttttacttttggttttacatttaactctagtaatcgttagttcartgtttcataatttaaaccgttgacttaaattcatctgatttgtaatttctctcttcagtttggcctataagactaatactttaagctttgaagtaagattgttactgccttctcatctgggtagaaatctgtgtggtgtatcttctacagtgataagttatgaaggaaggcaaatacccttcaaaagaactgagacacataaatgaactcatagagcttagtttttaggttatagctggggagtgttgggttctcttagatcttgtaaacagagaaaaattagctcctgcttccctgtctctttttttcctcctctagtcttcccctttccacccggcttcctgtttgagcctcccccatccattcttgaaagaaatggaaaatcttgctgatgcttcccttgtagtctgccgcatagctagaggtgattgtggaagcaggcaccaacatttccccagaggtctcctttagcccagatgttgcacgatgaaataacagatagtttatctcattttcagagccctttccacatgcattatctcacgttaacctctgaggaaaatagtgttagaagcctgccagaggaaccagtgactatttcctctccttcctgcccccatccatcttaagttttaaatgacggagtcggtgccagatccattacctttcattcatcacagtcttgacttaggatttagaacacgacacttattcctacacataggtaaaatgttcccatttgttaaatgtcacatgtttcctgaaaatatctctgctgataattatttacttgccatctcagaaaagattttataaaacacaattgctacctggaagttccacttaatatctgtcagggctgcttttgtagcaggaccatcagaatcaacccaaagttaaataggaatatttacctataataggaataatgcaatacattttcattgctgctgttgcttcctttctaaagctatctttaactacttagtctttgctccccctgcaactysacacctttaccataggttaaccctttctcacctatgtctggatcatgtgtctgcagtatatattgccctgatcacattgtattataattstttttctttttttttttcttttcttttttttttttttttttttttgtgagacagagtctcactctgtcccaaggctggagttcagtggcctgaccttggcttactgcaacctccacccaccaggttcaagcaatcctcccgccttcctcccaagtagctgggactacaggcatgcaccaccactcctggctaatttttgtatttttagtagagatgaggtttcaccatgttggccaggctggtctcgaactcctgacctcaagtggtccaccaccctcagcctctcaaagtgctgggattacaggtgtaagccaccatgcccagctatatgtcttgacacatctgtctcttacactacattgttaggtccttgaggacaatcaccatgttgttgtttgtttttaatttttgtctctgtgtctgataaatatcgaygatccctgtgtttctctcaaattaaaaatatcccatggtaccctgggacaccttgacacttagtttgggaaccacaryaattgattgagggagagagtgtttgactagggtagcccgggaagactttttggagtaggtagcatttgagttgagacctgaatggtragaaaaagccaacagccacacagtgagggtagagtattgtggtctgaaagagactcgtgtgaaggtctagaacaggaagggggaagtaaacgggtgtgaggtgcagccagagaggcagtaggcaggsccatgccgttggagccccgccatccctgagaaggcaccctgtgtttccttctaactgccggggggaagcctttggggaagctttaagtagaggagtggtgcactgagctatctattttgaagggatcctctgggccctctgtagagggccactgtggtgagggcaagcttagatgcagcagaagctgctagggggctgatgcagctgtccagttgggagatgatggggggctggactaaagagtggtggggaagaaggaggaagtggtcgggtttggggtctgcttcattaggagtgtgtacagtatatggcagagctggatagttgctgattaagaatttgtggraattatgattaaatggctcctcaaaagcagttattaattctgtttcctcatcattcactcttctttctttttattctgtgacattgtccccaggactctgagagtgtttccaaagtgctttggctggatgagatacagcaagcygtcgatgakgccaacgtggacgaggacagagcaaaacaatgtaagccctcacctcctttgctcttgaaacttgcctttttggatttggttatgtgcctgaagtcatgygatttttaatttctgaaagatttggattcttaccaagttttagttcttggacacataattataccraaattagttggttgccctattgtcagtgatttgactctatctccaacaaaatgtaacaatgttgctgaacaaaatccagaaggtaaaaaatagtttttaagctctcaaattgtataattgaataaaattctttttttctcttgatttttagagaactagaccatttctacttaataaatgcctttttctcctttccatggcctttatagttaccagggttttccgcagaaacagaaccaataggagacctatggagttggctagctgatcatggtgcaactagaagtgaaatagactggcagtctactcaattcttacttaatctgtacaactggatgagttttgggtcaagcaaacagaagtctaccttgaatcataaaaacagtcatggaccctcaatcaaatcccagaatggggccagtttacaaacccagaacccctcaaatgaagggaaggccaggccccttgaggaaaaactcagctactctaccaaaaatttatactgttagtctttcttccacccctcccccaaagggaccaatggccttttaccagggtgactgtacttaggagaaagtacataatcagacttttgggaattagtggacacttgctctgaactgacactaattccaagaggcccaaaacataactgtggtccaccagtcaatgtaggggtttgtggaggtcaggtgatgaatagaatattagctcagatccatctcacagtgggtccctaaactctttctgtggttacttccccacttctggagtgcataatcggaataggcataatcagcaactggcagaatccccacattggttcaaatgataaaattgtttaaccctctgtttttaaggaagaataacatgaaaattcacatgatagtctgaaatagcttctaaattgctatactaacattctccatatataaattaagattcctaaaaatatatttcactaacctgccaactgatggcataattagaatctattctgttgtatcagktcrgagaaggttcttaagatgactttgtcttactccacagatgggcttttcaacctcggaagcatctgtgagaaacatctgggctttatctccttagcttagaaaaatgtgtgtatttctctaacctgaacttttattccctaaggaactttgaagtctttcctttctagcacgccttaagaaaaaaataatgaagtggaggtgtgtatataagaaatttcaacttaaatataaaactgaaggaagccatggtctgaagagacagttttgagaaagtagattgtaatttagacattcaaatagcctaagatggttatgatttgtctcttagaaatcaaaccaatttagaaggtttttaaaatgttcttatattcattgttcttacatttggcctgcaaatgtcaagttgattctgtttttcacattgagactcatggttctattgactataaaagtaagaggatttctcaaatgtataattttgtactctgtattgcacatctataatcctatcttttcactctgtcctgtcccttaaagagctgatatactttcttttactatatcttaaacagcaaaaaagattttccaaagttaatgctacctatgagaattttctgactttcaacaagaatttgattaaaaacattcttcattatttgcatgaagacttgaaatagattctggtcacacactataagcatcacacacactctcagataatatgataaaagaaaatgtgttggcccaaatatgttaccaccagcaaaatttgaaagggcagagtaactcaagtccctttcattttggcccagtgttcacattcactggagtatcttgcttgcttaaagtagatttgcctctacttttgattccttagagcagtctttctctacctttttctcattatggcaccctaaggaatctttttagacagttttttctctaatcactccttaccatgaaattttaatgccacagatattttgtatacctgtttatgtgccatatgtagacctgtactttatacataaagagatttttttcactccctccctgcaggaactaatttttgccccgttaggggttctatcacctccactgtgaatgtgtgccttaagagagcctgctggtatatggcttaagatgtaaagcaaacattttttggatctcttaggagatttatggaggtttcttaatttgttccttggcagaaacatacctgactttctggagtgaaagtcatctatctgatatcttcaactatctggaacttagctacaactcacagattaagaaaaaaagcaatcaaaatagatatctcaaagcaagcgcattgaagttaatctactttattcactgagcacccctcagatagacactttgagcctgttgattcttttcttaggcaaaactctattatcttggtagtttcttttcctggttggttgtgacttagagcacatcagaagccacaagtcacaaggcagtaaagtgcttaagctgccataggcaggcacaccaatgtcagtaaaaagtgacagctgacagtgaaggaagaaggaaaaactaagaagcataggagttattaaggctatttcgtgcaggagccagtaagcccaaacacctccacagtccttgaaaataacactcaccggattatagcacagcacaattttaatgacaaggactcttctggcagctctcagcagacattaagcacctactttataccatagactttgggtaaaataaggagcaatagcagctgtcctgttaggattttctctaaggcatgttttagagtttcatcgaaaatggttctattaagatgagagttgatccataaaggaattagcttcagttatctggaaattgacctgtgaaccagctcatcgatactcaatgatgatatatccaagaaatgtgtgtcttttgtaatatcttttaaggaaaattgcattttattgggttagatgacactgtcacatgtagttcatgtgataatttttgtcattttcttgttcctattacttttcttggaccacaaacttctcaattgccagtactctattttctctatcctacaaagctttcctggagaagaggaaagggctatgtctacccatgttctattaacctctgttagcataagaacatgctgccataccttttgttcaacaaccactggagtttgcctgagaagttctcccttcatctatatgtgcccctccagatttgcatgactttgactccaggttgttgaaagtcaatctctgtttttctttctcctttaaccctcatagtgctatgcacatgtgaacataatttgatgacaacraattgtaatttaatatttgtagagtttgatgtacgtgtaagaaaaaaagaraaagcatccrtgtctcccttctcttttcctcaagatgtttttcatgtaggaagtattttaacttggcctctttcatttttctggttctacttttctaactcagtgcatttactggttgtgaaaactctagtcctatcgattggacattcttacctggaattaaagtgggaaataattcactaagttaactttccttaggcaaccargagtttaatgtgttttgttaatgaggaggggtagaaatttgcaatgggataaaatgcttgttaggtctaaaatggttccagaattaagttttaggactccgttgcacatatccaccagctctgcctttctagaacacttgtttaggttgtttttgacaatcttgctaaatatattagcactatacaagagaataccaggatttcygtaacttaaaaaggattttgcttatcctaaagtaaacaaatgtctttgtaaaactagttctcaaatacatgctaatgccctaggttacagctacatatctatgttcgtgtgtattcaccccatttcatagattactacagcaagcaaaacctagtgccttcataccacatatgagtaaccaggaaagactattgtttttaataaaccatactcccatggtatctaattcttcttrtggactaaactggtctgtgaatttgtgattgtcttgggcatatgtggtaaatattctcaaagggtaaaaatgtttgatactaatgsattcctaaaaygttgaattatatatttgcatgccttgaartaagtggaagataaccattaacaagaaacttttttttcaattacccaggggttactctggtggttgatgttaatcagtgtttggaaggaaaaaaatcaagtgatattttgtctgtattgaagtcttccacttctaatgcaaatgacataatcccggagtgtgctgacaaatactatgatgcccttgtgaaggcaaaagagctcaaatctgaaagaggtaagttggtttgttactttagcacaaaytaagtattttaaatatcatttctgtggtattatattttcttaattttaagacaagtawtgctttcaaattaacrtttctgtaattttttgtcatctatggctaaggaaattaggaaaagttttagatgtttctttttagttttagaaagctatgatgagctcagtggcaatatatggatggcattaagaaaatgtcatatttgaggagtstgtgccttatacaggtcatgcttattgattcatttattcgtgtgagtagaccagtgatataaacagatgtttacactaatattttctctcacctaatcctttgtgattgcacagtattaagtaggggtaaagagtaattctgaatatatgaaataaagtacaatgagccagcctgcaagggatcagttggcaaagctaggcaactagttatgcctactcaatccaatggcagagcctacattgttagctctggaaagaatctttgagactacacagtttgatactcatttttcagatttggaagttcacattggtaagatttcagacagagggaaagaatggtagacccaaggacaattaatttttattccagaattcctttagtagatttttattaagcacctactatttcctagtgtcaaggatcaaggtggctgtcaacttctaggctagtatttatttgtaccacattgtaggtcatctacasgatactattcatctttaagaaactagtgtgacagtgtgtggccttagaagtagagcttaaggaaaaaaaaaaacttttttagtccaacttgatgtttgtctagtagtaccctatgtacttgttttcaagtttcatatatttccaacttggagattccaccttaaaattcagttaattttctgttaatgaaatgaccactctcttacttggcatctggtcacccttgagtccctctctgttccattcagatctcttcatcaagaattactgtaatgtcccctgtctcatccttcattgggaaagaattgcataattgtataaatgagctatcctaatttcaaattcatcctggaaaaaacttagttcatcttctgtctcctaaacttgctatgtcgtttcccacatgtcatatttgggtgactatagtcaaatccctgtgtatccaattcagaaacctaggaagtgctttagattcattcttctgggaagaaaaaaatggcagcaagacttttgtcagctgagatcatattgaatctgtaggtaaatttgagaagtcttgccatcttaacaatattctgatccatgtacatgggtatctttccttttaatcaagtttaaaactctttcaacaattttttgtagttttctgcatataaggcttgcatttgtttcattaaatttattcctaagtattttatcatttttattttattgtaaatattgttttttaattatattttgggattgtttattgctagtttatagatatacaattgactttttattgagaaataatttatatgccataaaattgtccttttaaggtatgtaattaagaggtttttagtatattcacaaggttgtacatccaacacctctagttaattccagaacattttcatcacaccaaaacaaaacccaatacttattagcagtaaatccccatcacccactccccagctccaggcaactactaatctactttctgtctttggcctattttggacatttcatgtaaacagaattatacaatacatagccttttgtgcctggcttcttttacctagcataatattttcagagttcattcatgtagcattagtcagttcgtccttttttgtggctaatattccattgtatgaatatgccacattttgtttacccagccatcaactgatggaacctgtattctgcgccaccccctccccccaacttttggctattctaaatgagactgctatgaatattcatgtccaggttttttcatggatatatcttttcgtacaactgatttttgtatattgatcttgtatcctacaaccttgctgaactcattctaatcatttttagtaaatttcttgtgctgccatccgccttaataaataaagtttcactgaaatccagccacacattaatttatatatggtctatggctgctttcctgctgcagtggtagtgctgagtggttgtttcagagacccatagcctgcaaarctgaaaatatttgcctttttttttttcttttcgagatgaagtctcactctgtcacccaggctggagtgcagcagggcaatcttggctcactgcaacctcagcctcctgggttcaagcaattctgcctcagcctcccgagtagctggcattacagttacctgccaacatgcctggctcatttttgtattttttagtagagacggggtttcaccatgttgaccaggttggtctcgaactcctgacctcaagtgattcacctgcctcggcctcccaaagtgctgagattacaggcatgagccactgcacccagcccctactctctgactctacggaaaacgtttgccaacccctgttctagaaagaagagcatcccaagcaattaaagactgattctcacctccagatagagctatgagcattgttttcaggcacgcacaggatgatttattcttatctctttcacctctggttctaggatgtcttatcttttcccaaactgaaacatctaccatttggtggatggattactcagccttgtaactcagtttaacgcttctatatgttcgcgtataattttgtctgcaaggcatctaaaaagtatgcctccttgtggaatgttcatcacctcttaactaacggtaatcagtcttttttctaagtaacaaaccaactgtatttcttaggaaaactatttggagcccatgctggaaagtagctctcctcagcctctgatctaactacattcaaactagatgtgaaaaatgtaggaattctactttcctattacctactgacatcctaacccaagtaaagccttctaatgccattcagatctcttcatcaggaattactgtaatgtcccctgtctcatccttcattgggaaagaattacataattgtattaatgagctatcctaatttcatattcatcctggaaaaaacttagtttatcttctctctcctaaacttgcctgcttcttttcccacgtgtcatatttggatgagagctaaaaacaacagaaaaatataagaagttctaacttagactaagctaagtcagctgctatcaagtgagctttagactcattgcctttccatgtaaatcaaagttcaagtgaattgaccattggtgattgtcttttaaccaactaacaaattttttacttctcagttcaagtgaygggagaaacattttcaccagctttgcttgctttctttccttcccactgagacagttgccttaagaagggtgattattcttctgaaaacatttatgaatctgacaactattggtaattgaaaatatcataattggctggttgtggtggttcatgcctataatcccagcactttgggcggctgaggtgagcggattgcttgaccccaggagtttgaaaacagcctggacaacatggcaaaacccatctctacaaaaaaatacaaaaaattagccaggtgttgcatgatcctgtggtcccagctactctggaggctcatctgagcctggggaggttgaggctgcagtgagccttggtcacaccactgttctccagcctgggtgacagagtgagaccctgtctcaaaagcaagaaagaaaggaaggaagggaggggagaggagggtagggggagggaaaggaaggaagaaagaataataattacttgtaaacatcctaacttgactgtacaatgtattttctagtagaccaatgtttctaaacagatgaaccagctgtctggctgcccattgaaaagagatacatctctcttcctgggcattgacaaacagaaagaacaggtgaggggcatttaaagccaaatgaagcatcaacacatattaaagagccttaaagttacccctgcttagttatttacatgcatttcaatattctgtgaaaaaattcacttgaactttgatttacctggaaaggtaatgagtctaatgctcacttgatacagttgacttagcttagtctaagttagaacttcttatgtttttctgttgtttttagctctcaggtctggggaccagaattgtaaccattcaacaaaataaacagatttctaaatatgaagtttagcccatggattcatgaggaggagagattcttgaccaatctaagtcatgactaccataggattttctaacaccccttccccaaaattaagtttcaaaaaaatttttttctcatttcttgtggttgcacagcacaaaatgagtcagaggaaccaggaattttctttttccccactttagttgacctttgtgttgtgcatatgccattttgtactttgagtaacgttgtctccraaggttctgctttggtttaatgccgaacattggccgtccttaaataagggccacagtccttgtgggtatctccttattggagaaattgcaggtaaactttgtaagcaaagaggatcttgccgattggtctcctttgtctacatgtgttgtttgcatctacctgggacttataattattgtttgcttttccttctctttggctgcttttggccaaacatgtttttatcatcctcatgaaagatttaagttccagagctagccttagatatttgtgtctcttccttttctttgggttagcaggcatctgccattaaatacatcgaattcattccatrttagtgggtcacttctgatgcctttggctgtctgaaggtttggtgaaaaacatattcaattattttacatattaaagaaactacactaatgtttaagggttcactgtgtctgtgtagaatttaacaaacttttttctttagtgtctagtgayggttcatggctcaaactcaacctgcacaaaaaatatgactactattacaacactgattcaaaagagagttcctgggtcacacctgaatcatgcttstataaagaatcatggctcacaggaaaagaaatcgaggtaggaggttggtgtttgatggataactctactgtataaagttaaatttgactggttttctatttctgaatcatggaagtgatgagaggaactaaytgatttatctgaagtctggmtatgtaataaagtcttcatgaactgcagttgaatgtggctgcattgttactaatgtacagaattttttccatattggcttaacaaaaccaaatagagcagggggaagaaatatttcactatttatttgggatggtagattatcctaagaaatcaatcttaagattttccttgacttaattaagctcaattaatgataattcctgggttgtcaatatttaaaaggtatttctttccccccatctcagcctgcaacttaacattgtacctttcaaaccaaaatgtcatttttttctacaaagtgctggagagggcatctctgccacacatggccccagccatctccaggacagcttcggaagcaaagaacagagttgggcaaagagcaggatgggtaaacattaaatgtttgcttcttccgagatggtcatcttagcatgttttcattgcttaacatttctagagctctggatgtacccatgtccaaatgtaagtgcaaacatcacaattgagtgtatcttatactttgctttcaattaactgacataaaaattagccatgtgtccatgtattgtactaaccaagagttaaacaagatacattgaactggaatttctatttaactactaaaggtcccttttaactaatctgtgacccatatttgaaagctttcttctaccagattttacttattgaaagcaatttatccctcctctcatctctttttaaccaaactatataaatagtacctgtttgagcttcttgttaggagtaaagaaatagtgcattagtgaacatagtgtcattattgactattaggacgtttgttagtttttgtttctctttttgggggaacatttgttattttaaataaaagaagaaactcatttagaaaagtctgcattaggtgaaaccccatctttactaaaaatacaaaaattagctgggcatggtggcgggcacctgtaatcccagctacttggaaggctgcatcaggagaattgcttgaacccaggaratggaggttgcagtgagccaagatcgcaccattgcactccagcctgggcgacaagagctacactctgtccckgggagggaaaaaagcccagaaaagtctgcgttagaatctcaggttcagatgctttttctcgttataaacaagactggctggagtctcaggggtcctcctgattcccccatgtgccttgtccattgtagtcctaattccctcccaaatattcagcaatttttatatatataggagcccagggctgaagtatttacaaaaaaagataacaagagcaaagctaggagaaaaagtacagccaaaagagctattttcagtttcagttctaggtcactgaatttcattcattttttagttgcccctccctacatagaggaatgagaggagcactttgacaatagattatttgcataatcatggctttgttagatctgaatrttttcttgcaacatgggaatagggaactaaatgcttggtgaggctttcctgaaacaaaagacttagctataaacaggtagtgaggtagatcttgccgaatggccttgtttgtgaggtggttctttgctttgtctgaagttggtgggcagccatgaagaaacaggagggggtaaagtcagaggaatgtgaaattggaatcaacccttgtagcaagatgtctgaaacaagttatggccaaaagtaacctttccaactggtgtctctacaaatacccaaagaatgtgtagaactgcgaatgaggtctcctgaaaccataaacatagccaagtacccctcatttgtatggagtttcactttccaatgtactttcacatcactttgatccctaaattatcctctaagtagagatagagcaaatattctcatcttctatttttctaagtgaggaaattggggcacagagtaggtgaagcagtttgtactaattctgcaatttgtgtagattttgtcaataaacagatttatttccagtgcttccaacttctagtctagtatgttttccactttttgcattgtttttgacacagtcaccggtatctctgagtggttatatcatgtgcccattgctctggaattaataacataagttggtggcttaagaaatacataggtactttaaaaagtgagtaatgcttcctaggaggaatactcttgaaggaatattcaccaacattgctttggatttaaaaacaaaaacaaaagttggacccaaaggatgtgaaacctgctgataatggatccacgcgtcataatatgtttaaagaggaaatactgatgataattaagttctattttgggaaaaaacaagaacacatatcttatagaatcgttaaaagtcagcatcaaagatatcgcagtgtggcagtattgcagacagaatcaccaatgcagtatttactaaaacttagaggaaaawaacatgatctgagtctgaccaatgctaccaaaaatayttaatgacaagaagatagtgaagaacacagtttattgactcatttcagttgttcagaggtcgtacaacttttaggaaaacgacattgtagcaatggattattagtgctaattttgaagaaaaaaatgaaattatagacatactaaaaawttatatgccatggttgaaaagatgtatcaaactataaagcagcagcatcgaagatttaaaatttagaataaaaattgatcatgtggcatcccaagatataccccaggtataactttttgttatatcaagcatcagtctgttaagattattaaccagtggaaggtctaacactgttataaaaaattgtatttattctaaacaactggaatccagttacctgttttattcaatgaatgcatacatatatgtcttctcttaaagatatgtatgcatctttggtatgatttcacttttagctctttaagttaaccaaccattaattccagttgtactagataagagtcatcagctgtagaagtgacagtccagtctttctttgcatctctcatcgggcataaaagtaaaccctgttcataccccacatgaaactttcttataacccccttcttccttttttctcattcttctagatttctgctctctatccttaatagcacttatcttgcctctcccacccctttktcttttgccccagagcatcattctgagtttggccacagctcrttacaggggtctgcctactctggcctggggaagaaatgggaaagaagtctgaggaccttatggccattgcagtsttttccttggcagtccgagggaagcgggaggtgatgcatgtttttacagcaagcatccttgtccctttacattctgtggagctcaggcctcatgcctggtccttgccagcatcatccatacatctctgcctccaaatcctgagatcattgagctgcattctcttgccacctcagcaccaagctcagagattccaaaatcatattgctagaaagaagttaagccagtttcatccctcagctctgcttaaatttgtttttaaaccaagccaaaaggagacatccatattattttctaaaagataaaatatcagaagctattctatgtgtgcctttcagctgatgtgtgaagtgtaaccataagaaatatctcttgccaggacattattgaggaastcacagtaggttacattcgtgagaatatatggtctgcttcagaagagttgcttcttcgctttcaagccacaagctcaggacccatccttagggaagagtttgaagctagaaaatcatttttgcatgaacaagaagagaatgtggtcaaaatacaggtatgtggatcacctrccactgtttacacaaaactgtcatatcacctgaaaatgttttatttgataatagaatagtcaactaccagcattcctataaacaaatctgactgcatayttttacatwatcagtgcccctagtctacttcactaaggctttaaaataggaagcattttgatgatgaatgacttaacctatggtcttctagagagcatttaggagcaccgcagatttgcacagatccacctgctgccaacctagttggacccaaagggatataccttggatcagagttgaaatcatacctgacttggggactttacaatttggcttttttgtggttagtagatgttgagtggcgtcttagtttctgtgctgttctagcctgaaagaacaggagaactaatgaaataaacagatttagcctctctaagaatgtcttctaccttctgtaatctgtcactcttcatttaggccttcaggagaaaccttcattcccaatttttttgctataaattgttcttaagtttgcatgacttgtctaaactttctgattggcaggagaatttgccaggtttagatgtttctcttctgtattcctatagcgccccctaccagtcaccacactggtttgtgaaaggctgtgagtttgttctttttattgtgagttcaaaggggtattattaacaactggtaaagtctgatgctgatgggtttttactttgaagtttcctaaattgaacatttttctgttgaagaccttcttttttgtgtggtcactggtgaactcatctgcttttcccacctaactgtaatgtccaaggcagaaaatgaattttacaaacatttgtcttcttgtatcttgcacatgataggtgcttacatatttaaatttgcttggagcttaagatattattagcaaagcagaaataattaattttataaaagaaatttstactataaatctgacactcaaaggatttttctaggtgggccaatgagtttacaatgtattcctttaaacaaatagtaggcaaaacacacaggaagtgaacaaaagcctaaaaatagtcatctacactgatgagactctaattttgcacaaatttcacgtgtcagccaatataaaattgggaccccacactctccagtctcaggtcacacagcagtgttgcagttggaagatataccacagagcccaccagtacagaatccctctatattagaaaccagggctgaaggatgagagaaatggggtaaggacaggaacgatcatttggagcctttttcctccacctcagcagaggcaaaagaattgacgaagcagccatcaaaccatgaagtcacctcaccacgcctttttttcagtcttctgacaattttccaaaacagagggcatgaggcctaaaggtaagcctactttacagatgtggaccagaagtgaataatacagttaataggaacctgctgacccataaaaccaagagactgtgaaccaaaaggtgtcatgctaatctcatttctcaccaaagtggctggttcaccttcaagtaggaaaatgttctgatatctgagaaggtcccctacgtaaaacactgtgagcttcctagctggctgaactgccccccagacacagtagtcttaacacatttggagagaaatacaaaggcaaaactcctaggccgaggccagctatactccggctacaccaccctccctgccatcagtggtctgccaaggaaatgagtagtggtacagagaatgtgcagcatgatcaacatccagcattctgtctcaagtgcttatggagttaactgggaggtgcccaggtcaatatagaggaagtcaaggagaatctacatagccatattatttttgagcagttagaagtccccgataaaattgcctgagtgagccagaaaaaaaaatctgttcataaacaaaaaagattttatatcagaaatagaaaaaggaatgtaacttgtaaaatataaatggagtagatatctagagttactcttccagaagacaggagaaaattttatactgaagctgctttatactgtcaaggaatttgataagacatggacttaatgaaataagaagacaatagaataataaaatgaaaagacagctgacagctaaggagaggaagagaaataatgatgttatagaatgtaaatgaatttataactgcagaatgcaaattagacactgaacataattggagcagacacaaaaaacttcagaaaaatccacaaaagatgagagaaagaatagatgactaaaaacacactttctcatctgaaaaatataatgcccattttattgcagggtggtgaagactgactggaataattcacataacagatgtttcctagtatttgcttctcaagtgcttgataaactttagaaatggtaagatgatagagataatgactcagaaggcagataatggggatccaatattgatattgttggtgtggcacaggaaaacatcagaaaaaaatgaaataggattagagtaggtaactacaggaggaagtttttttcatgaactgaagaaagctagtatactactttttaggaaaggacataatagtggcaaacaccaaaacttagccctgaaaattaatgaattattgaacttcagctcagggagtgccacaagcatcctggtgaagaaaaacaagctactctgaaggaacttcacttcgccaggagcagtggcagagtctgtgggccaagaggaaggggatggcctgggagagtcggtcctcagttgttttaatgtaaccgactgctcttatagatggctggattttttttacctttgaggagagggagaagaggtaaatgtttagggctttcttggctaaccgagatcacacaagtattctgtgcatcagaagttggcattggtaatttgaatatctctatactgagtgtccagttatcaagcatagcagccagtgtatcaagccagatttcccagagagtaatagttaaagtctataaaatagagcaatgacctctgaggtctaagcgttttgacagacttcttttatacagatactctgcacagaaaatatatttatggtactagaaaacaaaacaaataagatggctattataaattttcccacaagttcccataccaggcaggagaatgagactgccattttttttttttttttgagacagagtcttgctctgtcgcccaggctggagtgcagtggcaccatcccagctcactgcaacctccacctcctgggttcaagtgattctcatgcctcagcttcccaagtagctgggattactggcatgcrccaccacacccagctcattttggtattttttatagagacagaatttcaccatgttggccaggctggtcttgaactcttggcctcgagtgatctgcctgcctcrgctttccaaagtgctgggattataggcataagccaccacacctggcctgtaaatcccatctgtctgtaattttcaaagtttctttrtatcaactgtatacccatatttgcttatrataaacagcctctaattagagaagagattacaatgtcatggctatgcacaagagttctgttgttaggacataataggaaaagctcatctcaawggaactaaaacttacagactaaaaaaagaaaaacagaattttggcaaatgaaatatgaggcatgtagtattctgcttctatggaacaaaaaaattcttttattattatgctttaagttcgggatacatgtgcagaatgtgcaggtttgttacataggtatacacgtgccatggtggtttgctgcacccatcaacccaccatctagattaggtatttctcctaatgctatccctcccctagttccccaccccctgacaagccccagtgtgtgatgttcccctccctgtgtccatatgttctcattgttcaactcctacttatgagtgagaacatgcggtgtttggttttctgttcctgtgttagtttgctgagaatgatggtttccagcttcatccatgtccctgcaaaggatgtgaactcatccttttttatggctgcatagtattccatggtgtatgtgtgccacattttctttatccagtctgtcattgatgggcatttgagttggttccaatcctttgctattgtgaacagcactgcagtaaacatacttgtgcatgtgtctttatagtagaatgatttatatcctttgggtacatacccagtaatgggattgctgagtcaaatggtatttctggttctagatccttgaggaattgccacactgtcttccacaatggttgaactaagttacactcccaccagtagtgtaaaaagcattcctatttctccacatcctctccagcatctattgtttcctgacgttttaatgattgccattccaactggcgtgagatggtatctcattgtgattttgatttgtatttctctgatgaccagtgatgatgagctttttttcatgtttgttgactgcataaatgtcttcttttgagaagtgtctcttcatatccaggagcaaaaaaattatattcccagccaagctgcctttgtttggaaacgtaaaaaaactcataaatatagaagaataccagaaaawtttacataaatagttatgagatgaaacataataatgagctctcaaggtaaatagttaatccttagtayattaaaaaaaaaaaacagaatggacgaatggggtaattttgccaatgcaggaatgattcaatattaaataatctgttactatgacaggtcacttattcagaatgtttgcgratctcagataattgaaattaagtgtttttggagtttaggtaattccagaagagcagaataggaacttgagctaattccaattatcttgtttagcctttcagtatggactaaggaaggagtggaatttataatatacattcaaacaattgcacttctctgctttaaaccagtgttaaccaccaaaatataggaactgttaagatccatcacaacacrtgttttactggttggactgccatggaatcccagtgacccacgattagggtccacttcccctagtttctgttgtgctgttgggccacttttatgaacaactgttggtgacatcagagaattttgcccatctcagaattgtcacactgtgacaaatcccatggggtagcattttctaaayggataattaatttaaaattttttattttggttatttacatttttatcatttaatgtgtgaacacatacccaatgctctctttgcctggaagattggtaaaagtacaaaatctcaagccttccccgaggcctactgaatcctaacctgcattctgacaagatcctcggatgattttatattcacattaaagtttgagaagcaccgttaagatcactccagtttcaaaactccagataataattcatcttcctgtataattctttatcaccataagagcttaagggagaaaaacccatgtgctcttttcaatagttactgcaaaagcatttgatagaattctakactcattcctgtgtttttaaatgattgcattgaagtttaaggtttttttttgagggcaattggcatctttataataataaactttacagttcaggcattaatctttttccatttattaatctgttcmaaactgtaccattataattttattcctttatatttaagtttactcatgtatatttttctgctattgtgaataacatctttattctattgtgttgtttattcttgacatgtagaaaasttatcaattttatattcattttataactagtcaccaggatgaactcttagttctaataaatttttagttgatcctcttgagtcataactaccattgacacttctgatttttttttaaatctttaattttgtcaaggaatagattcacatagccttaataatatagtaagctttaaggacttaaaaattatttgrgcttgcctctgcttctggggaaatggaatgcatgttcttttccctattcttccgtaaatacaactaaaagcctccaatattatatataaacaaacataacactcttaaaagtgaagagaaaaaagtcagactaagtagtgaaccttgggacccaaggaatgacatagtggtgagttctttgagttttctttttgtttatatttttctgacctggagctgragaggctggccacccagaaatgccaatgggtacaggctctgatatggtttggctctgtgtccccacccgaatctcatcttgaattgaacttccataattcytgcatgttgtgggagggacccagtgggagataatttgaatcatgggggcggtttcccccatactgttcttgtggtagtgaataagtctcatgagacctgatggttttataaggggtttccacttttgcttctttctcattctctcttgctgccaccgtgtaagaagtgccttttgccttccaccatgattgtgaggcctccccagccacatggaactgtgagtccattaaacctgtttttcttcccagtctcaggtatgtctgtatcatcagcgtgaaaacwgattaatacaggctcyartgaaagcctgctctctgtagccaaaggaccaagaaagaaacaggctagcaagacagaaataatttcagacagtaactgctctactctagccaaacaccacacacacacacacacacacacacacacacacgaaaaaaactgtaatgcctccacctaggcagcraagcctgaatggcgagcctggacttccaccctcctggactgtaataaggcacccagacttatagaatctggatcttgtgcccactgagcagtaatgtggcagccctccctctccctgctagagtggtgtgagaggagccawggcagagaggcaggaccttcacaccatccagttgtaatgaggtctttcccctcagttggtcaatkgaggccacatggggagtaataagaaggcacccctactctcccagccagagtgatatcaagagaggtccagtaggtagctggaccccctcccagcaataaygaggaggccttccccaccttagtagtaaggttccttgggtcccaagattcactagcctcctttttttctcttcacctttaagagagttatgtttgtttatatagacagaaaccaaatggagaacctagccttctcctcccacctcctagtaatgaggcagtgcccccactttttccttgccaaaacaatgtcaggaaaagccacctaaaacagtaggattaaataagatccaggaccccaaactaccgacattacctaaggttcaatcacttgactgtttggatattgcaatcacaacaatcacttatgtcaagaaccaagaaaatcacaacttaagtttaaaataacaattcctaggtgcccacacagaaatgacggatgttagaattatctgacaaggatttttaaagcagctatcataaaaatgttaaaataagcaattagcaattactaacatttgaagcaaaagaaagaacatctcaggaaaaaaactaaagcctcagcaaagaattaaaaggtttataaaccacacagtaacttttagaactgaaaaatacagtaacagatgtggaaacccaatgaatagtctttgcagcagaatggaaggacagaggaatgaatcagtgcactagagactataacaacagaaattcccagatctgaacaacaaagaaaaagcagactgaaagaaataaagaacagagcctcagggatcagtgggattataacagaagatttgacatttgtgtcatcggattcccagaggagaggagaaagaggcagtactgacaaagtacttgaaataaaagtggaaatgttccaaaaacacagattcaagaagctgaggaaacctcagacaggataaagtgaaagaaattcacacaaagacatatcatagtcaaacttctgaaaacaaaagacaaagaaaatatttggaaaagcagtgagatagaaacaacttacctgtaagagggrgacagttctaatgacagaggatttttcataacctaaggaggccagaaggaagtacaacatttttcgggggaakcaaaggctgaatgaggagtctagacttccaccctcctgtaacaaggcacccagacacttgtagaacctggagagaaaataactgtcaacatagaattttatatccagcaaaaataacctttaggaatgaaggagaaactaagagcacttgttaccagcaaacttccctcaaagaatgactacagatagctctctaaaccaaaaggaaatgaagaaagaagaaatttcggaacatcagaagggaagaaaggatagctagaagaataaaaatatgaataaatacatttttctactcttgagtttttaaagttgacagttgaagtgctgwtgtggctctgaatgaagcctgcttcattctctgtggtttctctcaagggatggcgttcagtgtctgtggcttttccaggcacrkggtacaagctgtcgatggatctaccattctggggtctggaggacagtggccatctgctcacagctccactaggcaatgccccagtggggactctgtgtaggagctccaaccccacacttctcctccatactgccctagcagagattcttcatgacagttctgctcctgcagcaggcttctgcctggacacccaggcttttccaaacattctttgaaatctaggcagaggctcccaaacctcgacttttgcattctatgcacccacaggcttaacatgacatggaaggcactaaggcttacagcttgcaccctctgaagcagcagccttagctgtacctgagccccttttagccatggttagatctggagcgsctgggatgcagggattactgtcccaaggctgtgcagtgcatcaaggccctgggcccacaaaaccattctgccctcctaggcttcccagcctgtgatggcaggggctgctgtgaaggtctaaagcattggggatttcagttcaacatgagatttgggtggggatgcaaatccaaaccatattaaggcatgagccatcatgtccagttcacatctttatataagtttgtatttgtatttgtgtgtacaatgatggggtatgtgtgtttacacatgtgcgtatttcagaagrtacataataaaatgttaaatagtagttgcctttataaagtagctaggtggaagtagagataggtacacaggtatgtataccctttctctttgttcactgtgtattttaatagatattctagatattgaggtacagattgtttgcatagaaatatatagaattattctgtgggttttttgttaacatgtgrtatcataatatgtgtggtaagctaaaatttccttttcatattagcaatatatcttagaggtcttcctgttctccaaaatacagagcattgccatagtcagtatatatgaccttactttactctttttttatatatatactttaagttctagggtacatgtgcacaaygtgcakgtttgttacatatgtatacatgtgccatgttggtttgctgcrcccactaactcgtcatttacattaggtatttctcctaatgctatccctccccgctcccttactttactcttaactgatgtgtaacatccctcagtgggactgcaattgcagtgtctctagctgttccccctattagtgaacattttactggatgcacaattttggtattacaaacaatgctgtgacaaaaatacttatatatggggcttttctacacaggtgctttaattttcctgggctagatatattgaaaattagaaatactaggtgaaaggctaaataattttaaatttgatactgctaaattccctccccaaaactatacccttttgtagtttcctcgagctcacacttcaccatctatgctttctttgtccaccgattgacatatggataaggcaagaattttcccaaaattactctgactrcctcaagcttaaagccataaaaaaaagttttgacattttttrtggaaatttgctctgcctcttcctctttcagttcagttctagttgctttctgttttctaggaaccctcataatttttatctctatgccttcttattttctagcactattatggattgctttaaaagtatgtttgggccaggcatggctaacacctgtaatcccaacactttgggaggccaaggtrgggtggattgcttgagtccaggaattcaagaccagcctgggcaacatagtgaaacttwgtctctctgaaaaatagaaaaatcagtcaggcatggtggtgcacacctgtagtcccagctattcaggagtctgaggcaggaggatcagttgagcccaggaggtggaggctgcagtgagccatgattgagccactgcactgtagcctgggacaaaatgagaccctgtctcaaaaaataataagaaaataaaagtatatttgtatgatgttaccattgggggaagctgtgtaaaggggtacacggaactcattgtataatcttttgtccttcctgtgagtcgatgattctttccaaattaaaaggtttttttttttaaacatatttatgccttctagggacttggactgaggggaagtctggarcaagtgcccagttcgtcattttgattccatccwgactaaattgttttgactcattacaaaaatattatttttttgaaataacaaaatttcatktaccctttttaaaaagaatgaggtaaatatatacagacatgaaaagaagtttataaaaaaatttgattttttatatttgccctttttaacaaggaacttttacttcctaatttgaaaaacrgtatcagaattggggtgagttacaaagatgtttcaataaaaagatgctcataaatgaattggaataaactgtaacagttatgaatttacttcttctaaagatactagtttgtgtccagtttttgtaaagagtttcctgtaaaaattattcttaatggtgataatcaggtaaagctatgttgatgaagcrttgtttaactttatgtggggatatatgaaatgatggtcagttgcagcaccagtgttttcagggatccaagggattcagggccacaagttggtagagcatcctcctttccagtcggggccacagtgggccacgtgttgtggtaaagatacttaatattaggcattattttcaagcattttttgttgttatcaaataccactagcacctagttaatactgtttatgggttttggagaaattccattttattactcctttttgccacccagggccttggtaaagttaagctttccagcaggaactgtgcttctccatgtaatttatcacccttactctgctgtcctaagcttagaactagtctcagctgtgagctgatgtgctctgctgtgtttaactggctacccccagagagggtgtccagatgagatctgaagggagggtgcctgacagtgycccagctccatgcggcctgagatgtgctctgctcttgcacttcctagataaattgggaaacttgctggtaaataattctataacccactcttttccttaggctttttggaaaggatataaacaacggaaggagtatatgcacaggyggcaaacgttcattgataatactgattctrttgtgaaggtaaataccctttcctaccataccaartgcttggcttaaacgtttcccctcatttcrtgtttaatctgaaagacagctatagaaagggagggtayatgtgagccttgaagtcagaaggcagtactggatttgaatcccagytctgctgctcatttacctaatcatttttcaagcaggttggttaaaccgstataaaacctcaagtcctttatgagtggttatgagaatcacaagtgaaagtgttctataaccaataaatgttctttgtctagaaagttcaagttgattatttagactttaggtagaacccagctttttttcatgtttctctttccacatttgcttaagcatatttagaatgctcagacataacagaacaaaaccaatgataagaggaagtagagctaatttagggcctatatttgggagctgaattagtcgaacccaggtgaatagctctgggtgagaaagaaagggtactgtgatgtccactctcatggatctgaaagccagaggactggacaaaaatcaacttggaaatctacaacttggagatctacaagtctccagcttggaaatccagatgagagtggaagcaatggaactggaaagtagaatcagattagtttaaagatctttcaggccaggcttagtggctcaaacctgtaatctcagcactttgggaggccaaggtgggaggatagcttgagcccaggagttcaagaccagcctgggtaacatagggggacctcatttgtattttaaaaaataataataaataaaaacaaatttaaaaaacgttttaaactgtgaagacagagaataatgtgacccagatccattgtgcagtagctccttgatgaaatagcatcctatggaacatatgcctattctgtcaaaaaccattggtagcaattggtccctcatgagacctcttcgatgttttcctgtaaaaacttaaaggatattggatgcayttaaagggatgttagaagaaaccctagacttagtttacttgatttcctgactcattgcaactctcagcaaaacgcttcacccttctggcttttatttactgagtttaaggtaaaatagtacaaagttaaattattttccccacttctctcttattaaggtggtgaaattwagagtaacatgtaaagcgttttgaaccccttaagaaacmtcagtgaaagatgaagagtaggctttagagaytgattattcagtgggctgctttttttctttatcaagtatcattgtttttagaaaaactacacaaaaccgtattacgggttgtttggtgattactttgacttttctctttattttttgttgtacttttctattttttaaaacctttcagattcagtcctggttccgaatggcaactgcaagaaagagctatctttcaagactacagtatttcagagatcatgtaagaaaaatgcctgtgggattttatccaggttgataatgacctaaatgaatgctttattgaaagttagcattgaatgatttttattgaatggtgracatgaacacttaagaaataatggatctkagaacttcatatgataatatttggaggcttactgttttcattcagaaatcatgttgagagttagacttcaccagtcaggactcgatagaaaatgggtgaggggaaaactgtgggctagtaayaccaaagagaagactctagagaaatattttacagcattrcatatgtagttttttcaactgttaactgcttactttaaatagaagcccctgggagggatttcttcctgaatmtttaaagaagagatatgggaacatagattggatcatctaagttgtgtgctaaaattattttccctttttagatctctttgtctaggcagttcccctacagtcttgtttgtacttttagctgacttatctgacctcttcttcaaagaaaatggaaaaataaatgttgaatacaccacattgaaatactgtcagttctaagtagtgtcagttcttaaatactgacagttcttaaatgttctaaattcaaaaatratggagtaggtgggactctgggagatcaagacttgtcttaatcttttgcagaataatgaaattgtgaaaatacagtcactgttgagagcgaacaaagctagagatgactacaaaacattgggtaagtgagagctttctgaaacaaagcaaggattttttataaaccaggcaaggacatattggtccatattggtcacttcagaggctgctctaagaacagaggatacccattgtttccagtagattttgatcatctcaggccccaggttctaaaccagtacacagaggarcacatggtgaaaggaaatgggccttcctattaaatggaagggatcagccacatggtataatttcttcttcaaagagagtggagttggcatwaatgctgatttttttttttcaatctaagcragagtcaaaaatctaatgcaaaagagttagccagaaaataaccttatatttaaattgtttaatttgttagacatagtctcatctcccaaaaatgacaactgcaaatatcttcctacaatttcattttgaacttttcacagaataatttttaatttttgtttgtttttgttttgagacagagtctcacactgtcgcccaggctggaatgcagtggcgcaatcttggctcactgcaacctccacctccccagttcaagcaattctcctgcctcagcctyccgagtagctggggttacaggcaccagccaccacacccagctaatattttgtattttcagtacagccggggtttcaccatgtgtgccaggctggtcttgaacccctgacctcatgattcacctgccttggcctcccaaagtgctgggattacagattaaattttttaataaaaatttgtagaaagtttgaaaatagcaaaataaaattcacccaaaaataacaatcacattttgtgctatctccttacagtcccaactttgcctatgtttgttattttggttttttacagatcataagttgattctttatatactaaatttttaacattctaattatcacgggaacatgcacagtcaaggagagcttgatgataaatttactagtacttacagtgcctagtaagtttagccagcaccttttattgtctaaagtttgtctgaattaagggatgaagtatatggctcaagaaagatcttccctggtacttgttaaggaaaatctagggacgcttgaagtcctcactctgcctccagcctgcagaatctactgaataatgtctcattccactagattccagctcacctctcagctggtagatatgttgttgtttttggrgttttttgttggttttttttgtttgttttttgttttttgttttttttttttcttgagacrgagtctcgctctttcgcccaggcaggactgcagtggcgctatctcctgcctcagccttccaagtagctgggastacaggcgcccaccaccgcacccagctaattttttgtatttttagtagagatggggtttcaccgtgttagccaggatggtcttaatctcctgaccttgtggtccgcccgcctcggcctcccaaaatgctgggattacaggcatgagccactgcgcccagccgtttttggttttttttttaaagaaggctaaagaggatttttttttctgagccctaacactaaaatatgtttgctgttgcttttatatatgaaagatgacttcaaaataaattttccaaatgaacacaggctagttttcattttattcaaggtaaagtgtttttttttaagcagttatagtgatgttttttgtttgtttacttttttattacaaagacaaattccaattttaaaatctaggcaactttatattggggcataaaaggtaaatagagaaaccatctcggtgagtgagttagatctaagcttctctgggcttcagcaaattgggtgcttttatggtaaccaaaacataaattttcatttctttcttagttcagcatctttagaaaactaaggctttgggattttctaatttaaaaaaaaataacttttctaagtttgttatcatctgttctcmcccttttattctggaatgtcactgaacgcattccagcttgaaagatgctgaaactaagatgtggtcagttgtaggagcagactataaagtggtctgatttcctgaaattaaaatacctgtaccacaaagtcattctcagatgaagatrgcaaaaagcctagtattgatagaggaaatattaaattcgagccataacaattagtaaagctaaaatactaatttagttttttccgatgggactgttaatacatatgaagagacacaacccttagtgggtgggagaggcagccatcaactctggccacagtgggagggctcatgttcccytaacttggctgcatggatgagcggtggtgcattgctaaggccttccctgaagtggtcatgtcagtggcagcatctttgctggaaatagaaggaaaataaattgatgtgcttcagtggtcaggaaataaagggtcccatgatccaaggaaaattctccaataaaggccatttatgcagttgtttgtggtttatgcagttgttttggtgttagttttcttactcctttagtgtcaaaacaccacagaactaaggtggaagtaaaaggaagactgtcaagggcctaggygtaaaggagggcaactaatgagatggccatggctggactagctcttccaagtcatctttctattactgggtctaatcattcgtcctcaatggaccagacaatttattcttacagtttacccagatctgatctccctaagcatgttaaaaatatttttccaagagtcagagtgccaggaaattaaagcctaaagttccaggtactaaggggaaaacccttttagaatttatgtgagaatgtccctctcaataacaggggctgacccctagattctgagcaccctcccttggccggtgctcaaaggacaagggccaagtttcaatttctaaaatctttttatttcagctaagtagaacattcgttttacttatcattctgttggttcctgtttggcttttacagtcctcccttcctggcccttttctaattcagctttcacctacttccggctccttcccaaagatcctttgggctgggagaaaccactttctgcttcctgcagcaagaatgtaagtcacttatctagctcaagcacaaggtctcagggtcgaggtaacttatgttaactttctttcccaggttcctgaggaatgaggcacagataggactatcttcttagcgcatgagtccagggaacagtgtgagagagagctgataaaagggataaaaggggagttgataactagaaaagagtggggccagatatctgttttgtgcrtttatttattgatcagtttccttgtccagattttaaattgtgtgggggtgggtagaatgattctcaccctagaccaagtactttcattggtatatttttctagtaattatttaagaccttgtttcyttcctgttgataatcattccaagctttcctaattaaagtatacctgttcctgtcactgcagttggctctgaaaacccaccattaacagtaattcgcaaatttgtatacctgctggaccaaagtgatttggatttccaggaggaactagaggttgcacgattaagggaagaagtagtgaccaagatcagggccaatcaacagctggaaaaagacctgaacctgatggacatcaagattggactgctggtgaagaacaggatcacactagaggtcagtggggtttttgggactgtcagctcccagaagagggaagaygcctacatacagtcaagagtcacttaatgacagggatacrttctcagaaatgtagcattaggtgatttcatcctgatgcaaacatcatagagcacttacctaaacatagatggtggagtctactacacatctaggctatatggtaaaaaagcctactgctcctaggctacacacctgtacagcttgtgactgtactgaatactgcaggcaattgtaacacaattgtaagtatttgtgtatctaaacatagctcaacatagaaaaaatacagtaaaaatatagtactataatcttataggactwatgtcttatatgaggtccactgttgactgaaacattatgttgtttgtggttatatatgttcatgacactttggtctagctaagttcatttggaatctaagataagtttttatcgtttttattataaattagtggttcttcgtctgtaaaattttaagcccgcccatttataacattttgtaaggcttctttatcattctgaaatgaaatctatatgataaaatgtactgatgtatataccttcagaataagactagggcctttatatgaatacaaaagagatatttaaagagtaattaataataaaagcacacattttattgagaaaatgtatatgcctgatgacactggaagacatgatacagttaccagaggtgtagacctcttcacagaacagctacagattatgagggcttcagtggcaaatgaggcaggaactcattttccaaaatggagaacaactatttgtaaagttcaacattagccaagtgtagtctccacccaatttacatagcagttgcaattctagaaaatcctagcttttgtgtggggaaaatgtattatgcatctacataaaacaattagattctaggctcagataattacaaacagaatcttgacccacgtaaatgaccagtaagacattcaaaagttctgtcatgcaaggtgagggcaattatttacacaagaccatcccacaaattgccagatcacagagcacctctcatccccaatccctgctcactagaaaccaagagtgcccttcaattgttaagatattaaaaaacacccctacgtatttccaaaatgtgactccctacaaagacacactgcccccgttatgcccccattgataacttctaaataaattacggtgtggtttcacatctgtgtgaaacctgccaacatcagggctcaaaaaaaaaaaagtataaaaagtgtcatttttacccaagaacagatgcctaagaccactctccctgtccctgttcccttcctatgtgccacatcagttttcagaaaactgataggtcaaagagggaaactgatcttctggaagctctgagaaggctacagtggctcatagagcgccagcggccagcaaccaagcgaacgttctggacaacggggagatgagcagccacaggaggctgccagttacatgggcatgtgaatgccccaggctggtcctccagacctcataaagacaccagggcaattgtggaggagaaaataagaaaaacagcattttataaacagaaataatcatctcttctaaatattcaggaataaaactacagtttaaatgttctacatttaactctacttttattattttatccagaaaaacaacagtactttttaaaaaacaatgttatttgtattgtttgacatccatgagaacttttaaagtgtaatatattccagaaggattttcagagaatgctttttatagccttaaactgctgtttcacgctatccccataaaatcataaacaggaaatgtcttgccttttaaaataaaggcttagttgcaaatcagtacatagtttaaataatatgtatcttttggaaacacaatcatggcaagttatcagatttttatgaatgcttgaggttttgtgggggttttttaaagccacttatcactaatagataacattgtgaagtttttcaacatatttgcaaacaccagatatgtatccagcattttttagcggttaaattaatgattattaaatatgtagctgttagccttgtcattgacagaatattagtagtgatacaagaacagagcaattgaagctttatttatagtagtgaaaaagtgggaaacgacctgaagcccaaagcaatatgcagagggcgatagaattagtttaatatggatgttgtatagccactaaaaatgatggtttttagactattttaaagcaggaggaaaggtttgcgatatagtagaggagaaaatagtgcctamggtagtatgatttcttttattatcaaaaaataataatccagaagaagaaagaagttaagtgatttttctttgggtgatagttaagtttatcttctccccctcctccccacacctttttatttttaacaatgagtgtgtgtttagtgaggaaaagagagattgtaaagggaaatggctttgttcttatagaacaatgctagctcttgctagtaaccttaacattttttatagttcttttaaatcagcattcctcctaaaatcctcaaaatctgtaggtcagtgaagtggctaacattggttttaggcaaaaagaatggtttggagaaagaagacagagcaactgaaataagaggtttcctggaggcacaggagccaaaaaataaaaaataaaaaagtataggtcagcctagctggaaggaaagcctaaattaagagactgaagctaatctaaaactagtgctaaaattcccattcatgagtatgatgtatcatctaggagcccagatttgcaggccagtactacctgaaactcaggactgagatttttaactattaatacttaattatactacttcactgcttatattaacatgtggccttgagcatgtttcttaacctctctctgagtgtgttttcttccctggaaaatgktctaggtgatttacatatatttttaatcttcacagcaactcagtaaaattgctgttattacactcactctacagatgaggaaactgaagcttaggttaacctgtgtaggtttaccaagctaattatactctscagatacccatatcttttatractccaaagcccaagcccaagcccttcatactagcccacactttctacaaaaacgtttatatcatagcatactacctgcatgcagatatccctttatcagagcaaggggaaaggtggtggcaaaagggcaatactgagatgggggactatcatgaacaagccaaatacggttgctctttcaaaccatggtattcctccaatgttcaatatttattaagaatcaggaaaartgagttttgatgaataaaaagtatctgcccctgtttgttatccttgtctgggttggctcttgtgtccrtcttcaagcttcccaaagcaaacctccattcacacaagcacattctggagcaagtcagaacctcacagggagaaggaagaggggctatccccattgctgtgccgggctctgtccttggagctccagcagacaggtgctgttccatcagcacagccaccggcccgtcctctctcttcccctttctgggttcagcattgcctccgttgcttccctccctccattcctctcattatcctgccttcaccaactctctctgtttctaatgcagaggaatttagatctgccccagatcttgctcaccacccctaccctctcatctgtatatggcaaaaaccattaaccagaagatgaagtctgcaacaaaacaaaaagcccccagtttctagagtgacctccactgaaaacacttgggagggaaaaggggggaattataggtaacaagactttcctgtcgtatatttaaaatcaaggtgatagatttattctgtgtatttgagggagttgaacgatttacatacatgtcgccagctatctgaagaggaaaaatgtggattaactggcactgtaagccacatttattctagtgatgtcttaggacttcttatagataaggattatcagacagccgcctgcctagattcccccttgacctctatctggtggtaactgcacttcctttctttgtactgaagacattttatatattggtaaaacaagggggaaatgttgctttttwaaaaatgttatcggaatgtaaatcaactcccctccctccttctctataaaagcaattggggtgacagaagtaagtgggtaagtcaaggctgcctctctctgaattgagaatgagaaagaataaaatcatggacctggaaggcaacagatgtagccacatggaactgtcttactccagagcttcctagagctctggaccccagctgctcaatgggctgaccccagctatgggagaatggggtgccaggaagtaaacagatttagagcttgccatttaggcaagacctgacggtggttctcatccccaggggcaactggaaatgggggcgggcccatgtccgcttgtgaaaatgactaggggcccctgctgatagccggtggtgggaaggggccagggtgatagacrctggtagtgcatgcagagcaaaacactgttgtccacactgcccatagtgcccctctaaggacactgggccagcattcctgatgtgcaaatagagtcctcacgtggaggtccagctaagagctcagtcaaaaatctgaaaaaagttttaggaaaagcaactttcttgccacttactctgggacagtgaactaatgttaagtggcaggggaggtgttctagaacagygactttcaaatatgagtcgcatgccattagggtcatgaaatcaatttagtgtgtcacaatgagcaacctttaaaagtggaatagaataaaagcaaatagaaaatatcagcatgtaccattagtgagagagagggtgtatgtgtgttcactaataaaagatggaaaatgtatttcttactgcgggtcccagacttctgagttgccagtaccacaggcatgagccaccacacctggcttatttttaaaatttgtttgtagagatggggtcttgctctgttgcccaggttgatctcaaactcctggcctcaagccatcctcccatgttggcctcccaaagtgctgagatcacaggcatgagccaccacacttggcccgcttccaacttttcttccgaagtttcctggcttctcttaaggcctcatagaattgaagaaagttagggccttgctttggattaggcttaggcttaaaggaatattgtgctggtttaatcttctatccattccactcaaactttctccatatcagcaataaggccattttgtctttttaatcattcatgtgttcactgaagtagcatttttaatttctctcaagaaatttttctttgcattcatgacttggctgtttggtgcaagaggcctagcattacgcctgtcctagcttttgatatgccttcttcactaagcttaataatttctagcttttgatttaaagtgaaagatgtgtaactttcacttgaatactttgaggctatcatatggttattaattaacctaatttcaatatcattgtgtctcaggaaatagggggcccaagaagagaagagaaaaaggraagttggtgaagcagtcagaacagacacatttattgrttaagttctatgggcgtggtttgtggcaccccaaaacaattacaatagtaacatcgaagatcactgataggctgggcacggtggcttacgcctgtaatcccagcactttggaaggccaaagcgggtggatcaagagggcaggagatcgagaccagcctggccaacatggtgaaaccccgtctctactaaaaatacaaaaattagccaggtgtggaggcgcgtgcctgtagttccagctactcaggaggctgaggcagtggaatcgcttgaacctggcaggcagaggttgcagtgtgctgaggttgcaccactgcactccagcctgggtgacaaagcgagactccatttcaaaaaataaaaaaagatcactgataacagcgccccgtaatagatagtataataatgaaaaagttctacatattgcaagaattatcaaaatgtgacacagagacacaaagtaagcacatgctattggaaaaaaatggtgacaataggcatgttcaatgtaggattgcacaaaccttcaatttgcaaagaaaaaaaatgcggtatctgtgaagcacagtaaagcaatgcacaatacaatgaggtatgcctgtatttccaattacgtgtgtttcaatcctatatgtgaagggaggagataaagagtatgagaattaaaaaagsagtaatctcatcaaattttttacaggatgtaatttcacacagtaaaaagctgaacaagaaaaaaggaggagaaatggaaatactgaataacaccgacaaccaaggaataaaaagtttgagtaaggagaggagaaaaacactasaaacatatcagcagctgttttaccttttacaggtgagaacaatttatcgttcactctgagtttgggagtaatactatgttacatgtttgtggcttacagggagtattttgtcatgcktcagctataatagcatacatgttttgagcatctactaagtaccaagtgctgttgttggtgctttacatrcattatctcatttaattcttacmataaccctgggagccgtgagagaatgagtactgttgttattcctgcattacagatgagaaaactgagacacagccagtaaatgataaagcaggggttttgaaacgcaggcagtttgacttcagagaccatgctctttacagtattatactacggttaccttcagaaacaatataaatctgataataacaaaacaaaaacaggtgctgtcatccatgaaaaaattaaaataactgtatgtgaaaaacagatatttaccagaaccagtctccccttctatgggggaagagccagagggtttgggatttcaaaataatatttcttttttcttgtattattttcatggcattactatgatctaaatgaatagtaattttccattgcttcctgagtgttggtgagaactgataagtttgactggttatggttggactttgatggatcacttattgttttgtttgaccattgattcagcccgtcagccctactagcacatacagctagtcacagaggaaactgcatgatagcaatagaaattaacaagcatcctcttcagcaggaaaagtttccccaaagaggtggatccatagttctcccttgtaagagtcagatgtctctcagagtggggccactgctgggattccttcaaagcctggagatgcttagatctttgtttgaggatgtcactggcagtagatgtatagagagcacattacacaaaccataaataagaggcgtggctaacctcatggagaaacacgatgttaattttggtaggtttgaaaattctctacttggaataagagattggagaacatcttcaaacatacgaacatcttcacacaagtggccaccacatggcggcacagaaggaaaagsttaacagtacttagaattgtctgtggaacccactgtttcacgccagcaaacctagaaagaaagggggctcactttaaacaggaaaggactttggtctgcctaatttagtagtcaaccaccagtttgaaatttaatcttaggcacttatcattttttacacccatgaaatttcaagcatattgaagattctttagaatttagttttctcaatttgacagaatttgtcataagttaaaatctagtcattgtttattatataggtggaggcacatttatgggaagaagaaaaagtgcaggagcatgtttagaataattccaccaaacttgatccgcaaacaatccaaaatgtacaaccaaagggtgcaaccattcagttgtatcaagtgaactctctcttgaaatcatatatttttcttctccttctcttcttttgaggcgttagcccaatatcactaaagaaattatagaaaagcaaatggcctggattccttcgacccgttggttacactttagcaagacttctttttttgtagagacaagatgtcactctcccacccaggcaggagtgcagtggcgcaaccacagctcactgcagccttcatctcctgggctcaagcaatcctcccaccttggcctcctgagtagctgggactacagacacctgccacaatgcctggctaattttttcatggtttttgtagagacagggtttttccatgttgcccaggctgatctcaaacacctgagctcaagtgatccacccatctcagcctcctcctaaagcactaggattgcaggcatgagacaccacacctgacctagcaaaaattcttaaccaaagccgcagtcagctagtataggtttttggggggtttgtctcttcagtatgaacctaaatttaaaatttttaggtaaccttaggaggaatggtgagtagdcatctttctttagttatagagtaagtttcctttctcctaattcctatatacttcacattgaaaaacagtcactacagagctatcaagaaaaagtactgagctgcttatttataaaatttcaaccaatcattatgaacttaaaagtaaacctaagtgataaagtaaaccagaatttaaggcttcttaaaagctgcccaaactgcttgagtatattagatgaataccagttttcaagtatggaaaaattttcttctcttgtcagaaagaagatgaagattaggagtattaaatttctctttgtacatacttcctctataacctgaacattattgttctctttgaacttctacctggtaggtgtagctgctggagaaaagccacatcaccatgaaggctggttctgtatccaatgggtccatcctcatcagagcccacagggttccacgtccattttaagttctttgttgttttttgctcatggtcttctggcacttcccttatcaactgtcctgaccttcacccctctcttcagcctccctacctcactcccccttctcactctgtgtagaacattgtggccattttgctgtttccacattgtaaatgtattcttttctttttctttccagtctgacaagatagtatgcatttctactcatctatcaatccttctaggccagtctatgtagccgggcccttagtccactttctttttttttttttttttttttttgatacagagtctgtgttgtctaggctggaatacagtggtatgatcacagctcacggcagccttgaaatactgggctcaagtgatcctcccaacctcagcctcttgagtagcagggactgcatgcgcacaccaccacacccggctaatttatttttacttttttctagagacagggtctgtccatgttgcccaggcttgtctcgaactcctgggctcaagctatccttctgcctctgtctcccaaagcgctggaattataagtgtgagccaccatgcccaagctttgccagtgtctttggacaccagattctactggctacccgccctgttttctgcgtctctacaataaatattaatatgtggttcaaaaaggtcaacagtgaaaagtagatataatatgttaagtgtatcatatagtgtgtatcatttaaatcctatcataattttctactatagcttcctatagtatgatatgaataatattaagtaattaatatttgatattaatattttaaaatattaatatatgataggaagctaaagtagaaagttatrtaatatcagtctataggaaactgtagtagaaagttacactatatactaatagcatagagatgagtacctggcatataaaaattattttatatactcatctatatgcttttagtgacattaagtcattgaagagcagggaatcagatactgctttgtgctttaataatatattaacttattgwtttgtgggatttttttgttttctttttccttctttccttctagaycaaccctttatacttggctaagctgattttccagatgccacagaacaagtccactaaatttatggatactgttattttcacactatataattatgcctctaatcagcgagaagaatatctacttctcaagctttttaaaactgctctggaggaagaaataaagtatgtatacaaatatgtatgtaaaaataccartgaatcaatccttttgttagtggtggctgtctttgatttactaaaattatttttaaattcttataagttattcccacatattaaaatatatcaagtttcttgagaatacttctatattattagagctatattcaagtaccattttctcccaccagtgatactttctctagtgttaaattaacttttgattttgtatgcctgtaacaactgaaaatcaatagcatattgaaagtcagtgaaaacatttaacttaattaaaattctgagtagtaaagccattaacaggtgggaatgcagagtgcaatctctgcctaaatagtcttcccttctttctagaacttaaactacttttgctaatttattttctgactcagttaatgtaaaaattgtataggtagctataatgagtgggctgagaaacaagcatgagaaatgtccttagctcaggtggcctccctaacttgtggaaaccttaagttataccagttcctattggttttgggagcacgggagccaggcacctctgccctccaggtgtctgtaagcccacgagacatgtgattcgtgagaaataggaatgctatgcagtggaatgtggtaagtactaaatgaaggacgcgtctaaatgaaggacatgtacaatgtatcaggttagaggacaggaggaaagattccaactaggttgactagtaaagattttatagaagaggaggtgcttgacctaaaaccttgaggaacagctacaatttttataagaagagatagaagagggaaataaggcacaatggtggtggaaacagcatgggcataggtcccaggaggaaagtagattagtctagccagaaagtgacttaattactaactaccaggagatgaatcctgaatgatagggtagggccaggtagtgggagactctgagtaaaggcccagctgttaaggctctatttgctttttggggatctgtgaaatcttttttcttcttcttcctaggccggagtgcaatggcatgatctcagctcactgaaacctctgcctcctgagttcaagcaattcttctgcctcagcctcctgagtagctgggactacaggtacccgccaccacgcctggctaatttttgtatttttagtagagaagaggtttcaccatgttggccaggctggtctcgaactcctgacttcagggggataggtcccagagagatggcgggtgaagctgtgcatgcacgtgaggtctgaggggagaacatgggttttggttgggctctggtagaccagttattcttttgtttgggcattgattcaccctcattcgccttacaagcacctacaattagtcaaaaaataaacaaaaaggccgggcacggtggctcacgcctgtagtcccagcactttgggaggccaagacaggcggatcacgaggtcaggagatcaagacatactggctaacatggtgaaaccccatttctactaaaaatacaaaaacaaaattagccagacatggtggcgggcgcctgtagtcccagctactcaggaggctgagacgggagaatggtgtgaacccaggaggcagagcttgcagtgagctgagatcgcgccactgcactccagcctgggcgacagagccagactccgtctcaaaaaataaaataaacaaaactagcatttaaaggtgggaagaggagcacagcaaagaaaataaaaaggaatgactgggtaagataagaaccaggcattgtcaagctctaaaggggaaggatgtggaagagggagagaaagtggtcaaaagagaaaggggaggaagagaggagagaggccctaagaatcagcaaccataaatcaagaaaagctctctcagccatctgacgtggctagaagctgtattgcagctttgagtgggatttgaaaaagtgaaaacagttcattcaatcaagaaagttgtttttgaaatttgataactacaggggcatggtacttgtaccgtgtcacccagtattgctagtcctggtccattttcagctcatacctgccttctagattgaaattgaggctgtgactttattttcagatcctcaaattgctcatctaagaaacatacacgttataaactgggaacagtggctcacgcctgtaatcccagcactttgggaggccaaggcgggtagatcatttgaggtcagaagttgggascagcctggccaacatggtgaaactctatctctctgaaaatacaaaaattagctgggcatggtggcatgtgcctgtaatccgagctactcaggaggctgagataggagaatcgcttgaaccctggaggaggaggttgcagtgagccaagatggcgctactactctccaacctgggcagtagagtgagactctgtctcaaaaagaaaaaaagaaatatacaccttataaatgattgcttgtttttaaagcacaccaacttagattttcatagagaaaagtataattccatgaagtccttgccttccagagggagaatacattgtttaaaactgtatccaggcccagaaccatggctcaggactgtatttccagcactttgggaggccaaggcaggtggatcacctgagatcaggagttcgagaccagcctggccaacatggtgaaaccccgtctctactaaaaatacaaaaagtagccccrggcatgtggtggtgcacacctgtagtcccagctactcaggaagctgaggcaggagaatcgcttgaacctgggaggtggaggttgcagtgaaccaagatcacaccactgcactccagcctgggtgacagagcaagactgtctcggggaaaaaaaaaaaaaaaaaaaatctgtatccatggaagcaaaccattttgttttgtcttgggcttttttagatcaaaagtggaccaggtacaggacatagttactggtaaccctacagtcatcaagatggtcgtcagcttcaatagaggtgcccggggacagaacaccctgcgccaactcctggctccagtggtaaaagagatcatcgacgacaagtcgctgattatcaacacaaaccctgtagaggtgtacaaggcttgggtgaaccaactagaaacacagactggagaggccaggtaatagaatcaggaaggtgttggtcttctgttatgttttatgatatttttacrtgtgtatttattgatactcttaaactttgttaggcgaactgtacaaagtcagttatcaatccaaaatgttacctccctttaacatatccatgcaaattacatcttgatactaaatggtattttcacatttcagagccaggtgatccccaatgccacaacttccataattctctcccttgtttattttctttgtgtatttctaaacctagacctagagatggtgtagactctctcttcacctgataatacgtacttttctttacagttaccaggcaagtaactttaaggtgtaaggtttaacaatccaggttggattggcttattctgggtgggtggttgtagatttaagcaaccctagcttcttgtttcctgtaaaaggatgtctgtgaaataaagtgtacacagagaattatgtaattatgtgggtggttgttacagtactgtttgtaataataaaaagtcaggaaaagtcaaaatatttagctttgagggatttgttaaataaatgtttgtatagcacataatggaataagtatttggaatcgtggtatagatatacatttgttggcacagaaaaaaatgttcagggtatatattccagttggagttaggtgcaataacccatttttctgggaaaagaatgctcattacatacgccacacaggatctgtatagaatgtcgattacacaaattgcattacacccatcaatatgcgaggcccacagacatacatgcacagaggagattggacagttatgcactaaggtatgaaaattggttgtcccaaacaccgcatattctcactcataggtgggaattgaacacatggacacaggaaggggaacatcacactctggggactgttgtgggattgggggaggggggagggatagctttaggagatatacctaatgctaaatgacgagttaatgggtgcagtacaccagcatggcacatgtatacatatgtaactaacctgcacattgtgcacatgtaccctaaaacttaaagtataataataataaaataaaaaataattaatttaaaaaaaagaaaagaaaattggttgtcctctctggtattgttttagattatatgtgattttatttttctgtaatgaacatttgctttttataattaaaagaaatttagctgagtctaaattacctgggtctgcctcttatcttgccagaagagaccagagggaaggcctcaagtccttcctgttccaagttgcagaaggtaccctctgtgaaggtggagcctcccctcatttagtaaacattttgttactggagtcagtggcaaagtccaattcactatacaaagcttgactatagaaccaacttggcagcaaaattaatgcttgtacctaagcctccagttaatttaaagcctttgtgttttcagcaagttgccttatgatgtgaccacagaacaagctctaacatacccagaagtgaaaaataaactggaggcttccattgagaacctgakaagggtcaccgacaaagtcctgaattctatcatttcttcccttgatctactgccgtaagttgtacttgcagcaagtttaacattctttcctggaacgttcttggaatacgatgtaaaataagcccctgtagtgaagacagcagttttcccttatattgtgtttactattttaaaagattgcctacatttaccttttaaattcctgactgttctctaaagaaggggcaatacttcagtagcaaacacagctcagttattatcatcagtggaagtcctgtgattccattaccatctcatcttatgtttaatttttagaaaaactactcagctgaagttgactggaacaattgctgtgtgttttttcctcactccgccttttttccattrttttcttttgtcatctgttttatatgtagttatggattgaggtatatagccaaagtactgaagaattcgatccatgagaaattccccgatgcaacagaagatgagctattaaaggtagattttcaagggtaatctcaccatagcttctcctgggggtatgaatcaaaattaccaacatataactttgtaagattattccccatgtatgattatttataataagctgcaggtcttctgtttctaatgactctcaagataattgattaagctgaggttaatttggagatcctagacattattgaaattctttgcattagagcattttgggggcaatgagcattttttcatcaaaaataactttgcaaattatgctattaataatgtgtgattatattcattgcctttattaaactccttgttaggatttacatcagaaaatgatctgctttctcttgggaaatgtaggagaatmtatatctttaaaaaaaaaaagaaaactaaaactcttgagttttctctcttaaaaatggtcatgcacttctgcgtcactccagattgttggaaacctcctgtactatcggtacatgaatccagccattgtagctccagatggctttgatatcatcgacatgacagctggaggtcagataaattctgaccaaaggagaaacttaggatcagtggccaaggttcttcagcacgcagcctccaacaagctgtttgaaggagaaaatgagcatctctcatctatgaacaattatttatcagagacgtatcaggaattcaggtgagaggggcccttagttttggagaaacgtgcaagaatggtaggcaagaataatatgtgctctgtgcccagagctagagtgggcatggaggacaggaaccccaggtggttacaagcatttcttctaccagccactggggaaagaggagagagggaagtgcaggcaagattgcctctgtctggcgatcctatcgcacccccaccacagcactcctattacactgagtcttttctgtgtgtattatttctgctgctgacaaaatggcatacttgttcttccttgtatgctacaggcttccagtacctagaatttaaaaatcaaaatagcagatttctgcttctttcaacttaagaagagaggaatcatttttaaaaagttttccggtgaggaagaacttgcttatctacgtcagatacatttgacccttgattaacacaggtttgaactgctcgggtctatttatatatggattttttcaaccaaagacagagagaaaatacagtattcatgggatgcagaacccacatatacaaacagatgacttttcacatacatgggttccacaaggccaatttcaaacttgagtatgcacaaattttggtgtgtatgggggtcctggaaccaatcccccaaacataccaaggaacgactgtagtaggaaatggaatacttgattttgaaaggttaggaaaacccagattttatatttgttgatgattgtrtatgtgaatatgttctgttctattctcaagcctttcttaatgacacatgtaagaagatttaattctattgattttgtgtttccaaattatatcactaatcattaacaagaaaggcatgagtctggtagtcagattcactcctcctggagctctgaggaaacactttcctcttgtcatgtttgttctcatgtctgccatttaatcaacaggccatagaagtgtaacatcagtttggcctcttttaatcctcacttggaaactcatttctcattcctcggtctcccttggagtgagtgacttactagaaaacaaaggtagttcatgattattcatttctatttagaatttgtggtcttttgtgagaaaattgccccaaatcctcctactacagaaagtgttgatttttcaagctaatttttcattctcctcactgactaacaaagtaatatccaggctgggcaacatagggagacctcatctctacaaaaaatttaaaaaattatctgggcatagtggtaagcacctgtagtcccagctactcaggaggctgagatgggaggatcacttgagccttggaggtcaaggctgcagtgagccgtgtttgtgccactgtactccagcccaggtgacagggtaagactctgtcacacacacacacacacacacacacacacacacacacacacacacaaagtaatatccatttcccacatttctcatgaacttttaactgctgttattcctatcagtcatttatgttcccacctattctttatttaaaaagaaacaagaccaaagaagtgagcctcttctaaacttgtcctttcttccactcatatttatcctttgtgtttctcagaaatctacaaaaaattataaccaaagcagcataggaaagccgactgttacatgggaacatgctccccacaacagggctctgctgtttaacctcccccagcctctggctgggaaagcagaggtcatttctggtacataagacccaggtgcctgtaggagagatgccgacaatgatttcaggcatatgaaacatttacaactttatagaataaaatgtatattcgacctgcacaagaattgtttaggcaaaaaatacatagaactattcaactgtgatcacagcatgcctcacttctcttgatctctgtcaaaacttgctttagcttaaaatagactttttagggtctgagtcctgggacatgttatgtatttgggtgtctagccttaacaatctttccatcggccagcaaatatttgcagcaacgaagaagagtagacttaatctcatttttgtcaaactggtaacagaagctctgaagggtgattagggtgatgtaggcccaggagcctgtgctgtttaaagcagcaaatttgactaattgcttttttttctattgtattcctcacacagacttgattcttagatcaagaattatcatttttgactttttaagtttcagggaccatttttaaaataacatttttaagatgacctacgcataggtcactatatcactaagtcacaaacagggcctgaggcccttgccactctctccaatcctgtttgaggagctgggtccaatatccagaaacatggatgcagctccgacagccaggagccagcctggaagaagctgtaacacgtcctctcaaggtttgagatgggaacaaagtayatgtcatcattcaaaatttcctagctattttgatgaaactgtttaatgcacatgtttgagtctgtcttaagacttttcccccctttattaggaaatatttcaaagaagcatgtaatgtccctgagccagaagagaagtttaatatggacaaatacacagacctggtgacagtcagcaaaccagtcatttatatttcaattgaagaaatmatcagcacacactcagtaagtggggatggggagccatcttagcaatggacccatgatttaggcatctgttatcttgaaaatgcttaatctctacaggacttattgtacacatgtgctaatactcatattcttaaccctaaaaatctcgcaattatttattccatgactcttatacattaataaaactccttctcccaaacaacaaaattctatttttacataattattccctgactcctakacattaataaaacttctccccaaaaaagaaagtgtacttttggcataatccatttacaaagccagattgtgactggaatggtggcatatgcctgtaatcccaacactttgggagactgaggcaggaggatcactcaagcccacaagtttgagactagcccgggcaacatagtgagacccctatctctactaaaaattttttaaaaactagccgggtttggtggtacatgcctgtagtcacagctacttaagaggctgaggtgggagatcacttgagctcaggagtctgaggctgcagtgatctatgatcgtgccactgcactccagccggggcaacagagcgagaccctacctcaaaaaataaataaataaataataaaaataaagccagattgtaaatatgcagtttaagccctgagccaggacaggctatggtgttctcatccgccaaagctatgctatgtagacctacaccctgtctctcccctcttccaggaaccctctcagcttttccagtaattttctgggggaaatgagaatattctttttattctaatgttttaacataaagtggtaataaacaggctacgcaacgaaaacaagaaactaccacccaatagtagccttctgcaaagaatcacttccattgttctggaaacccccatttctcggaagcaggcagtttttcacatcatgtgctgtgttatgacatctacatytggtttgcatgcagacatcactgccgtcagccattagcatgtattaagtatctgttgggtgcagggcactgtgctcagtggcatggggaaggaattgggaggctttagatgacttttcaaacattaaaattaaaaaaaaaaaagctaagcattgaggggtttgcattgttttctttttaagatcaattggaacttatttcatgaaaaaatcttggtttttaaaaggtaaccatttcaagaatagtttcagaccttgtgagttgaagcaaggtcctggggatatgttagcaatgcaccctggacctcccaaattagaacctgcattgtaacaagatcccagaggattcagatgcacattcaagttctagatgcttcagttaaggatgcacccaactttggattatacagagaaccaaagggaaagcataacaaatacacattctcaaaggttgtgctctagcccccatcaaaccagacatactgacaagtggcaggttagctgcttaaaatttcagtctattattaagctcttctaagaaactaaagcttgaatgtaggtttgaaggaaagattgaatctagtattgattttcttctttcagggttgaaacagggaacttccctgacatttacatcaagctctcaatacatactgattaaatgaataggctatccttcttttctctatatatgaacaccctagattacaaggaaaactgtccagcaatctagcaatgcattacttacagaaataattatctactggacagactcatttatatttgagcaatgacccatttgtctgtttttgtggtacattatctgtcttcaaagaatatgtacatcttgggtgcacatttgctgaatgcaatatccacatgcgaaaaaaatggtggggagtacttgtttagagtgagagattctttcccaagggtagcagagagaaaatgttactgtattaatttagaagtcttagaagtctttaaggagaaatagtctgttcttttgttaacaaaaattgaaaacagaattcaatcctgggaaagagagcttgtgactgatttggaattccttcctgtgttaggttagaagcagatgtaatgtggggaaattgtgtaatttcataggaagactgtcctgtttactgtctgccttctgtgtggaggcgtccgtgtgcagacacaagcacagcagtagcaggatttgccaagcctgtggccatgtgcttacccctttctctaaggaagatgcaagaacttccaaataagctctttaagaagacattatcaggaaatttttccgaataaagggtagaaggtggccacctaaataatcatttccaaagaaaacagccaaatcagttgccctggctcatcagagaagaagaacataaatttatccatcttgcatattttgttcttgtctcttaattttccctccaaaacatcatatgtaccgcctttccagattttgcccggtctttgtatcacctctattatttatttaatgcctttctttgaatcaactcacctttttaaaaacaacacgtaatttctttgctttaaaacaaagtacctctactatagtgaaaaactagcctgctttgccatacacagaaactttagaagaaaataagtgtaatgaaaacaaaatagttggatacagtcacttccttaccttgaagttatgtatctgaggtgtgttctctctttgttaacaactctccatgtgtcagggaaatgttaagaaaaatttagcatcaaacagatactctctccttcactgatcttaaagattagaagagaacggaaaaggcagtaatcaagacagtgctatgctggcataaggttagacataaagactaatgggatagaatcgagagtctagaaataagccatcacatttatggttaattcattctgacaggggactaagttcaatgggaaaatagtgtctccaaatggtactgggacaactggaaattcccatgccaaagaatgtagttgtgccccttccttccactctatacaaaaagtgaactcaaaatgggtggtagacatagatgtaagagctaaaactatagatctcttcaaaataagatataggagtaaatctttgtgaccttggattaggcagtagtttcttagatatgacaccaaacacataagcagcaaaggaaggaaataaactagacttcatcaaaattgaaaacttttgagctataaagagtaatatcaagaaattgaggctagacgtggtggctgacgcttgtaatcctagtactttgggaggccaaagtgggaggatgcttgaggccaggagttcgtcgacaaaataggaaaaaaaaattagctgggtgtagtggtgcatgcctgtagtcctagctactcgagagaatgagacaggaggatcccttaaagccaggagttcgaggctgcagtgagccatgatcatgccattgtaccctaacctgggtgacagagtcagaccttgtctcatttaaaaaaaaaaaaaaaaaaaaaaaatttcatccaggtgcagtggctcacacctgtaatcccagcatgttgggaggctgaagcaggtggatcacttgaggccaggagttcaagaccagcctggccaacatggagaaaccctatctttatttaaaaatacaaaaattaaccaggtgcggtgacacatgcctgtaatcccagctactcggaaggctgaggcacgagagtcacttgagcctgggaggtggagcttgcagtgaaccactccagcctgggcagcagagcgagactttgtctcaaaaaaaaaaaaaaaaaaaaaaaaaacttgagaaaaccaacagaatgaaagaaaataattgtaaataatrtgtttgattggggacttgtatccagaatatataaagaaatcctacaactcaatgatagaaacataatccaatttaaatattggacaattacacatcaaaggacataatcaactgagtgaaaagataatgtatggaatgggagaaaatatttgcaaatcacatgtctggtaaagggttaatatctagaatatataaagaattcctacgaatcgacaacaaaacaacccaattataatataaacaaaggactttaacagatgtttttccagagaagtatacagatggtcagcatcactaataattagagaaatcaaaactgaaactgcaaggagataccactcacacccagtaggatgattaatatcaaaatttaaaaaaaaaaaaacagaaaataagtgttgagaaggatgtgaagaaaatgcaacccttgcaccccgttggtgggaatgtaaaatggtgcagctgctatggaaacaggatggtctttcctcaaaaatttaaacagagaggctggagtatggcggcacgatcaattaaaaaaaattaaacatagaattacctcataatctaacagttccacttctggaagtatacccataaaaaattgaaagcagagtcaaagagttatttgttcactcatgttcatagcagcattgttcacaacagccaagcgtctatcactagatgaatggataaaatgtgttatattcatacaatacaatattattcagctctaaaaagaaggaaattctgatacatgctacaacatggaggaaccttgaagacattatgctaattgaaatgagccagtcacaaaaagacaaataccacttatctaaggtacctagagtagtcaaatacatacaggtatatttgtggtttctaggggatagaaagaagagataatggagagtgactgccaatgggtacccggtatcttttagggcagtgaaactgttctacagtcagagagtggtaatggctgcacagctctgtgaatacactagaagccattgcatcgtacattttaagtgagtggatttgatgtatctgaattctattttggtaaagctgttggaaaaaagattgaaaatggaaaaggaactagctttatcattatgatgcagagttttataaaatagttgctgagaacaacaaattttatctcctgtctccaagattactagttccgtactttggaaatgttgtttcaatctaattagaaatgcaagcaaaaacagatgtgtcgctgttcatgtgtaaggttgtaacaattaaaccaactccattaaaatttgtttaaattaaaaaaaaaaaaaaagtgttgtctttcatggtttcccccgagtgctgctacccctcaggagttaacactgtttcctgtaagacctggcaagacaccccagcagatgttactcatctttgggccttcttaggataaggaaaggggaaaccactcaggacatctaggtctcttacatccttacccatgagagatcttcaatgcaagacagattgaaacagctcatagtagtgattaagaagaagataactgtagtatttgattactgcatagagatgtaaatgcccttccagtttgctaccaatgttaactgaaagatctgcctcattctggactctttcccccaactttgactttttctatggaggaagagtgaagcacagagatcaggtggtagaaggcttccctttggcagaccttgctgaaaaagggtttatgaacacgtttcttgcaacaatttcttgatgtagagtaggtgcttccctctgagatacaataaaaactgtatctatgtctctaatttttataaatgtcatactcatatttaagatttaaatggtatgaggaggaaattatgaaaaatttcatataaatatggtacagttgagaatttacttttttctttgtgtgtgtgttgctttctacataaagctcctgttggaacaccaggatgcaattgcccctgagaaaaatgacttactgagtgaattgctggggtcrctgggagaggtgccaaccgtggaatcttttcttggtaagagcttgttccttctacttatcccttggtttttgtttaattgggtgggttggttggttggttcgttggttttcctatcctagataaaacaattattttggaatttaatgcttaagcatatttaaagaataacaactacacttgccccttcctacagtaagagttctgtaattaatggagtccgggattataaaataattcagtattcttgaaggtaagctccagatatgtcaaaaaggaattgtcaacctgtrttatacagaaagaagccatcaataaagaaccaaatttattacaaaatgaaaaatacttttattaacagttatcctttttagtaatttgtatttgaaatacctatgtcccatgtcattttcatttttcaatcagatattttaaaagccactttagctatagtagaatgtgggttttgtaaagaccatgatctcccatttaattaccaagcctatctttcccacagaacctttatcttacattgttggtgccatcatcacaaagagtgaattggaaaaataacactaggttttttccctacaggggaaggagcagttgaccccaatgaccctaacaaggcaaatacactaagtcagctttcaaagaccgagatttctcttgtcttgacaagcaaatatgacatagaggacggtgaagctatagatagccgaagcctcatgataaagtaagtttgggggttaaagggcacatgtctccaaatacacatcttaaatgatgcaaattcaaatgaggctaaatcccaactaatttatttaaaagtatgtgaacattgaaatctattatgtatatccatcaaacatctaaccaaaggataatagactctttagaatttaggaaggcattaaatattataatagtttacaacaccttccttggtttttagttttccatgtagtaatttgatttttttcctttgagaaatgattaactcagcttatgcaagtccttaggtaactgaagagaaatatctattacagagtggccagaagattagtgaggaaattcagttaaccaacgtttatttccggtataaaatcataatataaaaacacgtacctacaataagacattatgatagcatctgatttattggccttccttcctgttaaactgatcctggatatatttaccagctttgacttttatttgtaccctgcttcctgccgctaaagatttcaagtgaagcattcacactttaaataatactatcttttctccatcaaagaatcaaggatattccacatccatcctttacacacagagtaagaaagagaatgagattcatgatwcaacaccataaatcaaaagcacccgctgaccaagcagtgcagttttcaagaacttatacaaacccaagaatgcatatcagtacattagaacagttatgtattggggtgagatggagactggaagtggaaaaatgaggacaaagggaacaagtatgtgttgaaacaatacgaaacatattacttccaagctacctgtcctgagttctgaggttttaatttgtggcaagagctttctctcctgccactgatgtgctgaagtgtgcttgaagtgtgaatgaagacagcattcatctccacttgatttttttttttaaacattcaatcatctgtgaaaacaacaggaagagcttcttcactgtgctgtgttgatatgttcctctcttaggcttgttgattttgtcctcagatcatctgaggctccattcggtcatgcagcaaatgcttgactacctactctgtgttcatgcgctgggcttgaggctgggatacaacagtgggtaagctggaaacagcccctgtcttacaggggtggagagcacagttcgacagtaggaccgcaaccaagttgcaggactaggacwcacccttggcctcacaagagttgagggcggttctttttgactacagattaccaaggcagatgaaaatttcagggagacaattcagggcagggcaggagagaaagggggagaaagtctacaccctgggttcctctgaacaagtgccaattataaagataactggaaatacagattgtgtggttttgccatgtaaatgaaattaggccaagtatcccatgatctcataagctttgtcctttagaagtaatgggaagaaattttttcttaattagttttgtctgctatttgaacatcattttctaaatccagtcaactccaatgtctgcatgatatctgagaatcaccatttgagtagttcaaagtatcagataatctgaatatcatatatatttatacttattcctgaacatgagtctgcatgattctgcaaattctaggaaatcacatttaaagataaaaccataaaagtcaggcctgtctggaagcaatgtgtcttagcctgggaaacctgggacattgtcctgtttgccttacccattacccagcctctgcccttgtgtggctctcccccgtcccccccagtgtgttggaaacaaacactatccacttctttaatcaccacactatgtagagccagcagtgggtttattttttattgtggtaaaatacacataaaacttaccatttcagccattttaaagtgtacatgcatttagtacattcgcagtgtgcaaccatcactgttgtctagttccagaacatttttatcagatgtgaaccctgtacccattaagtagtcattccccattccccgctgctgcccagcccctagcaactactagtctgcactctatgtctttgaacttttgcctgaagatatgaagtcgtatctcactgtggttttggtttgtacttttccaatgaccagtaatgttgaggatccttccatatgtttgtcatccacttgtgtatttatgtattctttttggagaaatgtctatttaactcctttgtccattttaaaattaggttgtttgtggttttgttcctcagttgtaagagttgtttatatattctggacactggaccattatcagatatatgatttgcaaatatttttgccccttgtgtgggctttttactctcttgataatgtccttttccgcacaaatgtttttttttttttattttgatgaagtccagtttatctgttttttttkttgttgttgttgttgttgttgttgttacttgtgagatttaccccaatgttttgttctaaaggttctatagttttagcttttacagttaggtctattaaccctttttgagttcatttttgtgtgtggtgtgagacaggtgtccaccttcattctttcttgttgttattgttgttgttttttgtttgagacagcgtctcgctctgtcgcccaggctggagtgcagtggcatgatctcgggtcactgcaagctctgcctcctgggttcatgccattctcctgcctcagcctcccaagtagctgggactacaggtgtctgccaccatgcccagctaattttttgtgtttttagtagagacggagtttcatcatgtcagccaggatggtctccatctcctgacctcatgatccgcccacctcagcctcccaaagtgctgggattacaggcgtgagccaccactcctggccccaccttcattcttttgcatgtggatgtccagttgtyctagcactattagttaaacagactattctttcttcatagaatggtctaggcacccttgtcaaaaactaattgacaatacatgtatggctttatttctggattttcaattctactccattcacttatatgtctatccttgtactagtgccacaccatattgatcactgtagctttgtaatgagttttgaaatacggaagtcctccaacttctttcttctttttcaagattgttttagtcttgcagttgaataggtctcttgcagttatatgtgaattttaggatcaacttttccatttatgtaaaaaaggcttgaggccagtgttttaatagaggccctaagtcttttatgctcaaaggccttcctcttggcatactgtgagatcttactgttggccgaccactttactaagcagcccagtgatcaatgtaggtaacaatttgaaatcaacactgactggttagccatccctgaaagtgaaatttggatattgcccaaaaggttcaatagaattagttctatgattttagccaagccctgcttctaaatatacttcctttaaagtacatatttgaaaaaatcttgatactaacagataattacaaagtgcagcattgacagggaacctgaaaactgagtctttttcttgcaggcaaggaaactaaagtctaaaagtaccagtatcagtccatggcctgttaggaaccaggcgacacagcaggaggggagcaagtgaagcttcatcctgtatttacagctgctccccattgctggcattaacacctgagctccrcctcctgtcagatcagtggcagcagtagattctcataggagtatgaaccctattgtgagctccacatgcaagggatctaggttgcacactccttatgagaatctaatgcctgatgatcactgtctcccatcacccacagatgggactgtctagttgtaggaaaacaagctcagggcatccactcattctgtattatggtgagttgtataattatttcattatatattacaatgcaataataatagaaayaaagtgcacaataaatgtaacgcacttgaatcatcttcccgaaaccatcccccaccctgtccatggaaaaattgtcttccacaaaacctgtccctggtgccaaaagggttggggaccactcctttaaaatattgatttgaactctcatgaggatgacttttttgatttgaacactctcatcaggatgacttttttccaagctaataaaccgaatttgtaactcaagcataagatatagttcttgagattcattagagaaccaaatttaactaaaatcggacaatgacttttataagttatgaagtggacagacatgaaatgcagagcaattgggatgtgaaaatacctagcttttctctatcaaaaaactattctgcttttttgtgaaacagattgtgttcttaactttcagaaatgcccttatgtttaattacaatgtcactagttttccagtcatgagtaactcatcttcatggaggcccccacagtagcagaatttgaggcattgttaatcattatgtttgtaaatttaattccatgctagtctcataattcttactcatcagatgaagatgaagatgatgataatagcaaacacctatgtagtgcttaccatggccagggacagtttttatatactgtgcaaatgcaaagtgttccagaattccaaaccttttgagagctgacagtggtcaaaggaaatgctctttggagcgttttgaattttcggatttaggatgctgaagcagtaagtatataatgcaaatgttccaaaatctgaaaagataaaaaatctgaaacacttttgggcccaagcattttgaaaaagggacccacaatctgtaaagagagaaagagaataacatgtgcatatatatatattaaaataaacatgtataaaatatgtatgtaatattctcagcaaccccaagagagtggaggttattatcagtattttacagatgaggaaactaggcacagaacaggtataaaccttttcctgggtaacacagttactaagtggagcagagattcaaacccacatgatttgaaatcctccagggcccacactcttgatcataaagttttacaacttgtcgagggcaaggtcattgttctttgcattcttaggaatcttagaataaataatgagaattattagctgagcagttactgagtaacggaggctggagcatctttccaggccaaagaggagggacaaagggcacatatcggagtaggaagaaacatttatttctttttcccttgtgtatgtttatagaatagagaacctcagtttgggctattgctatttttctaatactaccaagcacagggatatttaaaaaaaaaaaaaaaaaaaaaaaaaacctggtcgaggaatcctaaaaacctagtcgaggggtcttagggatgacatagggttatagcctcaatctatcacttattaaccatggaactcagcaagttgcctcgccatcagttttctcctccataatatagaggagaggggaaaggaagggctatgatgatcacatgaaattataattaataccacataaattatataaaactatgcagttgtcaacctttcattataacttatgattcaacttaaaatatgtgatccttatggccttaattaagcttagtttcccacaaaagtatgtgtgtttaagtagaaggcaatatttgtggtttttaatcatacttagctgcttgagtgcttaaattgtcatctcttaagaatttcctgtcacatgattaagtttaggttccatgatcccagctgaaagatttccttgttttttggtccaaactagcaggagcactaaatggctaaggtgatatttgaggtctggagctaataatgtaaattatcttgttaggatgttaaatactgaaaatattccttagtttccacaaacactgattgcttttcaaccttgggcacagtataagcagatgacagagggggagcttcaggaatgctactggtaataatagataccatatgaatggagtggccaaacccaaggggccacaccagcttacaagcgccgtatgggctcatttatctacagtggggtttgagcacagctatgatgaataaactccctggtgtatttctttctctttttttcttaattctttttcaaaattagatacctcctcattcagggagagcaagacccgtggtttggatcaacctatcttacatatttgaagagccctggcgccagtactctaagcarttgatttatgctggtcagaccatatccagaatgttatatttggactggggtgggaagggggatgcatattaaggtcattggtaactggaatgtgagcaggactgtgagctctctgcagatgccattgtgaggagctttaagggactgagtggtttcacttggaaaaaggaaagatggtggaagaggggatagaggaacacagtcttggcatttctctataggtttttcaggagctgctgatttggaaagggaattggacttgtttcctgcagctctagtctcttaggtcttagttgccacatttgtacaatcagggattggattgtttttcaaaggtctctctccgggccacagtcctaagactaaccaggtttcatgactgggtggccctggaaggcaggcctctcagagtgagctcctgtttgagaatggaatgtgccaatattgtactctccaaaagaaawttaatatgagccacatgtaattttaacttttctagaagccttattttaaaaagaaatagatgaaattaattctaataatatattttatttaacccaatatatccaaaaatatttaaatatgtaataaatgtaaaaaattgatgaaatattktacattctttgtttcatacaacatcttcaaaatccagtgtgtgtttcacacagcacatctcagtttgtactagccatgtctcaagtgctcaagtgccacctgtggccagtggcggccatcatgggcagcacagctttaacgaccatgtgagtgcttaccatgtgccagacctcacagaaggctttagatcttttcatccaatccttgcatcagtcctgagagattcctgttttataaacgaaaaaacaaaacctacaaggattatataacttgcacaaatccacatggctaatatgcaacaagagtccaagccaagacagatttggctttaaatctgtccgtccccgtcgtccttaagcactagacacactgtagtgggagggaggtgggttccctgtcatgggactggatggttacttatgtctgaggtagaactttggcaatgaattccacaggcctggtgtacagtagaagtccaagggaaacaggctgtgtgagcagtttgtcctccagcaactcttgagcaaataaacaytctttgtctttggtggggcacgttttattgactccagtcatttggtcattgcacagcttctctaaagaactagaagttccctagaaactgtatatcacaattagttctgagaatactatttcaaacaagaaagttactatattgacattttttaaatcatccaaagcttttatttttaactcagtgttcctgtttaatacattgatgatgatggctggaggaaggtggtgtgtaggaaggaaaggatacattgctttctcagccacagccgctttaggaaacatgccatcccccacgtggctgtaattagctgtgggcccacctttgagtctctgtggagtatttagctgtgcattcccagacagcctgtaaatccccagcagcaaagggtcatggggccagaggaaatggttctccaaaggctagggggaagggaggcaaggaagacacattgtgattgttcttttcacacagacttctgataaataggaaatgagaaaaatgatgtttacagatggcttattggattttatcctattttcaaaagtaatatatttgtaattaacttgaagggttttctctgtcatttgggagtagttgcccatatccttcaaaatgtgaaaattttgttctcatttctaaatttcatgctacatgaacatttcctgctagagtttaggaagaaaaattagtcattcagtgatatcatgtaatgactctgaaataactaaagttaaatgcaataacgggactacagtaaaagtgaaacttcagatgtcaattagaccagtgtatgtataatttaaacaaacttttgtctgtgtttccttttcttctttcttttctttctktctrtctatctatctagatatctatctgagatggtatctcactctgtcacccaggctggagtgcagtggcacgatttcagcttactgcaacctctgcctcccgggtttaagcaattctcacacttaggcctcctgagcagctggaattacaggcacatgccaccatgcccagctaatttttgtatccttagtagggatggggtttcgccatgttggccagggtggtctggaacttctgaccgcaggtgatccgcccacctcggcctcccaacatgctgggattacaggagtgagccaccgcgcctggcccttttttttctttttagaaggaaagccttttccaataatactgtttccaccttatgtaaaagtgagcaaatttgaccctttagcttttatgttaaaacctttgtacgtaattacataacatgatgcctccctaggaagtggtggccaattgccataaagaacacctatgagagaactacggttttcgtacttccagaagaattttccagctctttactgtttactgagaagctcttctattctcttccacctgaagactggaagaagacctaacaaataggtttctttgttaaccctatttgttagttgctcaggcccttgaacaccatcctcctcgctgctgtgtcagctgacagaccaagcctccacagcccacactgaacgttcgctcccactggtcttcagactctttaatagctttctgatagtaggaaaggtaacagttggtctggctcctaaaggcttatgaggtattaagccagctcagaagtctaggtgctattaaagtcaggaaaggagaatattagatatcattcctgcactctgcagtagcaggccatatcagcagcacttgctccccctgcccatcaaaaagtagtctccgtctaaaaaagaaggaaaagtatttagagaggaaatcttgtgatacacttgtgcccatgttactgacagtataatgctacaacatcaagcacagaaagcccagactttgattatcaagcattcataaactttcaggagccttatagcagacctggtgaatatccgcaagaatgttttattttaaggtattatctttgaagcttcagtattgtatgtgtttgtgcactctcttaggagaaacagatttttgtgcataaggactacagtctgaaagtctgtctctttctctggtttgttaaggaccaagaagctgataattgatgtgatccggaaccagccagggaacacattgacagaaatcttagagacaccagcaactgcgcaacaggtaatttgactttaagtgtaaaataataatagacaggtgttgattttcttcataaatctttatgccataygtttattatctcagagaaactgtatctgacatggtccggaagtaaggaattttatctattactgcagtggacttagttcagccatatataaacctgtatgaagtatcaatgggaatgaaatagaaaatacagcaccaaattcatgccgaatatacttttgtcttaacctaggatgatagttctgggtttttcaaagcccggaaatgttcatcataatgggcaaataagtcagttgagagagttctagctgacaggatattgaaaaatacctttcacattttatgtatttactaacttgaaacaaataagcgactcacatgttaaagatgttttccaaatgcttcagaagcaaatgttgagtccactgagtcaaagcatcattatgttagcgtaagtgaggtttcacaacaatcttgcatttagctttttattaacatctttgaaaatacgtcattgttcgttctaaaataaattcaaggttgttattttagtaccaataattgccgctccctaaacaaaagttaattatttaattaactatttcttagcacagctacacataattttcctggatcattcttaatttaattgattgccaaggaatccttgtaatagtttttaatttaaaaaatataaaaggctgggcatggtggctcatgtctgtaatcccaatactttggaaggctgaggtgtgtagatcacttgagcccaggagttcaacaccagcctggacaacacagtgagacccccatctctaatttttaaaaatttttaataaaaaatgtaaagcaaaacttcaaatcacaygtttgttaatatgtgggtatgttttaaacaatgtgggtaaaatattatactaggttagtataaaagacttttactccttactatttttcattttcccctaaatgtatcatgaataagtgactaagaacacagacttctgagatcaactatacctctgcacctcctaggtgtgtaactctgtgcacttagaagcattgctgtgccgcagtttcctcaactgtaaaatgggtataataatagtacccagctcacaggcaggattaagtcaattaaacatgttaagtgggtacatctgtatctggtgcacattaagtgctcaacaatgttggctgctgcttttgttatttactgctaacctggtaataatgttccaataatattgacctacctgtcctgtgtctaagattactgtccctaactaatagtcgtttccttagacttcatctattgggtcagtcaattgtctagtacaatgaaatgggaagaccaatagtctctttttgttactgtttccttgaacagactatccaaagagtattcattcattcattcatttactcatcgtttgggaatttataatgtgctagaatattcttattccctttggctcaaagaaactttgcaagtttttcagagttgctggtttgtgattcccttataagaataaagctctctgactgccttactgttggtttagtttaggactctccataaacatggctgatgtgtgagagtttagctgggttctgaacattcagggttctcatagccacatttcaataggtaatctagttttagtttcctcagctagcctatccaggaattgaaatccttccatgtggggaacaaagtagcagttatccattaaaatatgtccattactatagtgatttgtcaccttggcaataaagtagctattgagaatttttcccaaataaggcttgctatcgaaaagatgaagtaattcctttcaaagacctacttcaaaactcaggaagaacatgttctggttctagtctctgaactttggctggaggactactttcattttgacattaacttgcattgtgtagcttatgaactgtgaaattaggggatcagagaaaactcagcatcttgatattctcttttcaggaggtagaccatgccacggacatggtgagccgtgcaatgatagattccaggactccagaagaaatgargcatagccaatctatgattgaagatgcacagctgcctcttgagcagaagaagaggaaaatccagaggaatcttcggacgttggaacagactggacacgtgtcatccgaaaataaataccaagacattctcaatgagattgccaaggtttttggaaacagtattctttcttccttcacttagcagacatttgctaatcaccagtcaagtgctgggcactctgtgaggtggcattagggattcatggttgcatatgctgtggttactgccctcttcaatgctacagatttttcaaggtttcaaagcagttgatgactttttttttttttttttttttttgagttggagcctcgctctgttgcccaggctggagtgcagtggcacaatctcgactctctgcaacttccgcctcccaggttcaagcgattctcctgcctcagcctcctgagtagctgggactacaggcacgcaccaccacgcccagctaatttttgtatttttagtagagacggggtttcaccatgctggccaggctggtctcgaaatcctgacccggtgatccaccggggcctcccaagcagttgatgacttttaagagaaaacaatcacaacactttcatgtcattaggagagttgaaacagaccagaaataaatactaaaaaatgtacttgacaagtttggtctatacctttaaagttttaaaaataacactattggaagagttttctcctgagatgttagttgtcatatagctcagttgctcttagaacctgccactgagatggaactctgtgtccctgatcatttgtttttaagcaatttagcctaaatgcagttcagacttgaagattagtttctgttttcttatccaatatttttacacttgagaaacttcctgagcaaaggatctcaacttagtgcaatgaaacatcacaggaagtggctgagatctgtttgtcaaggataaggaagtatatatttgggttagaaggatatttcattctttttattcaaacatgcaaattaatatggatctagaggttaaaggcagttaaatgaccagaaaaaaaaaaaatttctcaccttctggaagggaaatgcgctcagctttgttctttgatagaaarttatgttcaattctggcagtaggcttattccttctagcccaagtgactcaagggaaataacatttctttctttagtttgggggtagaaatatttctatttgggaatatggggtagayaaatatatgcttttgctttaaaaaagaaaaaggctatcatgaagacatgatattctatttaatgaatattctattatatgaagaatttctatttaatgaagaattctatttaatgaagaatattctatttaatgaagaaattttacctaagggcatggggaagttgtgggggagtgtatgtgtatgtaggtatttctttgaattcctaggggaatggtttttaacttgtttacaaaagaaaaayaatattaaacaggcaccgttttcttaagtcaaacattttcataacttaccaattagaattatgaaaaaaacttatatctgcaagtttaaatttagcatagctcttgtaagctataagcagcttatgcaacttaatgttctaggaattctatttaaatccaagtaatagttatcaatgttgaatcttttcactcagtcttgacagcccagtgttgttttttcaaaccttgggaaatatttgtcagatgaaaaagtttgttcttttcttattttaaaaatgaatttaacaattaaatgtaaacttttttagtttaaagtactattcaaagaggaatattcaaaatagtctgaagaggcygggcacaatgtctcatgcctataatcccagcacttygggaggccgaggcgggcagatcacttgaggtcaggagttcaagaccagcctgaccaacatggtgaaaccctgtaactactaaaaatacaaaaattagccaggcatattggcacgggcctgcagccccagctactcaggaggctgaggcaggagaatcgcttgaacctggaggtaaakgttgcagagatcaggccactgcactccagcctgggtgacagagcaagactatgtctaaaaaaaaaagtctgaaraaattgcatttctgctactttgtgccccttttaaaacgcaatttttccttaaactaaatgtgtggttattctaaaataacttctttgcctttccatcmagagcaaaattaatgttaacaagtctcttaaagtgaaatatgtacactttccagttctgaagtaaaaagggatgggaaccctgtggtgttgagagtaaaataaggtgcctgagataagctacaagtcaagttacaaatagcgacttactactgcttgatattcttcttgtcccaaactggcaatatcataaagcaaacttctgcttaaatatgataccccttacttgttgttttaggatattcgaaatcaaagaatctatcgtaagcttcgaaaagctgaattggcaaaacttcagcagaccctgaatgcacttaacaagaaggcagcattttatgaagagcaaatcaattattatgacacctacataaagacttgtttagacaacttaaaaagaaagtaagttaaaatcatgtcrtgttcatttgtaatgtcatgatttctatgagatgtcaattctgtgtttctaggcagttgggttgggtatggaagaaaactttttgctctgtcttctaaccgaaaactagagtctcagttttattatttgccactgtgaactaagaagtcaggagtaagtgaaagcttttcaattccccaccagcactagaattaaagtggcttacctgttgtatattgagcaaatagcattagtaagttagggaagcactttcattattccttttgtcttttttagccaaagatttttttaaatactattatttttaaagtctcttgtttttggaatgtattttatataattgataatattagataatgccaggtgtttgctaattgcacagagcagctgaatgtttttaaattgcttcatggttttaaaaaattattgacacaactggcaaaatttggcagcygtctattatccattagcataagtattataggtttttatatacagtatagccatttttaatgaatatcctttgcttagtaattattcttatcactagactatgatcaatgctagttaaattttaattacccatttaaatatgtartacaatatttttatataatccttgtcatcaaattggcaggaggaaatggtgctgtatggaaaaatctrttgcattaatcatagatcttttaaattttattgcaaattgactataattttatgtattcctggggtacaaggtgatgttatcatttattattacaatgtgaaataattaattcatatatgcatcacctcaaatacttagtttttgtgataagaacacttgaaatttactcctagcagtttttaaatgtgcaatacaytattattagctatattcaccacactrtgcaatagatttcaaaaaaaaactgattcctcctaagatttcatatcctttgaccatcatctccccrtttcccccaccctccagcctctgaaaccaccattctattctgcttctatgagttcaacttttttagattccacatataagcgagaacatgtggtatttgcctttctgtgcctggcctatttcacttagcatagtgtcctctaattctgtccacattgccccaaatgtcagaatttctttgttttagggccgaatagtattcttctgtgtgtatatataccacattttctttacctgttcatctgttagtagattcttaggttgatttcataacttagctaacgtgtgagtagtgctgcaatgaagatgggagtgcagacatctctttgacaaactgatttcacatcttggagtaaacacccagaagttggattgctgaaatcacagaagatttgataaagggatgcagccacatttaaaccttattgatttggctcccactagtcctgaattttagttcatttgcttcaggcttctctctgtttctctctctctctctctctctctctctctctctctctctctctctctctctctctcactctcgtgctctctctctctccatatatagttcatttgcttcaggcttctctctgtttctctctctctctctctcactctcactctcgtgctctctctctctccatatatagttcatttgcttcaggcttctttctgtttctctctctctctctctctctctctctctctctctctctctctcactctcgtgctctctctctctccatatatagttcatttgcttcaggcttctttctgtttctctctctctctctctctctctctctctctctctctctcactctcgtgctctctctctctatatatatatatatacaaaaatacactaaatatgtatatacacacactacatatagtgtgcatatgcacttataattacataaacatatacactatacactaaatataggaaggaaggaagaatatatacatatacatgcaaggaagaagttggtcaagcttactttcagtagaaatgagattgttagggatttactttaaggcatttcacacaagatccacagtcgggcgaattggatttgggttctgattctctcttatgtcgtgtgatcttgagcccagttcagtgaactttgagcctcagttttctcatccttaaggtggaattaagagtaccagcctcaccagcttggctgacgtggcgaaactccttctcctctaaaaatacaaaaattcgccggatgtggtggcatgtgcctgtaatcccagctggaggttgaggcaggagaatcacttgaacccrggaggcagaggttrcagtgagccaagatcacgccactgcactccagcctgggcaatagagcaagattccatctcaaaacaaaacaaaaaacctccccccaaaaaagcaaagagtaccagactcacaagtatggttatgagagctacatgatatagtatatagcaaaggaatttattagtttaaaagtactatggaaatgttaattttggaaatgtgaggtaatatttataaggcacttagaacaatgctrgccacatagtgtttgttaaatagattaaaacagtcctagtaatatcgttatctaggaatacacagttcatgttattgcaccaaagctacttctgaaatgactaaagatagccacttggttcaatatacctgagaaaatagagtgtaagttttattaaaaatgttagtctgtaatgcaaacttcagtcacttgggaaatccctttccccacaaacagtttagtagtgaagttgcactctatggacaaaattacctactatcacaaaataaaaargtgtatattcagcgctctgagggccaggtatgaacagcgatgtcactctgagtatggtaatygcactaccagaagcctctgcatttgccrtcataacaacaaatgttctgttcttattttgtcagaaatactcrgagatcaattaaactagatggaaaaggagaacccaaaggggcgaagagagcgaagccagtgaagtacactgcagcaaagctgcatgagaaaggtgtcctgctagatatagatgatcttcaaacaaaccagtaagtgtgacctggaatctgcatrgaayaygcatgccatttgatttcttgtggccttggagagagctccatttggtctagcaaggcttaacctcaattactgatgggtgacaagggaagaatacacaaattgttatggctactcttcccttggcctcagcatctggtgctgtcrgtcatatgtagtgttgatcagtggttgtctttcccgtggcttgtgcaatatgtttggattggtgaacctccagaactgagtcatagcaatgagagtaaaaggctgtcttttggtcttgatggatgaattatctaccattgcaaaatagcacctttctcatttaaaataggctgtgccaacccctggatcagagccatttccaaagcatgctgtgagtgtgtgtattcggtgtagtggaaaaaacaaaccctccttcacagccccacatcaggcaccatgtgctgcctccttttaaaggggtcatgagcccagtgttccatcactttcttgtcctaaaatctcaagggaagccagactcactggcatttgccttttctttaactcctgccttccttcaaagcctgacttctgtttatcccatgaaacctcctgacaacaccaactcagaagaaaatgcttcttccwgagatggagtctcactctgyggcccaggctggagtgcagtggtgggatcttggctcactgcaacctccacctcccaggttcaagcgattctcctgcctcagcctcgcgagtagctgggattacaggcacatgccaccgcccagctaatttttktatttttagtaaagatggggtttcaccatgttggccaggtgatccgcccgcctcggcctctgaaagygctgggattacaggcgtgagcgactgcgcctggcctgaagtttctataaaagttatcatctgaaatactcaattggctataggtcaataatgttcatgttctgtgactcacatatttccaattatgttttatgctcttgaagagcaaggaccgtatcttctatttcttttgtaataaagcacctatgtcagaactctatgagctacagatctcaacaatagccatcaaacctagtgtttggagagcagaattgggggaaagatgacgtgaggtttttggtgacttccttaggattttctcaacaagccattatttaaaaatgattatttgagattccattagtttgtttcagctttaagcacatctgtatttgtaatttctcatgtatgaatgttcctttcttcacaggtttaagaatgttacatttgatatcatagctactgaagatgtaggcattttcgatgtaagatcaaaattccttggtgttgagatggaaaaggtgcaactcaatattcaggtaagctgctggaatttctgcacattgatgataaattttatatgtggatcatacattgctaccctggctctckctcttcaggacaacaataaagtttaacagaaaaccagtgccagccttatttgccaatatttgttaagtgttgatgatttttaagagctgtgacttttcaaatgattggaaattratatgcttctagctggcaaaccatagcagtcagtttctctaagccatgtttccattttaaagcttagacaaaagaatataatttaaaagtattcagagctattaaataaatgctataaattttccttttattggaaacttgcatttctttctaagactatgtatgcccaggactggaactttcatgatctcatttttccctctttcctagaatggtttttcttttttgtggggggagggggtgggggtggggcattgagaaggggtcttgctctgtcgcccaggctggaatacagtggcatgtatgcccaggactggaactttcatgatctcatttttccctctttcctagaatggtttttcttttttgtggggggagggggtgggggggggcattgagaaagggtcttgctctgtcgcccaggctggaatacagtggcacaatcatggttcactgcagcctcaacctcctgggctcaagcgatcctcctgcttcagcctctcgagtaactggtactacaggcacacaccaccacatctggctaatttctgtattttttgtagagacagggtttcaccacgttgcccaggcttgtcttagactactgggctcaagtgatctgcctggcttagcctccaaaagtgctgggattacaggcattagccaccacacctggcccctagaatagtttttacgtcaatttattaactctatttgtcaaatgcttgggatcacaggaatgaaaggcattatgcaaaacagatatctatacatagaaaaatggtgtttgcaatataaattatcgttattttatcataagagccacatttaagccaaatacacgtaaatgaaaaccgagaaatccagtttctgtgcaaaaaaaaaaaaaaagagagcactgcaaacaaatgttcatctgcccccaacttcttaatccttagcacaaaaccaatttaaagaagtaatttatttttcttttttgatgtaacactttttaaatggaaataacatcttacctgggccccaaactacttacaaaatggtttccaggtattttgcatatgtttacatgaatcatctcactaagatcctgagagtgatgtgaattctggcctcactgtctgtgcagcccagggctccatgcactggaattacttccccatcatgggagtgtgtgccagagcccttcttttctggcagcccttgtaagtttaaaagaaaaacgggagctgaatgggtttgataaggacattgagataatggagtaaattagaattcggagataagatgaaagctattatgtaattattgaaagtataattaagtaaacagtattgttttctaacttactttaaatgtcactaaatgtatccatttaataatttagctaattagggtcttcagttattttgtgtaacagataaatacaggaagagaaaagaaggtgcttgtggtgataccctttggttagtgattcctctgtagaaatagcaaaagacatatgtgattgccaagaaggaaattatccagggccagtcaatatcaactggaccaatgagtcacaagtgaccaggagacaccttatattgtgtttagagagaaagcaataattccatgagacttcctttgagtactggtataaaaaccaagcttcacttgttcctttgttaaggattctgtatacagtaagattagctgttcataccattcatttatacacataatggattgtgaaatgttaatccttagctatatgcaggtgaccagtatgtcctgggttttttaaatcagtagtgcataatcagaactggctacatccttagcagggctcagagcaaaataaaaatgcagtgccctgtttttaaaattattaaggattttaggatgatgacagaagagaataaaaccctgggcatgggaccctgtgcggctgcacagattgcatacccacggagccagccctgcatttgatagctgtcagatgtaaaggcagacttctatttatatatgcagctttcagtcaattgcatgaatgtgtaaattgtcaaagagaaatgtgatggccaggtccttactgtgagtaaaggaccaggaacaggaccaaagtttgaaaggactaaagaaagccccttctaacattacagctctatgtctcttggttatcttcagcccattttcccttcagttcctaaagaaaaccataggatagaattatatcctataattataggccatataggtaacaggaggatatgacttatgtgatatatattcttcttgtaaaaataatgkcaggtatttatcggggactgcagggtgggccttcttcctctcctagatgaagaactgaggttcagacagctaattatggaagataattagctgggataattatggaagataatgcagctgggatccaagttcttcatcactctagtccactgcctgtctcataggattccagttgatcctgcaagacaagagtagcttacaaagggtttgcatataccttaatctcatatctcattcccagtagcacccttgtgaaattggcagtgttatccccaatttacacacagggaaacagaacttcagagaagttawgtcatgttgcaaggtcttaagatagcaaatggcagagctaaaactaaagtctgcttttcaagtcatgagtccagccatgttttctctgctccctactttggggacccagctacttcccctacatatgccattccttttcaatctaactctattggtttaattcttttccactagactttgtttaacagatgttgcatttcccagaggaaaagtgaatctcctctacactctaaatagctaaaagtattattgatgaaaggacttcaattccctatagaattttagttctagaagcatatctgaataatgtaggggttttcttaagtgcagtgagaggtaattgaggaagtggaggaggaagctgccaagagtcagagttctctcaaagatgactccaacttctacaattgaccttgctagaaacaagaaaatgagacttagatattgggccaggacagctcaggaattatatcttccattgggaaaggcttcctgtacctatgttactatgaaatgttacagcttagtttcatgcatatggctggtgtgatccagttacttattttaaaaagagagttgatttcctttgtttatatgctggcagtgaaaaacagaatgacagttcgacttaagaatgagggcttgttctcagtacagaaacagaagtagcctagatcaagaagtgcggaccaccgctttgtacaatggtctccaaactttggtcacttcatcaggaaatagtatgagcacttctctccatacatagttatttgtaaagtatacatgcttctgctattgtactctaaaacgtgctgtattatataccaaaaaagtccaaaaaatgagaaaaaataaatagaaataggagttctaatattctttttgcttccccagtgaatgtcttgctcacttcactttaaaaaaacactgctttctgtgtttttgtttttgtttttgtttttgtttttgtttttcgggttttttgagacagagtctttctctgtcgctgaggctggagtacagcagtgcaatctcggctcgctgcaatctctgcctactctgttcaagtgattttcctgcctcagcctcctgagtagctgggattacaagtgtgcaccaccacgcccagctaatttttgtatttttagtagagatggggtttcgccatgttggccaggctggtctcactctcctgacctcaagtgatccacctgcctcagcctctcaaactgctggtattacaggaatgagccaccacacccagccagaaaacactgctttctaaagaatatgcatctagccagaactttgtgttttaacattttcgattaaaaattgaaattatatatctgacattaacttaatgatcatcatttwctttcatacagcccttatcaattccaaaaagctattttctttcatctaagtcacaatcacttgggaatttattaaaatgcaaattgatgggccccaccagagagctacataayaagaaattcctgtgggaggagcccaggcagcctttattttaactagcctatgtttttaaccagatgattctgatgtacacttaagttttagaacccccatctatggcctggtgccatggcatgcgcctgtagtcctggctactcgggaggctgaggtgggaagatagcttaagccaggagtttgagaccaacctgggcaacatagttagaccccacctaggtgattaggtcaattgaatctgacttttgtcaacaaattcttctaatatgttttttaaatgcacaaaatgtcaaagttgagatttaatgatgctttttacaatttcaggatttacttcagatgcaatatgaaggagtagctgtaatgaaaatgtttgataaggttaaagtgaatgtaaaccttctcatatacctgctgaacaagaagttctatggaaagtgaagtgcctacagaaatttcttggattctgtatcatctggattaggaaatgaatttgtttaatatttttgtttttaaacatgattgaaatcactgcttataaatgtgtgatttttttwaaaygaccaaaactgttctgaagaatgtacccaggtgcctttttgctaatttgatactataatagaatgagacataaaatgaattaatggaaacatatccacactgtactgtgatataggtactctgatttaaaactttggacatcctgtgatctgttttaaagttggggggtgggaaatttagctgactagggacaaacatgtaaacctattttcctatgaaaaaarttttaaatgtcccacttgaataacgtaattcttcatagtttttttaatctatggataaatggaaacctaattatttgtaatgaattatttagacagttctaagccctgtcttctgggagttatcaattttaaagagaacttttgtgcaattcaaatgaagtttttataagtaattgaaaatgacaacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaattttttgtaatgctaaaaaatcagtatctagatggtttttaaatgtattctctggaaattgttttatgtaaaataaatgttacttaattccattaatttggcttttaagttgtcttaataaatcaaagtcatttagtgggtaggggaagattcttggtcgggtttgttaggagagaatacatttcttgctgtactggttaaagtagagagcaagctgctgtaaggaaaagatacaaaaccctggtgtctaaaacaaggggtagaagtttgtttttctcaaattcagctcaacggtgagcagatccacaaggtaaagagtttccaggtgggtcagttggctctgtccttgtactgattccccccagccagatgaggaagaggatgacgaagaagtccagggcaagccttttcagttatacgcatcactttaacttccacttacattgtattggccaaaactgagtcatgtggacacagctagctaaagatagtccctaactaggcagccatgtagccagtgaatacagagaggtagagagggaattgggtctgttattaaaaggaagaaaaggagtgtgattcctgctgacagtttaggagtcttcaccacaaaaggattccagactctcaggctggaacctccctgccactttgttcatgcctgcaacaggctttattttttcacaaattgcaaaatattgagaaagtaggttagtttatgtacatgtggcacaaataaacttgaagggtaagaccaacagaatttggaaaattcaaattaaaaaaagtaaaatctgctactttagtgatggtttcaggctatgtatatttttttgacaaagagatgaatagcttaaaacaatgctcactatctcaacagtttgcgggtatgtatgttttgtaatgcattagccttaatgcaggctttggtagaaggaattaaatatacagttaagtttcacgttgaaaataaacctccctcttgccctactgctagcattggaaaggggaacaggagccaggggcaatgaggggtgggcagggtaagcttccttcttgctccgggcaaggcttttagtggaaatgtatagaaggagccaaaattagggagcaatgttttggaggcaaaagccagcctttcccagcatctctgaaaggagcttatcttaacttattgcaacactgaatgatatgcttgaatgttatttgtacgaataaagatatttgcatcatgtcaataccttcaaggaacgctgtgaatgatttctctgttggcccacaagatgaggttattgttgaagacatcaccaattgctatttgtgtgagatctttaagcggtatgaatgggtgacctgagaagaaggctcatgatgaaggaacaaaaccaagggccatcggggcctgggtgtagcagacttcagtttacagagatttgttggagccaagtcctgtgctactctttaagaggactaaactgtccctcaagccagaggacaattcttgataaccctgagcctgagccactaaggactccaacttcctcccagagcccatagatttttcttactcaatggaaaaggttttttgttgtttgggttttttgtttgcttgcttttttgcttttaaacactgagcaattggaactataacttatttttgcaaaactgactcctgtattttgattattttgattattttgatcttaaaagcaaaaagtacttatgcaacactataggtgctctcaaaggatatgctttagtggtcttcaggagaaggaaaatatgtgtatgctttattctgaaagttagtggtgaagaaagaccagcttggtgtgaccgttgtctgatatgaatgatctcaactataattatacgttagtgtttgtgtgtggttgggcacaaattagaaatgctattcatgatgtgatttttatgactttgtcattaagtagggatttgtggtattcctcaaacattccaagaggcaaaccacaaaactctgaatggtgaaagttgtctttattttgaaaaattatagtgagcactggatgttcttattgctggttagctttttgaaaaatctattgccaatgttactaaaaccaaacttggtaacaggttacaacagaggccccctaagctccagaggacagaatctgtgtttcagtcactctaaatccggagcctggcaatgctttgtaaataaatggcaggtgcagacaggggttctagcaatggaatgaaaagcagacagaccctaccacccccactgcccctcaggagtccactattacttcaggttggcacttggatgaatggggcttttacttattatctcagcctaaaaatgaatagcctctcaactcaatctccaaataaaatatcttatacagatttactatgttgcctcactgttttccttagagtataaaatcttttagctaaaatatattgaaagggaaatcaatgaagagggagaactaggagataatgtgttcaccttacttaactggaatgaaagtttttggtttttgtcgtcttttaatagatactgaatttgacctttgtttagcaccctaaatcatagggatagcctaccattctatcgatggtagaaatatagttgttgatccattatgagagataaacttccaaatctaagctgacagtacgggtttataacagcgaaagacagaaacaggtcatctgttggttggcttgtaacctgattacaaaccttctgtttgctttaaaaaaaatgtggcaatatatacacagaatctggtagtgcctcaacctactttgaatactttcatatgagctctggtatccccatcatttagcttccaaaaggaaattactatgcaagttcttagaatatactattgtctttggaacacttcaaatagaagagtggtaaccagaatacctgaagcaggtagatcatctgatggcttacatgaaactgctttcgtatcatctagttattaaaatgtttaccacgttgatgccacatttgtttgaaaacactactaaataccataaacattatgggaggatggctaatgactcatactatttggtaccaggcaagttaaaacagagaaaatgaaaaccggaaactaatatcaagtggttccaatatgaatgatgctgcaaagtcaagatttcatttccaagaaatatttttagcaactctggttaggcagattttcaacatgtttatcatctctggttaagtagattttctactctcagaaacctacagatgtttgctttaaaactgacaaaggggttttggtaggagtggcgtggaacaaatgaagtagtgggttatcttcttcaaaaagctcttaagaggccgggtacggtggctcacgcctgtaatcccagcactttgggaggccaaggcgggcagatcacctgaggtcgggttttaggaacagggcgccaaatctggccataaactggcccaaaaactggccataaacaaaatctctgcagcactgtgacatgttcgtgatggccatgacgctcacgctggaaggctgtgggtttactggaatgagcgcaaggaacacctggcccacccagggcagaaaaccgcttaaggcattcttaaaccacaaacagtagcatgagtgatctgtgcctggacatgttcctgctgcagataactagcaagagccatccctttgttttggcccatccctttatttcccataagtaatacttttagtaaatgttatgactggcttgctgtcaataaatatgtgggtaaatctctgttcgaggctctcagctctgaaggctgtgagatccctgatttcccactccacaatctatatttctgtgtgtgtgtctttaattcctctagcaccgctaggttagggtctccaccaccgagctggtctcggcagtcgggagttcgagatcagcctgaccaacatggagaaacccagtctctactaaaaaaaaatacaaaaattagccgggcatggtggcacatgcctgaatcccagctacttgggaggctgaggcaggagaatcgctccaacccaggaggcggaggttgtggtgagccaagatccggccgttgcactccagcctgggcaacaagtgcaaaactccgtctcaaaaaaaaaaaaaaaaaaagctcttaagagcacataaacataggaactttgtgaagtctaaggacaaaacaaaaaacaacatcactaacagaccataaaattagaaatcagtcacaaaaagccagtcaaaatatccaagaatttatggttgaagattgaatgaaattgacaaaatatttagacctgaattttatatatgcacatatcaaaacttgcaaaatgtagctgatgtggtcttttgaaggagaagaggtaaaaaataatcagttcaaaaaattatactaaagaggccgggcgcggtggctcacgcctgtaatcccagcacttcgggaggccatggcgggcggatcatgaggtcaggagatcgagaccaacctggctaacacggtgaaaccccgtctctactaaaaatacagaaaaattagccgggcgtggtggcaggcgcctgtagtcccagctactcaggaggctgaggcagtagaatggcgtaaacccaggaggcggaggttgcagtgagccgagatcgcgccactgcactccagcctgggcgatacagcgagactccgtctcaaaaaaaaaaaaaaaattatgctaaagagtaaactcaaagaaagtagaggaaaagaatgaattaaaaatctgtgtttataaataaaaataaaagtaacggagcaaaaagacgggcattagaaaatagtcatttctgacctctggtcagataaagggaaaaaagcaaaaaattagctatgttaggaatataaatggggacaacactacagataaaatagttttagaagactaaaatttattatatgtatacaagggaatagtatactatttaaaaagaattagataaacatgtaccaaacaagcctcaaaaaatacaactggcagaaatattcctagaaggaatcctttagtcaatatgcacaaagcatttaagcatttcattatttttgttttttttttttttgcttttgtttttgtttttttgagacagagtcttgctctgttgcccagactggagtgcagtggtgcaattttggctcacagcaaactccgcctcccaggttcaagtgattctcctgcgtcagcctcccaagtaactgggattacaggtgcacaccaccaagcccggctaatttttgtatttttagtagagacggagtttctctatgctggccaggctggtctctaactcctgacctcaagtgatttgaccgcctcagtttctcaaagtgctgggattacaggtgtgagccactgcacccagccttcattgtacgtctttttgtcactagaggtacattttgttctaacaactaagaccccaaagcatccttttaagctttatcgttttgtaaaatggttaaaaataacattttccaccaatgacacagataaaattttaaaatgtggtggtattattccattcttattttaaggatatacatatatgcaatttgtatgtggatatgattttttgaatggtgaacagaaacttagtggtcaggtagctggatgcggtggctcatgcctgtaatcccagcactttgggaggctaaggcgggtggatcacctgagttcaggagtttgaggccaacctggccaatatggtgaaacccagtctctactaaaaatacaaaaaattagccaggcgcggtggtaggcgcctgtaatcccaagtactcgggaggctgaggcaggagaatcgcttgaacccaggagacggaggttgctgtgagccgagtccgcgccattgcactccagcctgggcaacaagagtgaaactccgcctcaggaaaaaaaagaaagaaagaaaataagaaagacagagagagagagagaggaaggaaggaagagaggaaggaaggaaggaagagaaggaagggaggaaggaaggaaggaaggaaggaaggaaggaaggaggggaaacttagtggtcagatggcaactagg

SEQ ID NO: 17766 - DNA, 18430 bp, Homo sapiens
gctggtggtaacatatttgggccaacacattttcttttatcatattatctgagagtgtgtgtgatgcttatagtgtgtgaccagaatctatttcaagtcttcatgcaaataatgaagaatgtttttaatcaaattcttgttgaaagtcagaaaattctcataggtagcattaactttggaaaatcttttttgctgtttaagatatagtaaaagaaagtatatcagctctttaagggacaggacagagtgaaaagataggattatagatgtgcaatacagagtacaaaattatacatttgagaaatcctcttacttttatagtcaatagaaccatgagtctcaatgtgaaaaacagaatcaacttgacatttgcaggccaaatgtaagaacaatgaatataagaacattttaaaaaccttctaaattggtttgatttctaagagacaaatcataaccatcttaggctatttgaatgtctaaattacaatctactttctcaaaactgtctcttcagaccatggcttccttcagttttatatttaagttgaaatttcttatatacacacctccacttcattatttttttcttaaggcgtgctagaaaggaaagacttcaaagttccttagggaataaaagttcaggttagagaaatacacacatttttctaagctaaggagataaagcccagatgtttctcacagatgcttccgaggttgaaaagcccatctgtggagtaagacaaagtcatcttaagaaccttctctgacctgatacaacagaatagattctaattatgccatcagttggcaggttagtgaaatatatttttaggaatcttaatttatatatggagaatgttagtatagcaatttagaagctatttcagactatcatgtgaattttcatgttattcttccttaaaaacagagggttaaacaattttatcatttgaaccaatgtggggattctgccagttgctgattatgcctattccgattatgcactccagaagtggggaagtaaccacagaaagagtttagggacccactgtgagatggatctgagctaatattctattcatcacctgacctccacaaacccctacattgactggtggaccacagttatgttttgggcctcttggaattagtgtcagttcagagcaagtgtccactaattcccaaaagtctgattatgtactttctcctaagtacagtcaccctggtaaaaggccattggtccctttgggggaggggtggaagaaagactaacagtataaatttttggtagagtagctgagtttttcctcaaggggcctggccttcccttcatttgaggggttctgggtttgtaaactggccccattctgggatttgattgagggtccatgactgtttttatgattcaaggtagacttctgtttgcttgacccaaaactcatccagttgtacagattaagtaagaattgagtagactgccagtctatttcacttctagttgcaccatgatcagctagccaactccataggtctcctattggttctgtttctgcggaaaaccctggtaactataaaggccatggaaaggagaaaaaggcatttattaagtagaaatggtctagttctctaaaaatcaagagaaaaaaagaattttattcaattatacaatttgagagcttaaaaactattttttaccttctggattttgttcagcaacattgttacattttgttggagatagagtcaaatcactgacaatagggcaaccaactaatttcggtataattatgtgtccaagaactaaaacttggtaagaatccaaatctttcagaaattaaaaatcacatgacttcaggcacataaccaaatccaaaaaggcaagtttcaagagcaaaggaggtgagggcttacattgttttgctctgtcctcgtccacgttggcmtcatcgacrgcttgctgtatctcatccagccaaagcactttggaaacactctcagagtcctggggacaatgtcacagaataaaaagaaagaagagtgaatgatgaggaaacagaattaataactgcttttgaggagccatttaatcataattcccacaaattcttaatcagcaactatccagctctgccatatactgtacacactcctaatgaagcagaccccaaacccgaccacttcctccttcttccccaccactctttagtccagccccccatcatctcccaactggacagctgcatcagccccctagcagcttctgctgcatctaagcttgccctcaccacagtggccctctacagagggcccagaggatcccttcaaaatagatagctcagtgcaccactcctctacttaaagcttccccaaaggcttccccccggcagttagaaggaaacacagggtgccttctcagggatggcggggctccaacggcatggccctgcctactgcctctctggctgcacctcacacccgtttacttcccccttcctgttctagaccttcacacgagtctctttcagaccacaatactctaccctcactgtgtggctgttggctttttctcaccattcaggtctcaactcaaatgctacctactccaaaaagtcttcccgggctaccctagtcaaacactctctccctcaatcaattrytgtggttcccaaactaagtgtcaaggtgtcccagggtaccatgggatatttttaatttgagagaaacacagggatcgtcgatatttatcagacacagagacaaaaattaaaaacaaacaacaacatggtgattgtcctcaaggacctaacaatgtagtgtaagagacagatgtgtcaagacatatagctgggcatggtggcttacacctgtaatcccagcactttgagaggctgagggtggtggaccacttgaggtcaggagttcgagaccagcctggccaacatggtgaaacctcatctctactaaaaatacaaaaattagccaggagtggtggtgcatgcctgtagtcccagctacttgggaggaaggcgggaggattgcttgaacctggtgggtggaggttgcagtaagccaaggtcaggccactgaactccagccttgggacagagtgagactctgtctcacaaaaaaaaaaaaaaaaaaaaaagaaaagaaaaaaaaaaagaaaaagaattataatacaatgtgatcagggcaatatatactgcagacacatgatccagacataggtgagaaagggttaacctatggtaaaggtgtcaagttgcagggggagcaaagactaagtagttaaagatagctttagaaaggaagcaacagcagcaatgaaaatgtattgcattattcctattataggtaaatattcctatttaactttgggttgattctgatggtcctgctacaaaagcagccctgacagatattaagtggaacttccaggtagcaattgtgttttataaaatcttttctgagatggcaagtaaataattatcagcagagatattttcaggaaacatgtgacatttaacaaatgggaacattttacctatgtgtaggaataagtgtcgtgttctaaatcctaagtcaagactgtgatgaatgaaaggtaatggatctggcaccgactccgtcatttaaaacttaagatggatgggggcaggaaggagaggaaatagtcactggttcctctggcaggcttctaacactattttcctcagaggttaacgtgagataatgcatgtggaaagggctctgaaaatgagataaactatctgttatttcatcgtgcaacatctgggctaaaggagacctctggggaaatgttggtgcctgcttccacaatcacctctagctatgcggcagactacaagggaagcatcagcaagattttccatttctttcaagaatggatgggggaggctcaaacaggaagccgggtggaaaggggaagactagaggaggaaaaaaagagacagggaagcaggagctaatttttctctgtttacaagatctaagagaacccaacactccccagctataacctaaaaactaagctctatgagttcatttatgtgtctcagttcttttgaagggtatttgccttccttcataacttatcactgtagaagatacaccacacagatttctacccagatgagaaggcagtaacaatcttacttcaaagcttaaagtattagtcttataggccaaactgaagagagaaattacaaatcagatgaatttaagtcaacggtttaaattatgaaacattgaactaacgattactagagttaaatgtaaaaccaaaagtaaaagctgaatcttatcaatgtaaagtctgctttttcttatttattttatttttgagatggagtgttgctctgtcacccaggcttgctcactgcaacctccgcctctcagggtcaagctattctcctgcctcagcctcccaagtagctgggataacaggcgcccgccaccacgctcagctaatttttgcatttttagtagagatggggtttcaccatgttggtcaggctggtctcaaactcctgacctcaagtgatccccccacctcagccttacaaagtgctgggattacaggcatgagccactgtgcccagccaagtctgctttttcagttgttcaccagaagactgaaaataatagtatatttatgggacggccacacctccacttcagttaaacagccaggttcaacataagagttacaaatgaattaaatgaccagaaactaggccatgtgcaaatcaagtcataaattcctgaatttagataactcccagaaaagttctaatgaaacaaaaaaaacctttgtcaatattttaggttttatatttctgcaatataataacattctatctcagtttgtataaccatatattatgtagttgaagtattaaacactgacctttgtaaaaatcttggtctaatgtaatttaatcaagatgtgaaaggtttccgcagatcaatttcttcctagcatatccctagcctttaagtctcatgtgaaatttgtattttctgattcttgctgcattttgtaaagagcaggctgtgggatggtcaggcttcaagtttaagttttattaactacagaaaaatgtgttataatgcatttttttactgtatattaagtcatactctacagaatataacaattcataaaagcttatatgttgtacaacaatgtgaatgtatttaacattactgaactgtacacttaatactggttaagatagtaaattttatgttacgtatattttaccactattaaaaatatcttattgtagacttattcaccaacactcatggaataaagggagtcctcattttcatgatgtgctatgattttagtttaactgaacagcgttgtttgggaggttcctccagttatctgaccctaagggttattgaatggctcaaaacacatcaagataaggcaaaaaaaaaaaaaaaaagcctgaacaaacgccatcctcacccggcgaagaaaaaccaccaccactcaaaagccaggttctggccaggcactgacgacaaactgaaatcaatattacattgatagaaaattttcaaagtgattcaccgctcaatttgaatttcttaaaagtttgttttccatgattaatttataattatgtaaagtgtttaaggattaagatttgaaatagctgggaagataaaggaaaggataatttattaagtagaaattacactctggaactgcatttttaaaacggataagaaatgaaatgtgggacagattcaaaacttactgctgttcaacatctgtttttggcttagttctgtaaaggcctgtgtaatttctgccattctttaaaagcaaatctactaggggagaattacagcacctattcagaatagattgttgggggtgggtaagagttaaatgcctttctccagggataacgtaacacgttcagaggcttggcctgagtcatgcttactgaagcatcgagtggattacatcctttccctgcggaggaccagggcaagtttcctgcctgcacggcacaggagagcaaacttctacagacrgaccaaggcttccatttgctgctgacacatggaactgaggtgaaattgtgctccatgattttacagatttcataacgtttaagagacgggactcaggtcatcaaaatgaaagccctcatctttgcagctgctggcctcctgcttctgttgcccactttttgtcagagtggtaagcaattttctcagggggtaggatggggatgtgggtttctgttacaaattaagagtcaactgaacctaggtttctttgcatctcacacaaactgtaaaccccaaaggcagtttgatctttattattaaaaggtagaatcatggaaatgaacatctatagttcattcactctattcaaacctggtcatagactaagtgttccctcctgatgtttaaaaatgtgtggcatattcaagattttagatgtctacrattaagtcagggagcaattttgaaagtcgtttttgtgtttgtaagaatttctcttctggttaagcaaagatggcactttttctagggattaaaatatatatcctgtgtttaaacctcttggtgagacataaatgggagaaacaagaatactgccagaaagagaaagtcatctgctttcaatagctggcaatgctaataagtcagtatttccgaaatgaatgaccttttttgactttaagtggggagttctccctaccctcatatatgattttttaattttaaaaataaggtctcccaaatactattattcaactttgaatgtactttccactttacccatcacaatgttagcctgaaacctcctgctttttccaaaaataacaaatttgggataggtctgtacctgttactctttgttaggtcacacactccagtcaacattgttaggagtgggagaggcaaagactggacatagcaagggaaacaaaaacagaaatcaatgctttctaaaggaacattgcttaaattcacatttggaatccctgagcggttgcagagagctctaagagaatctgtggtgattagcagtaagcacatgtgggatttatgaatataataagtgcacgctctttctgggagtagatgggccaatatgttgagaagcagaattgcaaaagaagcaaggttttcgggggtggttccttcaagacgctaatagggtttgatggaggtgaaaacgggggcctctgaaggaaacaaagaggcagtgaatttgctttcttccatggggtgggggagaaatgtgaaggaagaatgaagcaagcttgtccaacctgccttatttcgttgtggttttgttttgttttaggcttttagcagcctgaagccatggtttttagtttctgtctctagaggtaaatggaaaagagggatgaggaaggggctttactggctcaactagaaacagaaactatgaatccatgactgtattctctcccttggacacccctgagaggcyggagttcattctctttggattagttcttcaaggccttttcccggatagaaaaacatttccgaaatattatgcccaatggaagcctcyataaagaattaaaatacaataaaaaaatttaacaatgagtacaattcataaggaaaaccaggctctgaggaataaaagccttatttaagtggacccagatctggcattctcacggaaaatggaatcaaatcaacttttccacaaaacacaggcactgtttggcatgtctggaggcatgatgtcttgctaaatcccagaaactttctgaaaacggacaaacacttggttttaacagctttttaaaatcaggctaataacttgtacggcatgctcttcaggcaccattctctaactttgtgcctatctttaaaggcacttctctttgggtgawgtcagatgcaagaacttttccaaaatgcaaaagtgagcagaagggtttgtgtgtcacacaacacagcttctaagatcacctctaaatacaggcatagaagaatgctgcctcccaaatttttctttccttttctttaatctaccttttcttaaatgatacctgatcacctccatacccctcagttactaggacacacctcctctattttacaccgtgaattcagcttgtgcaatctcaggtttacgtggagggtttccatttcacccgggagctaactgctagagattaaagcaggaagagaaactggctctgaatgaaacataggttactaaacactaacttcaagtattcaatatggaggaattttgaggccatgggacaagacataatggcgcagtactggcattttaaatcgataagaatgaggtttatatttggcatagaagtctatcttaaaggtaacattagaaatctgggagaatctattttctatacatgtgaaagggttacaaaaagttatataataataaatgttcaggtttgagctttaagattttgtttttgaaattgcaggaattaggattattaacatcaacatgccaagtaacaccaaatattgatagcatatagttgatgtgtttctatcttttaaagaattcatttccaacttcttaggtcctcataccgatttcatcttccgatttttcctcctttgtttcctcttcccttaaaatctgtcattacccctaaagtccacctttggattctttcttctcataactccccctaggccatctcaaccactcccattaaattaaacgagagcctccatgcagactacaataaatcatgcctctaatttgggctyctggaattttggacccacatccagtcttctaaccagttgctggacattttacacactaatattccaccagcaactcatcctcagtcagactaaaaacagattgtagcttctccccgatcctgtctccttgtctccctccaactcagttaatggcatcctctccctccaagtcatctagagtagaaacctgagtcattattgcttcctgcctctccctcactgcaccccaaagccaatcagaaccaagtccctttaagccgccatcagagtctcacgtgttcgcctctgcctttccataaccactgttctagctcagtaactcactgagctatgaatgatgacagtagcctccaaatcaggtccccttgcctgtaatttcttacctttccaatctgttctctacactattacctaagtcatcttaaaaacaagtcaaaataacggctatattcgtttcctactgctgctatatcaaatcattacaaactgagtggcttaaaataacagattatatttctggagatcagasgtcttaaaatcaaggctgttggtggggttgtgttcattctsgaggctctaggagagaatcggctatcttgcttttttcagcttctagaatctgcctgcattccttgggttatgaccctttcttccatcttcaaagccagcagcatagcatcttcaaatctctgactttgacaaccctcttaccttccccttatatggactgttatgattatatttgacccacccaggcaatccaggaaaatctcattttaagatccttaactggccgggcgcggtggctcacgcctgtaatcccagcactttgggtggccgaggcgggcagatcacgaggtcaggagatcgagaccatcctggctaacatggygaaaccctgtctctactaaaaaaatacaaaaaattagccaggcctggtggcgggcgcttgtagtcccagctactggggaggctgaggcaggagaatggcgtgaacccgggaggcggaggttgcagtgagctgagatcgtgccactgcactccagcctgggcgacagagtgagactgtctcaaaaaaaaaaaaaaaaaaaaargaagatccttaactaagttagatctgcaaaatcccttttgctaggtaaaggaatatacttgtaggttccaggaattagcaggtagaatctttgcggggggctactattctgcctaacacaatggtcattcctctgttcaaaattgtgtgtgcaatcccatcatctgtgaatagacatatgatttcttaggacagtttagaggcccttcaggaatttagctgtcacccactctttcaatttcctttctcagctgcactttattcgcataagacaatgcatttttatgcatcttctccacgagtagcattacttacagatagaaatggattttatttaaaactttacaccactgacacatcaatgtacaataaaaatttgctaaatcaacttatctggcattcccagatcccatgatagcccacactatgcttctgtccattcatcaccagcagaatcttactcattaaattccatctttttaggwaccttgctagtctttgctcaagttcatcttttccttgacattttgctcaaacatctgaatctattaagtattgtctgaatgcctgtatagtttgtagtcaacaygcctataatgttctgatgggctgtttttgtttcttctaatagtattataaacactttacatacaaggactgatcatttagtttttgtttccgcacaagatagtgttgttctggggcatatgatatgtattaaatatatgcttgttgactgcctaatctacaataactttttaaaataaaaatgatcttaaattctacaatcacagaaattatttacaaataattaaacacactttcttttctcttgaactatacatttatgttaatactttctttcaattacaggcatggaaaatgatacaaacaacttggcaaagccaaccttacccattaagacctttcgtggagctcccccaaattcttttgaagagttccccttttctgccttggaaggctggacaggagccacgattactgtaaaaattaagtgccctgaagaaagtgcttcacatctccatgtgaaaaatgctaccatggggtacctgaccagctccttaagtactaaactgatacctgccatctacctcctggtgtttgtagttggtgtcccggccaatgctgtgaccctgtggatgcttttcttcaggaccagatccatctgtaccactgtattctacaccaacctggccattgcagattttcttttttgtgttacattgccctttaagatagcttatcatctcaatgggaacaactgggtatttggagaggtcctgtgccgggccaccacagtcatcttctatggcaacrtgtactgctccattctgctccttgcctgcatcagcatcaaccgctacctggccatcgtccatcctttcacctaccggggcctgcccaagcacacctatgccttggtaacatgtggacyggtgtgggcaacagttttcttatatatgctgccatttttcatactgaagcaggaatattatcttgttcagccagacatcaccacctgccatgatgttcacaacacttgcgagtcctcatctcccttccaactctattacttcatctccttggcattctttggattcttaattccatttgtgcttatcatctactgctatgcagccatcatccggacacttaatgcatacgatcatagatggttgtggtatgttaaggcgagtctcctcatccttgtgatttttaccatttgctttgctccaagcaatattattcttattattcaccatgctaactactactacaacaacactgatggcttatattttatatatctcatagctttgtgcctgggtagtcttaatagttgcttagatccattcctttattttctcatgtcaaaaaccagaaatcactccactgcttaccttacaaaatagtgaaatgatcttagagaacaaggacagccatcacagagaacgtctgttttcaagaacaacataagcatagtgcaaggagctccatttccgagctcctaagaratatgcttcaaaggtcaaacattacaaaagcattagtagtttgtttgtttgtttttgagactgagtctcactttatcacccagactggcgtgcagtggcactatcttggctcattgcaacctctgcctcccaggtcagcctcccaagtagctgggattacaccaccatgcccagctactaaaaatacttgtatttttagtagagacggggtttcaccatgttgaccaggctggtcttgaactcctgacctcaagtgatcttccggcctcagcctcccaaagtgctggattacaggcgtgagccactgagccagccagcattagtaatttttaaaaacactttatcagtattttaaaaatgttaatgcaggagaaaagatatcacaactctatggaaaatgacatttccatttgccttattgctacttcaagctctttaaatcaccatcttccctatttctgygagtggtattgccatccttgacatttgacatcattttttattctttggtctcttttgactctcatgctggtggctgcctcatcaactgattctatctttgtagggtccctcaccagggtcttttatctagtttcacctttgccttcttttttcctttttttaatagagacagtgtctcgcttcgtcacctggctgaagtgcagtagcctgatcatagctcacttcagcctccaactcctgggctcaagcaatcctgctgtctcagcctcccaagtaactaagactacaggcatgcaccaccatacccaactaattttattttttattttttgcagagatggagtctcactgttgcccaggctggtcttgaactcctggtctcgagtgatcttcctatctcagcctcccaaagtgctgggactacaggcatgagccactacgcccaggccacctctaccttctaaccattctctccactgccagcctaccctccaccacttcacaagtcctgccagattaatcttccttagatatcagttaggatacatcactaaaacatttccactaactccactgtttctataataaatcataaatctttagcctggcattcaaggctaacttgctaatcacacttcccattaaaccttgcttatgatataggcaccaaccaaacctcttgctctgctatatctccactctgcctcagactgaaaagctagtcctaacgtctttgccttaattctgttcattttttcaagtccttgaaggaccattcttccctgattctcaggctagaagtgtcacttttcttatctgtacttccaaagcactttcgtatatttttattatggcatttatatatagttcatttatatttaaattttaattccatgaacaatcaagtaccaagtataatggagaaggtgctcatcctctgccttccttgagcttctgggtgatgccaggcccaagtctttgtggcacccagctccatgctttgaatactatgtggctgaatgaatttttaaaatctcaaagcagttaaacagcaggaaagcccattaacttcgtactgaaaaagcaacatactgtgatgatacgggatgacatcatttcaggttgggcatacaaaaaagtaaggaagctaaactaagactatactcaccaggccatttagaagttttaaataatgcctccactattttttttcttagacatagcttttaatggggaaatggaattttgttattaatacccattatattcctgtaagtaaatgactatttttcccttaactcagtgattagacaggaaggaagacattagtgattagacaggagggaagatattagtgattagacagcagggaagatattagtggtaaagagtgaatgatagtagtgaatataaatggggctgaggaaactttaagcataaaagattcctgagatgactttacaagtctgtacgaatctgccttgactgtatatttcatactgcccaacaaaacaataaaaaacaattttaaatgcatatttttaaatgtacacagttttctatttcatcagacttaagtaaaaagcttccacatgaagaccctttataatatgtgtgtggttatgcaaagagcaaaactcaggtaaacactaaagtgagaatgaaaaacaaacctaaagtaagtttcaagaagatagaaacttaaatggaaggagctgacttctgaaaactaagtcatcaattacaacacagttttacctaaggaaaaaatacagcaatattcgttaaaagcacacagtttttatggtatatacaaggagcaaaacagaactttttggtggagtataactcatatgttcacaagcaaaaccttcaattgtaaaatagcacacaccacccagtgaacagacatagaaaaagtgttaaagtcaacatgaccattactcaagtctctttccaagaggcaaaaggaattttgtagctacacaaggttatacttgacatactgctaaagaggacccagaatcttcaccaacttccattactgtcctccacctttgacaaaactgggcagccattctatgaagatgttacccattgtgacctttaatggctgtagcctttggcacagttttactttatactgataataccagcaatataattttctaatattattttccaaggccagaccttgggaagacaaggcacagaaataccatcataaacacacaactggaaacttctaggaatcaaaatagtagaggatgctgaatgtggtggcttgtgcctacaatcccagctacttgagaggctgaggtgggaggatcacttgagcccaggagtttgagaccagcctgggcaacacagcaagatcctgtctccaaaaaaaaaaaaaaaaaaaaaaaaaaagcagaggggaaaaacaaagacattaaagacattgccaaacaacagaattaggatttttccaagaaaaaagaacaggctgagaaaagaaagtttcaaagtcaatgaacagagaaagaaaactgcttaaaaacaggaatttaaccaaatatgattcatcgcttggacctgcagtattttaaatctgtttaaatctgttagtaattgccagtatatttcaaacctctaactatagtctaacagtggtttaacgcctgaactagaacccagatccctaggctccatatcaatgctctaatcacaccatgaaagctactgtttccacacctagaaaggatgcctgacacagagctggcatggtgtgggcactcaggggcttctttcaaaggacgcctgtggagttccatctcaatctagattggaatgctcagtctagaagggacctatactgcctgcctatgaaaggccttgggtttgtggagtcaggctcacctcaaagacaaacccccatgtggctgtgggcagacagggacccaggtctgtctctatttgtcctcagaagatcctgactttggtgtgtaaattcagcagactctacgtctagtaagaaccttgaagccgggtgcggtggctcatgcctgtaatcccagcactttgggaggccgaggcaggtggataacctgaggtcaggagttcaagaccagcctggaaaacatggtgaaacctcgtctctacaaaatacaaaaattagccgggcttgatggcaggtgcctgtagtccctgctactcgggaggctgaggcaggagaatcggttgaacctgggaggtggaggtttcagtgagctgatatggcgccacggcactccagcctgggtaactgagcgagactccatctcacaaaaaaaagaaccttaagatactgacatcactcaccccttacttgggaggcaaccataggtgcccacaataatactagctacattatttaagccctttttttggtgccaggctccatgctaaatgctatagctacacaaacacgtgcacatattcttcattaatagtacctatagttatatattgatatatatttacttattgtatattctcattgaaccctcaccataatcctataagacaggtactattattccaattttatacatgcaaaaataagcatatagagatttgatgatttgaccaagatcacataactaatttgtggcaaagccaggatttaaatgatgtctaccttcaaagcaaataactttgtcttccaatgcttgtaagtttaccatgtgccatggccacagccacctcagtggaaacatcaaggtgaaggcccactctcctgcccctgggatgtatggactccaggcttgtgtatgagccctcactctcccactcactggctgtaccttggccaggcattcgccctgagcctcaggctcattcacatcagatgagacagcacccattccacaggtggtatgaggcttaaatgagaaagactgatgtgagtgggggcgcttggcaaagtgaggagggtcaggcaatgccactgccgttcctgttggaaggctggcagtgcagagggcgccaccatgggggatacatttctccaccttcaatgaggcagtggagtagtgaggataggatttacattggtttttaaaagtttagaaacagtaattatttaatacacacactccttaaaaaatttaaaaatccaagcagtacaaaaacggagtgaagaataaatctcccatccatactagccttctagttcaccttccagaaggtatcctccctccagaaatattttagacacatgtaagagtgtgtgcgcccctcccccaacacatacacaagcctatctatattccatctatgtgcacatcacagcatgattttttttttgcttaacaacatttaggttgtttttcatgttttgtgattgcaaacaaagctgcaataaacatcttttcccatctgccttaatacataattataatgtttccgaatcagacagacctgagctgcatgtagtctcaggactaattatcttttagatagcttgattttgttttattttattttatgtatttattttcgagacagagccttgctctgtcacccaggtgggggtgcaatggtgcgatctcagctcgctgcaacctctacctctcggttcaagagattcttgtccctcaacctcccaagtagctgggattataggtgtgagccaccacacctggctaattttttattttttatttttatcttttagcagagatggggtttcaccatgtttgccaggctggtctcgaactcctggcctcaagtgatccacctgccttggcctcccgaaatgctgggattacaggtgtgagctactgtgcccggtcacattttagatagctttcaacaagttacttaatcttggtttcattatgtgtaagatggcaataatgatggcaaaatggttcagaaggctgttatgaattgttgtgatgattaaatgagatgatacacatgagtatctaatatcatgcctgacaaatagtaggttctcaataaatgtttgcattaaccaaggatgtttttcctgtttcgaatgaggcagttcctaggttctaaagacctagacagaggagatgaccgccctttcagttgggtttgcacctgaagacatggcagccataagtagctaggtcccaggtggcatcactcccactcttaggtgacagatcatatcagcctcaccactcagcccattggccttatcacagaggccagtctttgtggggctccttataatagcggtacaagctctgtactcagaaaaagccactagtcttcgagaggacagcttctgctctacctccacaccaacttctcttaggattctagtccccgacaatctcaaacatccgtgaatcaatctgtgtatctctcattttgacactttgcacacccttatctttactattacttgactgttccatgtgacaatgtccactgcctcaatcagtttctaagcattttgaagataaggtcagagaacattcaaatggtattatgtgtccctctgtatccccatcttctctaccagaagctatggactgaagtgtgcacatagtatctactaaggaaatagtcaatgaattgaactctgaacaagaactcacctacaactgagtttttagtcaaagaattaaagcaataaatagctctggagctggtttccccccaatgtttgttaccaggaaaataacagctctattatttccattctgattcatgggtaattgttgggacaagaagctcatgagatttaacgtaaatgggtcaaatcctcctccttctctccctctgccacccagcctgtaaaatttaaaagaaacagatatactaaaacttactccgagtttctgtgatttagcatggtataaaacatcctggtagtgctgggcrtgggcwgggtccacatcactaatattcgcagtaggtaggagcaaagtttctaaagtcctcaaaggattcccttcatcaatagcttcattgatgtaccctacagctacaactcctagaaaatgaagaagtagttttccttttaagt

SEQ ID NO: 17767 - DNA, 138434 bp, Homo sapiens
tcctttgtagcactttggagtttgatatgaagtatcttcttatcttgttaagggatccctataccaagaatgttttcatctcaaccccactatttctaagttagcttaaaaacaaaacaaaaccctgtgtgctctaataagaagatataagaaccaaaatggaaatgcaggttctcaaatgagctgaaagattccacatagcagcggggcagattgaaacactctttaccaaaggaacatgggagagaaaaggagattaaatcaagaaaggaagaaagctaatgacatatgaggagccacaaatgccacaaatgaaaaaacaaagtacgtaatacttgttgcaattattcagtgtgcttgctctaatgcctccaaacattaaaaacattgagttcctgcttatggcaacatttatctcatttatctgctgatagctgcctcatccttgaatcaggtattgcttaaactaagttctgccagcataaagaataaagtcaaccaggacacccattgggcatttcacgcatatgagcacaaattgtgatattttaggttgcttatgatgaaatcattgaaagcatcatgaaagacagcaaaacagcaggaaagctagtaataatttagcatttcccagtccaggcgggaatgttaattctaattacaacgaggaataccaaagtggagttcattatgattaagaacttgctgtactagtgtgaattgtttataataggcatgtctggcataaaatacaaatattgaagcagacagagatggctcattcaaagctcagctgggttcccttgaacctcttaccttataaagttaaataggaatagaagtattttccaaagtcaagatattattttaaagagacaaataatagctatgatagctgcaggaataattttttaaagtaagttctaaccaccaataaaagctgtttgtgtgggcttaacatgttcaaaatacacaatacacatgtacacaatacacgtatacatggttcccatttatatttaacatcacacatttaaagtgagagagtacagaaaaaaagaataaatggaaactgaagccatgacaaagaatcacggactataggaaaataagtcacaaagaagtatgcttatgtaagaggaaatatatgtgataaacaacaggagacatgggaatgaatgtggtgtcttatgtcctttctttaacagaatcgtgtaacagacactactcaatatcgatctcaactgatccagttctccagtctccctggaaaacaatggattgatgcccagggtgcgctgaacactggaaccatggtcacttctgcacttcacacgattctgctcccaccagttgagctaccaacagttcctggtgcttttgcttcccaaacatgtttatgccatttgttgcttattactgtacttacttaatttgattaaatattaagtaaaatgatgaaatgagtgtaaaaaattgttctataaaatctaaatggaaagatgccctatagccttccttgacttacagttgcgtcaagtaaggtggatgtaagacaattttaaaagactggtgtgggggcaggagtgaggaatcataaaaatttagaaatctgcacgaaaattattctaaaagtacacattgaacatccctaacttgaaaatctgaattttgaagtgctccaaaatccaaaactttttgagcattgttatgataccacaaatgaaaaatcctacatggaagtacttaccacaaactttgcttcatgccccaaattattttaaatattgtataaaattatcttcaggctataaggtgtatatgaaacaaaaaatgaatttcctatttagacttgggtcccatggccgagatatctcattataatgcaaatattccaaaatcagaaaaaaaaaaatccaaaatctaaaacactttcagtattaagcatttcaggtcatggatactgaatgtgtatctttaatttcttgttctactttgtttaaaaaaaagggggaaaatagtaattctacagatgaataataattgctaatgatgagcaaatacttcctatgacccaggaattcgtctaagcacttcacatatatcaaactggtttaatctttataaatcagtactattattatccccattttacagatgatggaaaaaggcacagagagttagcctgcccaaggttacattccttttagtggtggagactgtatttggcctttatagtctggcttttaactgctacactatatcaatgcattacaggtatagtttatacacacactaaagaagacatggaactccagtcagtgggctcataaaagctttagaccttcatcaaaagattagaaaataaatgttcaatcacaggttttaggtttcaaaagtttcaaaagtttaaagtttgcaagttatctttcttaaaattatttccttcttttaactaatttttaaattaaactccagttcaatcacatccactagaaggcttcactttctacaaaggggtaggtaaaggtgatgatcttaaataccatactgggagttgggatctgtgtagcactagaatcaagagttattgtatatacttgagaaggagcacagcctgatttagttgatgttttggaggggtaatctggcagtacagcttggattattttagtgggaatggagatgacaaaacatgaagagaatgggagaactcacttgggtaatatatcagtttctgaaatcaatgtatcaagtggtttggttattagtcaggcttaaggttttattggccttaggacatagtctctaagaccatatattatcttcattcattcatttaaccaacacccactgagcaccaactatgcactagtgatacaggggtgaacaaacagacacagtccctgcctttgcagaacttatgttctggtgggtgatacagagaaataacaaatgagggcacaaataatgaactatcattgtaatgtgctaacaaagtatgcagaatactataagaacatacaatcaagaatctaatctagtttattttaaaaaaaagtggggggagcactcagatgtttaaacacaaaacaataaaaatgaggatcttgagggttatctgtacactttttattaacccatttggccacaacaataacccagtaaaagtgattttacatctagttaactagttgactcaatgttattataaccctgtaatgtatttgttgggtgcctgctatgtagtgggctgtgttccaggagtgggacataaagctatgacaagatagatcaggtccttgccttgactgagtctgaatacatcaccttcatttccacctctgcttctaagacaatcaaataccttcccactcagatagggattcatcctatttcttgtagtaattataagttcccagggttacagattagtaaatgccatacctaaagacttaggatactgtgcataaaacactttcaatagtgtctgtcagacagcagatgcgcaataaatgttgactttcgttagaattgtgttattattataatgctaaatctcacgtcctttctggcacactggagttcatctcttcaattaaattccgtaagcacatattgtaagtagtctatcagaattgatatactacttcatgttaatgattgagatcagtgaggaaaaccactttaatattgtctaattcctctcttaatgcataggagccatgtgaacttagacaagcatcaacctctgtaagcctgttgtcctcatattgaaaaatcgaataacaatacctatctcatttaattgttgtcagcaaaagtgggcagcagaagagtggggatcaataaatgttagccacaaatcataactatttgtattactctgaaaaagaggggttaacttatagttcatgcatgcttccaaatgaatgtgaaagactaaagaatgagaatttttttgctatcaaattaaaaaattaacaggcacatttagattgctgaagagagaaattaggataagtttttttttttttttgctcaattaaaaacgttttcaatggcatatttaaaactacgtattcttccccattaagatctgcagagaaaaaaaaatgaagggagaataattgggaactcttgtgaaatcataaattatttaagcagagtacctaccactaaggatttgagcatgtatgagcgatgaggtggattcttagagcagagattcagcagtgagacaggctaatggcatggggagatgtgttctattagacaactgtattgtccccttaattatatacatatatatgtatataatatatatgtgtatacatatgtatacatacatgtatatataaatagaattcttaatcattttaagcagtgtacaaggataattattagcatgggctatttaactcacttttaaaacgtgtaaaacattattgtagggttgggtcttgatttgtttcccatgaaactgttggtagtttaggggccaaattaacgaaagacatctcattctagtgcttgaggctcagaaattggaaaaacgggcaactaggtcaagcagtgttctcatagcctcacagatgagcatccaaagcaagggcctccttctagttgacttgtgccaagggacaggagaagcggagtctgccttctgggtccagaagggggttttgttaacatggagttgctcagcgcccttcataaaaattcttctggctgagggttctacgttggcatacggttggttccctcttcttttccgaggtggcgagtatctcttcctttgccaagatggcggctccagaatcctctggaggcggcccccgtagatcgtctccggacaagaggcttgctgaaagcctacttctttcctttcacatcagacaatgcacagggaaccgtttacccttgagaaccaaggaaggacggcttaggctacccgcgatcgcgaacctttgccaagatggtggccgcggggacgggctggcgacactgtaccctaccaagatggcggcgggcggcttccgggacgcgcttccccaatcgtcttcaagatgtcagagcagggggagccgccgtcagtctgagcgcggcgggaggtgagagagtggctgtggccgagcgcccgagcaggattaggtggagctgcggcagcccccgcccgtgtcaggagctggcaagcgatgtcacctgtgggggcgcaaaagttacctccccaaaccctaaacccacacagcacaacctttcccagagtcacaaaaatcataatctgtgccgcacaaggtaggaggctcggtcccggcatcgtccaagccttcccgacgcggcgagctggggaagggagctggggcgggggcttcccgcacgggcacccctcgccccacggccctctcctttctcaggacggaccacgagttcccttccccttggactgaggggraagctcctaacaggaacatctgtagggagttgaacgctggcattttaaagctgcctgtattttgttttatttgtaggggcaggggtcctatgaacgtgatagggtgagcaacgcacagagtcgagggcagcaaatgtcaagattcgggggtggggcctgcaccgggaacttggacgcgggccctggccggggtggaagaagaggtcaggagtttcggaaggggggctatatttcgccagcaacttactatttcgcctgcaacttgcttttaagcctgccgccccctgctttccttaatcataataataaaaaaaaagtgcaaagaaatccagctcgctggaggttttgcatttggcgtgcaacttccttcgagtgtgagcacattgggcgggaggggtgggggttgaacttggcaggcggcgcctccttctgccgccgccgccgcctcgcagactcggggaagagggtgggggacggtcggggcgcgggggagggtgggttctgctttgcaacttctctcccagtgcgagagcgcggcggcggcagctgaagacccggccgcccagatgatgcggtggtgggggacctgccggcacgcgactccccccgggcccaaagtacgtatgcgccgacccccgctatcccgtcccttccctgaagcctccccagagggcgtgtcaggccgcccggccccgagcgcggccgagacgctgcggcaccgtttccgtgcaaccccgtagcccctttcgaagtgacacacttcacgcaactcggcccggcggcggcggcgcgggccactcacgcagctcagccgcgggaggcgccccggctcttgtggcccgcccgctgtcacccgcaggggcactggcggcgcttgccgccaaggggcagagcgagctcccgagtgggtctggagccgcggagctgggcgggggcgggaaggaggtagcgagaaaagaaactggagaaactcggtggccctcttaacgccgccccagagagaccaggtcggcccccgccgctgccgccgccaccctttttcctggggagttgggggcggggggcgaagcgcggcgcaccgggcggggcggccacgccaggggacgcgggcgtgcaggcgccgtcggggccggggtggcggggcccgcgcggagggcgtgggggcagggaccgcgggcgcccctgcagttgccaagcgtcaccaacaggttgcatcgttccccgcggccgccgcgcggcccctcgggcggggagcggccgggggtggagtgggagcgcgtgtgtgcgagtgtgtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagaggtaagaagcgaggcgggagggggccggggcgcgctcgctcccccgaggtgccgctgggaccggagacaactcgggggccrccgcgggagcctacaaacttttattagcctcggggagtgggggtggggggctggcaagggccgggcgacggtgacgaaagggcagcgcgcgggtgacagcgctggcctcttcctctccctccgccggcgtcccctggccgggccgagggggaggaacctgacctcggacggcgagcggagccctgtcgaactgccgggggcttcgagcctctcattcctcgcgggaatcctggcctcttttctccccctagtgtcccctttccctccaagggggtcgcccgacacccgttttcgtggtgaacgctaagccgcgtctgaattttactcgcccgaatatttgcacgccaccccggcgcgcccgagcgcgagcccgggctccggggaggccccggcggcgcctggcttgaggagggcgtgcggggcgcgtgagggtgcacacgcggggggctgacagcccgcaacttggagactgcggccggggccggcgttatctgttagaagtgggcgtgtcggagagagaactcaacaggtctggacgtacttctcttttaacctcgcacttttttctcttctccacccccgccccgcaagggcttgctctttagcgtttgttgttaattcgcgcctgaggtttctaagtggccccttttagaaaaagaccccctgtaaccgtaatggttttgtgctgcgatttttacaagtgctagtttgacgtttggggttgcagacttgataattgcaaccttgtaataccacttaagaccctctggcatggttcattagggccaattaatgtggctgggttatttgcaacttaaactgggggataatgtcgcttgagggagcgttttcgttttaggaaatattgttttggtttcgggtttgaaggcagctgtcaaaaaagcggcatggaaattcattgggctccattcgatacctcgtgtttagagatcgttatcgcctcagataaacggggcagagaggtggggagataagcagtttaccctcaagatttgtagtggcaagtccacacccctctctctaccttcatattcacttttcagtgagggccagtgacatttatgctgcctaacgtcatcgcataggaaaagttaccttttattggacgggatttgactatagtgtcccaaatgcgcttctccgtcttagcccatctcttaaaacaccctgattaacgatatactaacagtcttactctcttgagaataggctgagaattgggataggtgaaggtttggataggtgaaggcagagaaaattattttgaacattttactggatacagttgtacctgaatttatatgaatgtgattttacggttctgtgtttttccatttttcagtacttcgatatttgtttggaaaggaaagaacttagagatgtaatagcatttcatattgaggatctcaagcaatgtaaacaaatgtagcttaatctagatgtttttgtgagttatgataagggtcagctatatttaagttatgtaagctaacaacgtagtgagaaactactacaccttctcttctgctctttaaaatctaaattttagttggcctatataaagtgtatctcatttcatatatccaaaatttggaggtaggcacatccagtcagaagtatgggttaaaaagccttttcccagcctgtcggaagataagcagatcagcattgtttatttttcaaagaaaacgtgcatggttcaccagttggttgtactcaaaggtttggatgtgtgactagctggtaggagggaaatttggaagtaattagggattgagaattctagcatagtatttatcaaatgttatatgtattggttctcagaaaagcaaacagccgtgattgaaaagaggtaggaattttaatgatcacacttcctttttttgaaattaaatactttgacatcaacttgaaccttcagaataatcagatgtaatgaattataatgtctgtgattaacaaagctacacgttcagtaatcggcaggatgaatagccaagcttagttcgatacacttttgccctcagctgtgcaaatggattgcattgtacttttaaatgtggcatgctgaatgggagcaggggacatggctttttattctggaagatagaaactactcttctggtaacaaagaatttgattyggagttaactaaaaggttcatttaacaagctgcctcttactaatcggatcaggaagataatgtgactttagagcttatgatgttttccccccgtttttgttttttgttttgtagttgatattcactgatggactccaaagaatcattaactcctggtagagaagaaaaccccagcagtgtgcttgctcaggarargggagatgtgatggacttctataaaaccctaagaggaggagctactgtgaaggtttctgcgtcttcaccctcactggctgtcgcttctcaatcagactccaagcagcgaagacttttggttgatkttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagcccyagtaatgtaacactgccccaagtgaaaacagaaaaagaagatttcatcgaactctgcacccctggggtaattaarcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaarttggartaggtgccaaggatctggagatgacaacttgacttctctggggactctgaacttccctggtcgaacagttttttctaatggctattcaaggtaagatcagtgtttttctgtttcttaagaatggtacatttaaggtagattaatagatgtaaatcttcattgatttatatgtgttctctaaagattcatgtgcttttttatatgaataagtttaagtggccttttgaaagtaggaaaggtagacaacctaagtgacatctgtacgtaaccatttcaggttttttccttaaatagtggttttcagtatcccattggccaacggtgaggattttatttaacatttttaaaataatgttgctcattaacagatatcttaacgaaaaattatataaattcaggagagtataatgtctcataatatcatattgtgttgtgcatggtcattcagctgttttagaatatgttcttatattacaataaatgatacccttacttacatagtcaaaagttgtgctgccttatttgtaaattcgttaagtgttagcttgagattaaagagttaaaagcagaagtactaacaaagagccctattcttcaaactgaatcttctgttaaagaatttgagttttgaagttgctaaagcaatgcagtgaacagtgtaccagaccatagtattagacacaggtcttgctcacagggttcttgccataaagtagacaagttatgtctgctgatcaatctctttaagagaggaattggtgtcaacatggtgcaaaacaaaattttacgttcaaatgttcctgcaagttctcaagtagataactgatggccaaaattgttaagcttcaattttcagctttcgtttgatttttctcttttttttactcagtcgtttataagcatactgatatttttgtctgacccaaaaaggtcagaaaatggaattatcagaaaaaagttctaaatgtagatatacgtgttggtaggggtgaatttctctaccccgtaacctcatccccaattcagataaatgctaggttttatatccattttagttgtgaaggaaaatataaaaatgtggattgtagtgacacaagattgattaatcagcgggtttttttaaaagaagacatggtagacagtgatttatttgtatgtaactattgaagttttttcttaaatgttagtgatattcatcgttcccattaactagttattcagatttttgaaaatcctttttctgtgaaagctatcctaacctggaggatgtctcttttctttcctctgtacttaagaagcttttcttgttagggaaataatttagaattagatttaggctatgttctgttcttctaaaaggcttagttgtcaaaaaaaaaaaaaaaaaacaccaaaaaaccttggttcttacatgtcttaatgtgaactacctcctaatctattgtttaaataattatcctttatttagaagaacactacttcaacctgagttgaaggtttaaaatcttttcagtaaggagatttgagatctttattattgcataagctgttgtgttttaaatgctaaaagacatgctgtgttttaaaattttcaattgcaaatttttggcaatagaattcgcatacttggttttcttaaaagagttaagtacggttgatttgactaagctatctgtaggaaactcttaaattgatttataaaacatgtaattatacaaagaaaaataaaacatcttaggaaactcttggggattattaatggattttgccctgataatcatcatggcatggttttcattttccttactataaagaaaaggcaagggacaaaacttattttccatttgctatgaacttttaaaccctataaaatctgggatatagagtataagtagatgaacatagttactcttaaatcactaaaggtgattttaatgctttaacttttatagtacttcatgacataaagtatctttacgtatttttaatttgggtcccataaccttatggaggtagtaggcaaggcaatgatgatgcggctctttagaagttctttaatatcaaatgaaattattatttttatgccaatctgtgattgggaaatataatcagtagtctgtgtcctaacaagaaggtataatactttatacagggtattttgttaatatttgaagattttataccttatggcattaacttagcactgggaactatgattacccaaaacaaagcttcatccaaataaattgaaacagtgtttcttttaaaccatcattgaattagtctattgtttccaaacaacagccctgatatagctaaaattagttgctttctcttctctatatgttacatgactgtagccaaacatttgctatgaccagtgaccctgagtgatcagcaaataatcaacacattgagaccacaacttgaatactgaccttctgactttacgaagaaaaatattaaatgccactaataacttgaattccttttaaattaaaaaaagttataaattgcaatttgactttttaaaatgccacctaaaattgtttttatcagaatacttaaaaaaaaatcctcactttattctctgggggtgggaagaggcaattccttccttccaccacracattgaattatcacataaaattgtaaaattatgaatattatgattgagcttagtaaagcattttctaagttcatttatagtaaaacaagagaaaccttattctcaaaatctattctttaagtaaaacaaactagtcattctaacttaatatgcttttaaaaatactgaagttcagtacatttagcataaacttattgacgaaggcacatttctgcattatttgattttcagccttgtttcatttaagcattaatgacagaggtagagaacagaaatggttttaggtggtattagagcttttattgggattatgttgaaattttagtgttaaaaaattgttcgtatcctgaagggagggattattggagagaatgaatgatgtaggatgaacttgtaaattcagttttcggcagagtctaaaattaagtgatgattggcacttaatgaagctactaaaatttatgtagattttaatgtctcattagtaatcgcatctgtatctggttttataaaagtaatgaaattgaagacctgtacaaatacagaatgaatgaagcaaattctgctaacatcatgttgaatgttttctcagaaaaagaggaaatacgaagagaagagatttgttttgactgtgatttaccctcacccccatggatactttctttacttcctaccttttttctttttcttttccttctaaagattctggcaatgggtgtttcagtgttttttaagcttaatatttctggtactcatttatgtaaagtgatttctgaatgttaaaggagatttctttttaaatatattttcacttatttttagctttatgatgagaatcttattttttaaatctgtaacttgttatggctacatgattagtaaaaaaagtttttaaaacacactgtgtattcaggtgtgtcattttagtgtgaaatgactaatgcagaaatatgtgactagcatgtggtcagattttattgaaattacttacgatgtttctatggctagtccccttgtatttttataattggtaacataattcatatgttattttggtcttgtctatttgtgttacatgtattttagtctgaccacttttgctacttatttaatgtttatacattttatgaaagacttattctgaaatataccttgcataaatgtaggttaaatgcaaattgtattaatagtgaaatggatatgtgggtagagatcactttaggggccttttgagatttagtgaaggaaagattggatcaaaagggtttactttaatgtgactgcctaatgtgaaagtcggaacatctgcattaattggttagttacataaatcttagtctactctggcctgcaggtgactgaaacagcccaggaaatcttaatttacattaagcttagacaaggtctgaggcttaggcttagttcttaaagcacattcttttttactttaatgattattcctaattttaatgagcagtgggttctcattgtgtactagtacttaggtgggcaaattaaataagcaaaataggtttgtgctgaatagcatttacccttctgaggacatcctggtaatattttcatcaagagtaattgtgtaatgcaatatttacaggtatttgccagattaatgggcacttgttttcatatttctgagtcatggaaaatatacattgatgattcctgttgcataaagagttttcaagaaaattttgttgaattaagctataactacaaaaaaaaatccattacatrttgacctttagaaaggatttttaaaagcccatgctgtccttatttctgcagcttcagagagccgactgctcttattttcttctggcatattctattaatacttgggttttgtatttttcaagtaaataaaatattcctattgagaatttcaattttaaaaaagaaaaggtctactaagtgytcctttccctgttgaattatgtgtgatcatttctatgctaaactagattagggtgtgacttgtgatggtgatttttgttcattttacatattaagaaagaaatagaattttattgcagttcaaaattatttgtagacagtggttttaacccccagacacctaattgtgacaggttgctttccttagtgctcaatactgttgtaaatgtctctaaatacagaatttccagtggagttcatgaattaattgggggtggagggtgaagagggaggagcaacagagatgtgggatgctatagataagtttaggaatatccagatcagttctgaaaactaacagtttggatcaactgtcatgaattagaggtttaagaaaagaaaaatttaggactataggtacaagggaatgcatcaatcagaattacaatttaatttcttttatttcaggtagaaatctaaaactgaccatggctatataatactaatttttgagttatgttgtttcttactatgctttattatcaaaaaaggataaaatgcacattttacttgaagattattttagctaagattaagttcatatttttctcatttttatttaagctgctgtttaataaatgaaaatctaatgacttgaatgtagtcgacctaatgtcttaatgttgatataatcatttcatatatcatagtgcccttttacagccattgtcaactgactggagagcaacccttttctttggtaatatatttctatgggttatgtatttttctgctggaatattgagaaaattaatttttcataatatgcagaataaattatggggttctgcaagtgctagacagtcacttaaaccatttatattgcaatacattccttaaattcagtattttgaatgaaagtgtgttatccccgaattttatcacttgtccaatttaaatattaattacatcccaatagagctgcatgcttaaacatgctttttcagagtaacccaagtattaatttcgagtgcttttaaatattttttctttttagcaagtttcaacaacattaatcctgtctataatgcagcaagttcagtgaaagtacctgttgttttataatttttttttcattctcactgtagggcaccaaaaatatatataaggggaaaaaagttttaatgatatgattagttgtaaatgtttacgcattatcttaccttgaatttttatttttgtaactaataatttgagagttcaataagtatgcagtgtttaagacatagtttgttgcaaaaagtgttaacttactatttctttttacaataaaattagcctttattctagttgatttcataactgtccataatatttagctgtggctattatgaaagtatatttgatagccaaattttgaaagctattatgaaatgatacaattcactacatgatttattatttcatgctggttggggcagtgctgtgacttatgaccttatgattgtcacatgctgaacactaaagctctaccagtttgttatggacactgttttactttatgttatcgttttaatgttttcttttataattattgaggataagagcttccttaattttaagactatttaaattgcagattttgcttttttatttttttaaccatcccttccaaagaatttgatttagatattcagtagtagaaacagaagaaaaatactcaactaaaagtccaaagacctagtttctaatgctaagggagacagtccatggcctccaactaggtactttggagtcaaaaatactttctttacaactgtgtttgaattgttttcaaaacacctgtgtgtgtgtttctaaaattccacaatccttttaacccgtcaatttgatgagggaagtaattagggtagggaatggtataacaaagttggttctttgacattttctttatagattatcgaatgtaagacaaatagatgtgaatgcagatttggtgtttttataagataaggatttaaaataatgtagttggtgatatataaaaataaactattgctgctgttagcacccgagaggtggggctcttgggttctcagagcttgttttctatgttcgttacagttattttagattagaacttaaaagaacttgagagtttccctaattctaccccctaattttttcgaatgagaaattgagatccatagaaagtgttgaggtaaagatcacaaaacacttaatgagcggtgttgccagtttgaatatctcaattcttagttatctaagttccctggtaggcttctttaattatctgggtctcttctagacatctggaacaaatagttgattgacataatacagactagccacatattttataagagttacttttgactcatttagatttttaaaatatacagtgtctgtattcttctctattcattttgttaatttttttttacctaataatgattaagcaccaattatgtgacagcactatgctaagcactttgcatgcattcatctcatttaaatctcaactctgtgaaagtttttattctagttactgtattaagtctcaattctgtcaatatccatgaagcacagaaggcagctgttatttaccttaattttacagatgtgaaaactaaaggcatttaaagagaaaaagaaaaaaaaaaccaggaaaccttaacacttatctgaagggaaatatttaatattgggtatgttagttcctcatgtatctttaataatttttgtcaacagcgaatctttaaataaaatataaaggatcaggcctctgctctcctgcatatatttgtaaagtcacttactgctttttgtcacagtttcaatttctgtaaaatagtgagagggtttttacctgacaggatttgtgcatgtacgtttactttgaaaattaaaaagcattaggccaggcgcggtggctcacgcctgtaatcccagcactttgggaggccgaggcgggcagatcatgaggtcaggagattgagaccatcctggctaacacggtgaaaccctgtctctactaaaaatacagaaaattagccgggcatggtggctggtgcctgtagtcccagctactcgggagcctgaggcaggagaatggtgtgaacctgggaggcggagcttgcagtgagccgaggttgcaccactgcactccagcctgggcgacagagcgagtctccgtctcaaaaaaaagaaaaaaaaaagaaaagaaaattaaaaagcattataaaaatgcaaggtggaatttttaaagctctgccaagtccacttagcttaaaccagcatgactctcattggctaagtacgttatgacatctgtgactgtggtgtaggtattgcctataatcaagaatcttttagggtctgctatgtgcaatccctgaagggtcatggatcgcagtttcataaagactgctgtattttaaagccttcaaatgccaacgtagtatcttcacaatgattttttttttcagttttattattttttgaaagcgccttcgacaaagttttcagtggattttgttgagggatattaagtatgccatctacataatagccatagtgataactccaaccacattgttatatttttattaataaatgctagagtattctctttctggtatttcctattctgatatttttatataatcaagtatgcaaagattctttgtcattggaaaccttaatttgcctgaaaatgggaatgaaattttcaggtttaaaatttttttacatttattacatttattgaagctgtctgaaaaagctcttgagtatattgaataccaaaatttatcctaactgcataaagttgggaggattgtgaaacttgactgcactgacttgttttctttattgatcaaatggttgaaaaaaacttcagttaaacaaatttgatctattaaaccaaagttataaaagcagaggaaagcatagaattattaaacggcagtttaaattggtaaacataccgatgtagaacctaagtttgtaggcagctttcttagatggaaacttaaaaaaattttaatcagaacattatgtgaaatttgtcatctggaattcagctgggtttattaaggacaaagtgtatggctataaaatagattgagttttttttttaaaacagaaaacccaaaataaatgttctaagtttccaccttaggaggctatgtatattgctcctctttgaaactgccttcagaaccaccttgtaagccataaaagaaaatcggactcattgcactatagtaacacctaactgttcttgctcaaagaaaatgtatttatcccttagctttatttgtgtgactccaaatcatatgagtattgccagatatttagaaatttaatcctctctcgaatgataacatttattttctttgagggtttttaaaagagcccacatagatatttctacagaaaatgtttaattctgttttgaatatgcctggaataagtgaatagcttcccagggtgactattctgaaatgggtgatgcttagtggttaagttctgatttgtgttttcttgaagttattaaggaactttatgataacagtttatatattccctcttcttggcatagtaatgargtaatagagactattcacctctaagcctgattttttaaataagtgtttattttatgtttaagtaaggtaggtctgcttttggcttggacttgaatttggcaatagcagatataaagtaaacataatgtgaattcctacaacagtctcccaaacagtttaatttctcattcatacacatttcccttagtgtatcagggaattaagtatctgattatcagtatagcaagaacaactcaagtatactgaagttatttatactcataaaatagtttgagttatagctacaatataaaattaatatatttttgacttttattcctcacaacctgaaaaaaacctctgcgattactgatagtacttttaaaaactaaatgaattttgttactactatttgctaaatttagtcatgtttactgttcaaaaaatgctaggttaaaatggatcctaatctttgaaatgatgaagacatgtgtagtggtgtcaaaaataggatattcattttgtaactattctgttagtgccgaagttcttagaatttctttgtgacaacagcctgcttaagaactttagattttttagaattgtactaaaagcaaactgttttcttggatatttgttctttctccccaaaagatgatttataagttttcagagctaagaaatgggaaggaagagccatcctagcatggcaggtaatgttttactgctaacaggttttctctgcactgctttatttgccttgaacctcttactttgttctgtcagctgggaggctggtagattttctattaggtagcaaatgcttctcatcactaaacacatatcatgggctggtgttagtgcagtctgtggatgggcactacatttttaatcaagaaatgtttttaaaggaaagacaaattggtgaagtaatttctaattcagtattttagggatgagtgaccttttaattgataatgatatttaacagagctgtacagtgctttgggggtcccacagacatgtttaaacaagaaaacagtaaataaggaagccagaaggaaaagttataaaactattaagaaagaaaatgaaaattctaaacttcaattctggtgcctggctaaatttgatttttgtatgcctcagtgtttctctatggacactgggaaatcaataagcaacctagctacgttattatgttcgtaagtggaagaactaaagaactacaaagacatgttctaggccaagaattctggtggtaggtagagtgggaggttaactagatgatctccaaggtccttctaattgcacttggcagcagcaagcatttatcaagctagacactgggcatatggagatgaagaagatgaatatccccagcagcatggagagcactctgatgatagtcatccctgcctccccctccctcagtttgctttttgaaatgtgagcttgaaagatctcaaactccttcctgggaagacataactgaaacttcatggaggaaagtgcatgaatgaatgggaaacaagatttgattcaactatttggaataagaaaaggggcaacaaggagtctgaaacaaatgaaagaaaagatggaaagaattagttgactagatgaggactgagtacataggaatgagccaacaggagacttcagcaactaatggatgaaagtattatgtgcatgcatgttgtcatcaaatatcacatgatacaagacaaggagaaaacatgactttcaccataacctcagtttgtgtaccctagttgcaagatatttttttcttctagtcacttaagaatatccttattgtctaggagaaataatcctctttctgggctccccagtgtataagcccaaatctgaggaaaatttacctgaaatgttctttccccagatacccacatggtttactctctcatttaaatgtcagctctgtaaaagagatctctgactgctctatctgaaatagtagaatctttcacagtctttccttcttcttgacatcatctatttgtgtcttatctgctcacctgctacaatgtaagctccatgagagcagtgatactgtctgccttgcttactcctgtatgccagcgtctagaatagtgtctagcacatagtaagacctctacaaatacatgttgaatacctaaataaacaaaatttaacatataaaccaaaaagatatataggaatggattatatttctaatctttctcgagtgaggaaaatgtcagcagatagtgaatatcactgagagagagatgatagcccaggttatcttccccagatagaaataagccttragactgacaggtgtatatgaatacagagagtatacataaagaagatgtattttcaattgwcagtctctaaatttgctttaagacttcgaaatggattgcttttcataatttcttagaataactctggtctgtttaccattgaaaaattagagtagccaatgtttgtaaatgaagggttagagggttttttcctttggtggtttgttaaaagcttgctcaaggcagtaacatagtaaattgtcaatataggaacttttgtagcagaagctttatgcttttcacttttataagaattgagattatttaagcagatgagtctaatgtatatgtttgtactgacttacctagaaggtcaggcaagaaatcggtttcctcatttttcagataagtgtgtgtgtaatcactgagtaccttaagagaggaggggtgttttatttttgcctgaattttcaaaatatctttcttcagcttatttatattttagatttgacttattctgtctatagtatataacagtcaggaggttggtaggataagttcatctcttctactaagagttataggagagttcaacctaatatggcaatgacagtcgcagaaaagagaaaatgcaagttaagtaggtgttagccatagcaagaaaatcagatgaggtcatttaagaatgaactgctctaatgttcaggaaaaaagaggggagggacaaggacagggctctagaaggcaaccaaagagagcagccacaaaataaatgaatagctgaagaattaggagacaacaatcttaaaatgtggcagggagagggtagttgtcacattaactagcatagaagagacagaatagaataacataaatatatgagtgattattgttcttgaaaccagtctttaaaacatgggaacattcccaaaaatcaaagccagataaattagggaaatcttaaatggcacaatataactagtgatttcgtttataatttttttaaaaaggagacttaaatttgaaatttagatgtaattaaagcagataataagaaacatacttctgagaccacaaagaccctgagattcagttaagagtaaggtagaaaggctggaagccagaagggaattaagtttctgttccctgagaagccaacacaacaggaaaaaactggccacaccctagttcaaactcttattactcttatcaatagtctcctaattgtttctctagttttctcctctcccttcttaattcattctgcagtctactgccagattaatcttcctagaacaccactttcagtattattcccctgatcaaaaaatgtctgtggttttgttgctcatagcatagtggttctccttctttgtaccacagcccatatgcacgatgatagatggtgggtagccacatgaactctccataacctttggaggatttgggttatacacagtctgttatccaagaaagcatatctgagtgtaagtgagcattatagggatagtcttataattgactccttttaaaatttgttcttctttttgcaaatgccccttcagaatttacagaaatagtgtgttcattccatcagtaaaattataccccaaaatgttaataagcttatttccatcacgtctcctttcctatttctttctttcctctttcttcctgcacatctccccttatcctccacatttctctgtaattacataagcataaacagacacatatgagattttctgggttgcttgcctttaaataaaagaatgggattatcttatacccctttgtctgcagcttgcttttctcacctaacaagtacaccctgaacatccttccaggttaacagatgcggatcccattcttttaaatagacaatattctattcatgtggtttcgtgatttttgccactacaagcaagtttctaataaacacccttttctatgtaccctttacaaatagcaactttttttctaaatataaatgctatggtttggctctgtatccccacccaaatctcatcttgaattgtaatcctcacatatcaggggaggggcctggtgaaaggtgattgaatcctggaggcagacttctcctctgctgttctcatgatagtgagttctcatgagatctggttgcttgaaaatgtatggcacttccctcttcactcactgtctctcctgctctgccatgtgaaaacatggtttctttgccttccactgtgagtgtaagtttcctgaggcctcccagtaatgcttcctgttaagcctgtggaactatgagtcagttgaacctcttttctttgtaagttacccagtctcagttagttctttatagcactgtgaaaatggactagtacagaaacttggtaccaggacagtggggcattgctataaagatacatgaaaatgcggaagcaactttgtaactggataatgggcagaggttgcaacagtttggaggactcagaagaagacaggaagatgagggaatgtttggaacttcctagagacatgttgaatggttttgaccaaaatgctgatagttatatggacaataaagtccaggctgaggtggtctcaggtggagatgaggcacttattgggaactggagcaaagttcacttttgctttgctttagcaaatagactgacagcattttgcccctgccctagagatctgtggatctttgaacttgagagagatgatttagagttcgtggcagaagaaatttctaagtagcaaagcattcaatatgtggcctggctgctcctaacaacatacagtcatatgtgttcacaaagagatggtctgaagttggaacttaggtttaaaagagaagcagagcataaaagtttggaaaatttgcagcctgaccttgtggtagaaaagaaaaacctattttctggggagcaattcaagtgagctgcagaaatatgcatagatgaagagtagcctaatgttaatagccagtagaatagggaaaatgtttccagggcatgtcagagaccttcatggcagcccttcctatcacaggcctggaggtctaggaggaaaaaatggtttcgtgggccaggcccagggttgcgctgctctctgcagcctcaggacrtggtgccctgcatcccagctgctctagctccagctgtggctaaaaggggccaggagataatcttgggctgttgcttcagagggggtaagcctcaaaccttggcagccttcatgtggtgttgggcctatgggtgtgcagaaggcaagagttgaggcttgaaagcctctgccttgatttcaggatgtatggaaatgcctggatgtccatgcattctgcaggggcagagccctcatggagatcctctgctagggcagtgcagaggagatacatggggttagagcccccacacagagaccccactggggcactgcctagtggagccgtgagaagagggataccatcctccagactccagagtggtagatccactgacagctttcaccatgtgcctggaaaagctgtaggcactcaatgctagcctgtgaaagcagctgcagggtctgtacccagcagagccaccagggcagagctgtccaaggccttgggagctcaccccttgtgtcagcgtggcttggacatgagacgtggagtcaaaggagatcattttggatttttaagatttaatgactgtcctgcaggtttttggacatgcatggggcctgtagcctctttgtcttaaccaatttctctagtttggaatgggggaatttacccaatgcctgtatcccaattttttcttggaagtaactagtttttgattttacagtctcataagcagagtggacttgccttgacccaagaagactttgtacttggacttttgagttaatgctggaaggagttaagacttccggggactattgagaatgcaagattgtgttttgaaatgtaagaacatgagatttaggaggggccgggggyagaataatatggcttggctgtgtgtccccacccaaatctcaatcacttgtaatccccacatgtcaggggaggggcctagtgggaggtgactgaatcacaagggtggacttccctcttgttgttctcatgatcgtgagttctcatgagacctggttgtttgaaagtgtgtggcacttcccccttctctctctgtctcctcctctgccatgtgaacatgtgcttgcttctccttcaacttccaccaggattctaagtttcctgaggcctctcagtcatgcttcctttgaagcctgtggaactgtaagtcaattaagtctctgttcttcataaattatccagacacaggtagttctttattgcagtgtgaaaacggaataatacaatagatttccccaaagttgggttcctgagtcaggggtatgtgtatttaaaattttaacagatatttccaaattacttttttcgaggattatggcaagtcacagttccccctggcagtgtttatacttttctttataataaaaatacataaatcattattactaacaaattccttgccatgagtcctaaattgataacaacataccagtgtgccatataacatagctgaggactgttgcagtctagaattcaggctccttctctctgcttttaacaatatgtgtaatgttcaagaccaatttagtgccacttattttgtatgctttcctttatgtagtccaggccatagccccccacctcatctgatggtatcctctggcagccacagaccacacagttctttctacctaaattagtcattagcacatagtaggtacccagwaaatgtttgttgaattaatactgtttatatatttctaatttatctccaagtaaatccagtctccttaaggacaaggaacgttttcactataacacctagcacttaaggtactcaatttaggtagggctgtttgaacaaagaaccacagaggaagcaaatagcatggccttgcctttaatacatatattttactttctcttagggaaaactggaactgtaagaatctagtaacaataataagaacagcacttttattgagcagttactatatgtgaggcacagttcaaactgcagaggatacaacagtggacaaagctttagttgtttctgcctttctgaagcttatggtttatgggtgttacattcaagacatttgtaggacacattctaaaatgccatccaatttcaggctctttccagcagaaactgtggaatatttttccgttcattcagcatttacttagtgcctgctctgccaggaattgaagagaaagcccaaagacaggcagaccttacctgagaggtagtgaactgaccaggatgactgtgggcagtagacttgtttcccaaactagcctcaccatttctgtatttgcatatacgaggaaaggattagatatagggattcatgtcagcatacaccccagggacatttgtttttagtgaaaggtgccagtcttcatccctgtacccagtacacaaaccacgaagaagtatgctcccgtcattgtcaaagaatcatagaattccaaatggagctagttttgatatccagatctcacttcatatgaggaaactaggtccagtattgtgagtaagaattaggactcttcagattccctgggtatgaatctgactaacaactgtgtgaacttgaccaaattcataaccctgtaaactctgtttcctcacttttaaaatgggcacaacaaagtgatgcatgtaaactgcatagcacagtgtctggcacttaaaaagcactcctgaagttatttttagtgatgtgttttaagattagacaactccttaatgccaaaggtttttacttgagaactctgtctgttgtgccatactacacgctgttcataagataagcctttttcattaattgatctcaaactggcttcattatgatcttaactttatttcagttttatttttaaaatttatttttaatttttatgggtatatagtaggcatatatatttatggggtacaggtcatgttttaatgcaagcatgcaattgtgggggtgatatataattgactggggtgagatatctcattgtagttttgatttgcatttctctgatgattaaggatgttgaacatttcttcatacacctgttggccatttgtatgtcttttgagaaatgtctattcagatcttttgtccattttttaagttggattgtttgattttttcctgttgtctgaactctttatatattctagttattaatcccttctcagatgggtagcttgcaaatattttcttccattttgtgggttgcttctttgttgtttcctttgctgtgcagaagttttttagcttgatgtgatcccatttgtccatttttgcattggttgcctgtgcatttgaggtattactaaagaaatctttgcccataccagtgtcctggagagcttcccaaatgttttcttttagtatcctagtttcaggtcttagatttagggctttagtccatttttatttgatttttatatgtggtgagagataggggtctagtttcattctgcctatggatatccagttttcccagcaccatttattgaagagactgtcctttccctagtgtatgttcttggcacctttgctgaaaatgagttcactgtaggtgtatgaatttgtttctgggttctctaggtctgtgtatctgtttttatgctagaactatgttgtttgggttattatagttttgtagcataatttgaagtcagataatgtaattcctccagttttattttttttgttcaggatggctttggctattccggggcttttgtggttccatataaatcctatgattttttttttctatttctgtgaagaatgtcattgatatttattaataaagattgcattgaatctgtagattgctttgggtagtatggacattttaacaatattgattcttccaatccatgagcatggactatctttctttttttgtgtgtcctcttcaatatttttcctcagtgttttattgttttcattgtagagctctttcacttctttcgttgagtttattcctaggtgttttattttatctgtagctattgtaaatgagattactttctgatttcttttttagattgtcctctgttggcatctagaaatgccacagatttttgtatgttgattttgtatcctgtaactgtactgaatttatctgttctaatatttttttggtggagtctttaggcttttccaataagatcatacagtctgcaaacaagaataatttgacttcttccattccattttggattccctttatatctttctcttgtctgattactctaggtaggtcttccagtacttccagttgaataacagtgggcactcttgtcttgttgtagatcttagaagaaaggctttcagtttttccccattcagtatgatactagctgtcagtttgttgcagatggcataactttcaaactaattgattatagttaggaagtggatactttaacttgtggtaccattatcagatttatatttcggccataagcttgaagaggagctgaaaaatgcatatgtgatgcatatgcttcctatttggctctcttctcccacccccctgccctataatccacacaagttcctctctcagtcactcatcaactacttgaacctctgaggaacttggggttaaggtaaattagaataaaactgtctgaagaagagcaagcctttcatgtcttgagaaattcttggggttttagaaataacttcattgctttttttctccagttactttggcttcttcttaaagagaatactaacactttgaacgtcataatactaaggttctgcctcttcaaataaagactttaaaaaaaaatggtttttgtatgattcagtgtgaattaaatcccacagtgtaaaggactttactttcttaatgtagattttcaaatacacaattactgatgtttataagtagatttattacaccaaagcacctagcaaattcttgaatggatcaggtcttatttttcagtcttactttgcaaatttaagycaaataattaaggatttgttaaatatttgtcttaatatcaagcttttgcatatcggggccctcttttataagctttataagcaatcttttgttttctctgcttgctcaaagtagctrtgtttgttgtatctgttagtatttgctctataacaaacatactgggtgccttcccacttagatttggcaattatcactcctgtaaatgagatattacataagataggaaaaagaacagtatctttccaagaagaatagtatccttccatattaacagtttagagctgactgcttttaaaatttagtggctttaaaataacaaccatttattattcttcatgagtctacaaatgaggtgggcagttctgctgatctggccaagctgaacttatctcagctgggcacattcagcgtatctgctgtcagttggctggttggctgtagcaatgaatggtgaaagtaggctgcccttaactttttcacacagtagcattagagttacaaaagaaccagcagaaccatgcaaaactctttaagacctaggcttggaacaactatatttctaccacattctattggtcaaagcaaatcacggggctagtctagattcaagtgggtggaggagctgcaattacactgcaaaggagtgtgactgtagggagaggtgtttttttatttttatttttttgcgatttgtcacagtagttgtaggaatcaggtgtatttaaaattctgatccttctgtgatatccgaattgttcatgaaccttgcctctggtggaaaggcagaatcattgtgacagaaggataaaatcttggaatttagagactaacaaaggttcagattccagctccatcacttatttctgcaatcctgcagaagttaatcttcctgataggcattcagtaatgattgattcacctgaacctcagattctttatgtattttaaagaaagggctaggtaaatgcaaagcacttatgtaactgcttttattattgcaaacctggctcccacactccattcaaggtgtaagactcagtgtcttccttgaattaaaaaggaagagaaagtgtgttagggaaaggaagagaaatatttgactaattgtggccccaataaagtgaccactcactgggggtattttcctgtaagaaaagaatggttgaggctcagagttaagagatacaaatccaaaagtctccttggggtaggattccctgtgattcatgggttgagaggtgtaacattagacacagtcccagtctagattttttttttaaagaattgtrgtccatcctatacacactgggtgccttaatactatatgtggcaattatcactcctataaatcaggttttacataagataggaaaaagaacagtatcattccacattaacaattgaaagatgactgcttttaaaaaattaaaagggccatatagaaataaaatcacataaatttcttgtgttaaacatagttgtcatattggatgaggactaaacacctaaattcatccaactagtagtaatagaaaagatgaaacacacacacagtaaaactagattaatttaatttatacaaagggccagatatctcagaattcagacagtcagagatgttgactagagttaatgcctcttttaggagaggtaccaggtaagtgttctcaaagaactggaaactgagaccaccacctctggcattatctrtttgtgaacacaagcaagtctgaatttttccgcaccatagctacctttcatgtaagcttcttttcttagaagaaaagaaggtaacatttgggtgtaattttttattaagggtgaaatttagtgtagagagtaaaggcatttggcatagaagcccttagttttttttgtttttaagttgaactgccagcctttatggattgcagtcttcgctgttttgattgacatttcccaattcattttgtattatttatttttttaagagacagggtctcactctgttacccaggctggagtgcaatggggcaaacttggatcactgcagccttgaactcctgggctcaagcaatcctcccacctcagcctcccaagtagcttggactataggtgtgcaccaccatccttggctaattttttaaatcttttgtagagacagggtagtgctctgttgcccaggctggtctcacattcctggcctcagttgatgctctggtctcagccttccaaaatgctgggattacaagtgtgagccactgcacctggcccccaatttcatcctttacaaagactactttcaaccataaatcaacggaaacttcagctccctcagacatatttgggatccaaggatattttcccaaatgattaatgctaatttcatatcaatacatttttgcaaaacctacaaaaatggactagtaaagaaagactcttaatttgggaaagacagttacttggagagaagagaaacttaagaggcaggtcgagttcagtgttcagaaatgagaggatcataaagagatagccataaaaatgtttctccctatattgcctgctgatagggtgtatcagtgaaggtcttactaaggaccttgtaccttttcagcgctgcactgcgtgctcatagggaggaaagataaatcatgtgttttttctgacctcaaaggagcctgtatctggctagagagacatgatgcagacacatgaaataattaagaaacaattaactgtagcaggtgctgaagaatataccaggaggtcagagaatggtagagctagtgtgggcgaaggtatagcccagagcatcatcagatgattcttccttatgcaaattcacatctcctctgggtcaagtatcatcctggcatgcagcagctccataggtaatgccctaaggctagcctgaggcaagttgcaaaagccatcatattgagtcatggcctttttttgtgtggggggaggggaatggcatccccttcctgtctgccaaatcaaggaatacagtgccctcctaaacctgctttgttttagtggattgttaaaaagaagtgaatgaatttatgcttcattagggaaaggttacagtggaatactgaggagtaaggggtatttctatttaacaaatgacataacttgaaggaatgaaatcataaggatggaatttcaggcattaataaaaagctgatgagagatactttgagacaaaagagccttcccagtgtaaccgagatcacagcacctacttcacatacacaggaaaccagtcctatctgtctctcccatagagcagtagctgccttgtttttcctccctcctccatcattcattctaaatctccagtcctccaccgcaccttatccaaaccctgatacccttaagtcacagatggtgaatcagtcaaaagtagtattaaaaactagtggtacacagctacacctggaatgcagtaagaaaaatacggatttctgtacatcatcttccctccctgctcttacccccatttaagagttacagggtcagaacccaagagtstgagtttttgaaagtccctaaaaattttggatgatcacctacatttagaaccactgcactaagaaggacaacaaatatgccaataaattctgttgccaaggaggtgattatgcaagctggaaccctgataacatgaggagaatcccacaatagccaaatagtccatgtactagttacattataataaagccaaaagcagcaggcctacctgactttctcctgaggtctatcatgagcttagagagaaggaacgtggacatayagaggtagctctagatggagaagggcactaggtgtcatggaaagaatcatgtgcaagaagtaaagaggtgctctgaatgtcctagccctgcttaggtgtctgtgtcctcacatgagaatttatccacagttctttcccgctgtaacaatctttggttccaactgcatttgtgagacagcaaaaagctatggtccagtctccttccattgtatcatctcatcaatgtatttctcccactacccttgtgtgaaatacaaacttttttggcttattgtgattatgcaaggtgtatgccaactttttttttttctccacatctttcagctttctgatgggtaaaaattttccttattttgctttagaaaaattctcattggcatagatctaatttcagggagcctcccttgaaagctaaataacattgagaattcatgaaaatataatgtagagcattatgcctgttagcatattagtttaaatagaagtggttcatgaaaatttttgaaatgccagaccctgtcctgtgttttgtattctcccaaatactcatccagatactgttcagaatgtaacatgattattttgaaataaagattttcccctagtttttaaaaaagttactttatacattaacccttatgttcctctttgatcaatttttccagtagtgtaaacagtcttcagggaagtagatttcttacagaaattgtcaagtggctctctgctgttagcatggttactaatcttttggttacttttcatattttttatactttctggaagtggacaacttacttgtaaataaaagtgcataatttgtattaaaaatttttagtaacaatctaatttgtaaaatagatgtgagcagcatgaatgtgtgtgatatgcgtacatacgaattatgtctcttaaaaatgtatcacagacatctttccgtgtccaaacaaatctacctcattctttctaatagccatatgggtataccataatatatttaactaggcccctattaaaagaattttgactcttttgtagctactatagtgttgcagtgtgtatctgtgtatgtatctttgtgtgtgtatctttgtacgagtgtacatatattttccccttggctatttcagatttttttttaggtttaaatcttaggaaaggttttgaaattgtcttaagtattttcagaagcattaaatcatggtttttttacatttttcttttagaagttttatgtcatctctatgagtagctttcagtaatttgttctgcataaaattcccgaaaacttccatttaaaaataggtggcatgactagactttctcagccgaaagagtgaggtcccaggaaggattttggagaagctgtgttcaaatatagctgctgacctgatgtctgcctagagtctggcaaggtgatgtgttgaatctagtgtctgcctgcatgccagcatccctttactgatgagatttgtggttttcatcacttcatggtaatyatcccaagttataagatggagtctctagaaaatcagtagagtatgaaggcccaagtaaaatacatgtgagtgcatgtatgtgtgcatacaaattacttctcttaaaaacgtatcctgggcatttaaagaatgaggacctccgaaggattttgtggaagctgtgttcaagtacagctgctgagcgtatgtcagcctggagcctggcaaggtgaagtgttgaatctagtgtctttttgactcactgttttttttgactcactgtgctttgaagcccttgtcatttgggctcataaaatagatttctgtatactgtctctcctccctgccctcgcccccatttaaaagtatagtggcagaacccaagaatcagagttactaaaaactctctagaaaatttggatgatcacccacctgatcatgtcttttttactcactatgttttttttttttttgagacagagtctcgctctgtcgcccaggctggagtgcagtggcatgatcttggctcactgcaagctccgcctccctggttcacgccattctcctgcctcagcctcccatgtagctgggactacagggcctgccaccgcgcccggctaattttttgtatttttagtagagtcggggtttcactgtgttagccaggatggtcccgatctcctgacctcgtgatccacccgcctcggcctcccaaagtgctgggattacaggcgtgagccaccacacccggccctttactcactatgtttttaagcccttgttttcatttgctccactgtaaaacattccccaagccaatctggagctgaggcaaatttttaacaatttaaaatctggggaatataaatattggataatgatcatcctgaaaaaacaatgaaggtagtagcataatactttatatatcaataaaatggcaaaataagacagttgttgaaggacagaaagagtaactgaagttaggagcttatcttaacacattttttgtgtcataccataggcatcatattttttaaattttttttatttcatacacataggaaaatatatgtgtgtaagaaataataaacacctctttgtacctaccacccaacttaaggaacagctcattgctattccctttggtgctcgctggatgccctttcccagtcacatccccctcccttcccatctgcaggactatactagtaaattttgtattttttgcattattttgctttgttttatgattttactacctatctacatatccctaaataatacattatttagtttcatatgttttaactttatgttgtggaatcacattaaatgtagtcttttttttttatattatactttaagttctagggtacatgtgcacaacgtgcaggtttgttacgtaggtatacatgcgccatgttggtttgctgcacccatcaactcgtcatttacactgggtatttctcctaatgctatccctcccctagccccccaccccccgataaatgtagtctttataacttgtttttttaactcaacattgtttgtaagattcatccatgtaagctgaagcttttttatagagatctttgttaagccttttaatgaatacagtacatacatttctctgttcccctgttagtggacacttggattgtttccagagttttgctgttttgaacaacgctgctgtgaaaatgtctcctgaaacacatttataagagtttttttttccccaagggaattatacctagaaattgaataactagatcacaaggcatacacatctacaacttctgctaggtaatgccaaattgtttccaaggagcgttagaagtgttctcatcaacttttactagtgctagtcttttacatttgtggcagtatggtgggtgtgaaatatttatgtttagtttttcttggtgccatttaataatttttataaaaaatatttagaagtcaaggcagttttttgtttttgtttttattttttgcttgttttgttttaatgcagacattgagattacgacttggaataaacattggttgcaaagttcctaaaaggaaaactttttttggtattctggagcttttctggtactgaataaaataagtatgttaaattatgcatgtgtagtttagaagtcagagcaataattgtgattgttgaacagaatggcagtaaaaagtttctaaacgattgtactgtacaagggacacttgttgtgggtcagttttagcctccccaacttttatgttaaaagttgcaacaaggtttaagggcttatgtttgataggccagatggtgaccagctgtgataaaacacagggaacccttgcaaargatttcaaaatttatgcagtagtccgccttatctgcagttttgctttccaaggtttcagttacccgcagtcaactgtgttctgaaaatattaagtgaaaaattacagaaataaagaatcgaagagttttaaattttatgcttcccacccatcccacctgggatgtgaatcattcctttgttcagcatctccatgctgtaggtgctgcctgccccttagtcacttggtagccatccaggttatcagattgactcttctagtattacaacacttggcttcaagtaatccttattttacttcatagtggccccaaagtgcaggagtggtgatcctggcaattcagatatgtcaaagagaagctgtaaattgcttcccttaagtgaaagatgaaaattctagacttatatataaagaaaagaaatcatatgctgagactgctaagatctatgataagaatgaatcttttatacatgaaattgtgaagaatgaaaaagaaatgcgtgctggttttgctgtcatatctcagactgcaaaagtttgcagccaatgtgtatgataagtgcttagttaaaaggaaaaaggcatttaaggtaagtatatatagtgtttggtactacctgtgatttcaggcatccattgggggtctcctgagtataaggggagactactcttttagtgttaaatgaacactaaggaacagagatggggaagaggttggagaagattagttcagcagtttgagtataggtaaacagttgtttgagaaagaagaaaaatgtgattagtattttaccttagcaatagtggcatagataatgataaattatagtcacacagaactcttagtatttacagaacgttcacatttgtgatcccatttaacaataactctgaaagaaaggtatcatctaccactgctttattgataaagatataaaaggtaagagagatgaaacatattggccaatgatacccatctggtaagagacagggatggggtgggaccccaaggctcttctcgccaagcccacggtttttttgctttatacttttttgcctcctgatcaccatggctgcagtttctactgtggacaatgtctgtcagcaagcattgatcccctgccttcagcactcttacgtcttagcaaggactggaaagaaaaagccaggagtttacagtctgctggagcaacagaaaagaatgatatgaaatatgaagagaccaaaatgatttataataaggtgctagactatgtagtaaaaatctgctttagctgtaagtcaaaagcaagagcagtcttttcagaatggaatagaaatgttggaattaaaggaattttcaaagttgtgaatttttttcaagataaacatgttttattttggtaattatggtattactaatttgataaccttcagggagccacctaatattatagaagatgtacatataatgacaaaagcaaacattttatttttaaggaccacaatctaatctaaaacaaaatttcccccttttctggtctttggttaattaaggacttatttaaatatcaaagaaagacacatagaaaacatttagtatatttctatacttttattaatgtcctccataccttacacagatacttgacttggctatggtctagataatccatgaaaatttaaaggacagattttaacaactttatgctaaattgatagatctctaggatcagattgccatcactctcagatgcgaagcttccaaccacttataggttcctgatatcttgcttttatacagacctaatttctcttcctttaaactttcttttcctcagttgctatttgattgaaatattgagtcattaaaaatttccaagtgggaatttttgtgtttctgcatctatcatgaagctgctcaaataagtaggtgtttgaataggagtagaaacagtaataggctgaagccagaccaatacagcttcagctaaatgccgaccttgctaaagtctgggaggaccggtgtggtattctacaatgtacaagtctgtagccggtgcccttaatatgttggcttcatgtctcatgactctcttctgtaaatatgcagtttaaaaaatacaagttattctgctgtagaagatacatttgcaaaattgatgtatcccctctaagtaaagttggctaaacaataaggacatatttataattaatgaatttgagaagaatgctgacgatatgcattattctttgaagttaacatttttcaggtcctaaataaacaaaaagtaggttacttctgtctggagtgtatgcaaggggtaccatcttgtccttggttcctggctgctattccaaggtgctataaagtcagctaaagagagcaatcataatacattgatagcatccctcaatgtgtttctgagctacttgagaatcttatttttgaataggtagcaggaaaccatctttgcagggcagcatgggcaaagggattggagggactattattataaagatccactgaactgcttcagtatcataatatcttaaactaaaggactggaaagagccagattccaatttaatctgctcttctatgaattcttagctgggttcatttaaaaagaaaaaacttgaagattgcaagattttgaagacatcttaaaataggtgaactccaaggtgcactttaaacttgagactgataactgaatactccttcaccttttgatctgatattgtcaaaatgaatgaggacttagtgctctagtaagtttggaacagaatgatattaatttattttctcatgattgattcttttttgctttttaatagattaaacttcaccgtagaacagtttctcaacctctggactattgacatttttgattggataattctttgctgtcagggctgttctgtgtgttgcaggatagttagcaacatccctgacaatcacaaatgttactttctgtctctatggatttgcctattctggacatttcgtataaatagaatcatatatatgtggcttcttgtacctggcttatttcacttaacatgttttcaaggttcatccatattgtagcatgtaacagcacttcattttctttttatggctgagtaatattctgttatgtggatatactaccatattttgtctatccactccttagctgatggtcttttaggttgtgtccattctttggctattataaataatgctgttaagaacattcatatacaagtttctgtgtagacatatatctttatttctcttgtgtggatacctaggagtagaattactggatcatatgataactctatgtgttaccttttgaggaactgccaaacatttttctacagtggctgtatcattttacactcccatcagcaatgtataagaattccaatttctctgtccttgcctatatttattaactgtcttttcttattagccaactgctgtggttcgaatgtttgtcccctccaaaactcatgttggaacataatccccaatgtggcagtattgagatgtgaggcctttaagaagtgcttgggtcatcagaggtctgccctcatgaataggctaatccattcatgagttaatgtactaatgggttatcactggattgggactagtggctttataagaagaggaagagaactaatctagtaagctcagccttctcactatgtgattgctgccctgtgtcaccttgggactctgcagagagtcctccagcagcaagaagttcttcatcagctgtggccccttgaccttggacttcccagcctccagaaatgtaagaaatccatttcttttttttaataaattacacagtctcacgtattcagttataccaacagaacacagactaagacaccatcctattgggtatgggtatctcattgtgttttttatttgtgtctcccaaatgactaacgatgttgaacatcttttcatctgctttttggacatttgtgtattttctttgaagaaatgtctttaacattctttgcccattttaaaattaggttgtctttttattgttgagttgtcggtktgtgtgtgtgtgtgtgtgtgtgtgtgtgtgtatctagaatatatgtgtatgtatatatgcagatatattctaaacactagacccttatgaaatatataatttgaggacaatttctcccatttaaaaggccatcttttcacttcttgatagtgtcatttgactcacaagtttttaatttttatgaagtccaatttattttttaattctttgtttttggcactgtatctttaaaaagttgcctgatctaaggtcaaactgattttcacctatgttttcatctaagaattatagttttagctcttacatttaggcctttgatccattttgaattaatttgtgtatatggtgtgaagtagggctctaacttattcttttgtgtaatgatacctagttgtcccagcaccatttgttgaaaagattattctttccccattgaatggtcttgataccttgttgaaatcaactgaccataaatatataggcttattcctggactcacaattctatgagtctgtatgtctaatcttatgccagtaccacactgttttgattattacatctttgtacaaagttttgaaattgggaaatgtgagtcttccaactttgttcttttttaagattactttgcctatattccgtgttcgttgcaaactcatatgaattttaaatcaactctccatttctggaagaaaaaaagaggcaattgaagttcagatagggattgcattgaacctgtagatcagtttggggaatattgccatcataacaattagtaggtcttccaacccatgaatacaagacttctttccayttctgtagatatttagtttctttcattaatattttgtagttttcaatataaaagtcttgtacttcgattaaatttattcttgaatattttgggttttgatgcttttatgaatttgttttcttaatttcactttaagattgttcattgctactgattagtaatgcaactgatttttgtgtgttgatttttgtatcctgcaacctagctgaaatcattgattagcataatagagtatttaatagatttaggatttctatatataagatcatgtcatctgcaattagagataattttacttcttccctttcaatctggacattttttacttctttttcttgcctagttgccctagctagaacctccagtgcagtgttgaatagcagtggtgagaatgagcatctttgtgttggtcttcatcttgtggggaaacctttcagtttaagtgtgttgttgtggggttttcatagttgtcctttatcagattgagaatgttcctttctgttcctagtttgttgagtgttttctttttgattgttttaatcaggaaagggcattagattttgtcaaatgctttttctgcagctattgagatttttgtgtgtttttctggtcttttatggtttatcacattaattgattttcatatgtcaaacaaaccctgtgttcttgggtttcatctcacttggttatggtttataatcctttttatatacttgtagattcagtttgccagtattttgttgaggatgcttgcatttatatttataagggatattggtctgttgtagctgaccagtaagtatagtaagctgtatagtttactaagtgttccctctgttttgggggagactttgagaagaaggattgttggtaattgttctttaaacatttggtaaaattcactagtgaagccatctggggtcttctttggaagttttttgattactaacttaatgtctttacttgtttgttataagtccattcagatttttttctccttgagtcatttttgacagttggttgaggaatttgttcatttcatgtagttatctaattggttagtgtataattattcatagtattcctttataatcttatttttttgctgtaaggtcagtcataatgttcactctttcatttcggattctggtaatttaagagtcttctctccttttttttcttggtcagtctagctaaagtaaagttttgtccgttttcaggggaacagctttttttttttttttgaggcagaatttccatcttgtcacccagtctagagtgcagtggtgcaatctcggctcattgcagcctccgcttcccgggttcaagagattctcctgcctcagcttgccaagtagctgggattacaagcgcccaccaccacgcctggctaattttttatatttttagtagagacggggtttcaccatgttgggcaggctggtctcgaactcctgacctcaggtgatctgcctgccttggcctcccaaagtgctgggattacaggtgtgagctaccgtgcccaacccagctttggttatttttgttgacctactctattgtttttctcttctctatttcacttatttctacactggtctttattattttcttccttatgcttgctttggacttagttcttctttttctagtctcttaaggtggataattaagttcctgatttgaattcttacttctttgtaaggtggtcatgtactgctatgaatttccttctcagaaatgtatatgctttcactgcatcccttaagatttggtatgttgtatttttgttttcatttgtctcaaggtatagtcttctgatttccattgtgatttcttccccctctaacccgtttattatttaggaacttgttgatttccacatacctgtgaactttccagatttccttctttgttaattctcagtgtcattccattctggtccgagaacatactttgtatgatttctatcttttaaaatttatttggcttgtcttatgacctaatacattgtctatcctggaggatgtttcatgtacacttgagaagaatgtgtattctgcttttgttgggtagagtgtttgacaggtgtgttggtacatagttctgttcaaatctgtttccttgcagatttctatctagttgttctgtctattggaagtaggatattgaaatctccaactaatattgctgaattgtttattgttttcttcagttctgtcactttttgctttatatattttgaaattctattgttaggtacaagtaagtttatgattattatatcttcttgatagattgattcttttatcattatacagtgccctataagaacaatttttatcttaagtctattkgtctatattagtatagccacttcagctttcttttgtttactgtttgcatggaatattttcttcttttactttctatttgtgttcttgagtctaaggtgaatctctgtagatagcaattggatctgccaatctttgctttttatttggggagtttaaaccattgacatttaatgtaattattgatgaggaagattacttctgatattttgccatttgtttcctttattttgtgtctcttgttcttaaattcttccattactaccttctttcttttgtattacatattttctagtgtaacgattttaatttctttgtcatttcttttgttgtatgtttttagttattttcttagtggttgccacggagattttattgtcattttaacagcctaggttgggcacagtggctcatgcctgtaatcccagcactttgggagactgaggcaggaggatagcttgagtccaggagttcaagaccagcctgggcaacttactgagatactgtctctacaaaaaaatacaaaaattagccaggcatggtggtgtgtgcctgtagtcccagatgcttgagaggctgagttgggaggatagcttgagcccaggaggttgaggctgcagtgaactttgatcacaccactgcactccagcctgggtaccagggcaaaactagcccaaagaaatgaaggaaaaaaaaaatctaatttagattaatatcaactcaacttcaacagtgtataaaaactttgcctctgtatacctcttctgcttccactctgtgctgttattgtcatagattttcatctttctacactgtgtgtttatcaatgtagatttaaaaatattgcttagtagttgtctttagaatccgatacggagaaaaggagatataaacaaaagatgcatttttactgtcttgtatgtttacttatgtaattccctttcctgatgttgtatttctaaaggcaaagtagggttattgtgagtgtccttttgtttcaacctgaaagactccttttagcatgtgttggagatatgctaatgatggactctcacagtttttgttatctgggaatgtgttaatttatccttcatttttgaaggatagtgttggcaggatacagaattcttggttgacatgtaattctttcagcattatgaatatgtcatcgtactgtcttctgacctccatggtttctgataaggaatcaactgttaatcttattgaggatcacttgtttgtaatgacttgcttgtcgtgctgctttcaagattcattctttgcctttagcttttggtagtttgattgtgatgcatttaggtgtgtactttattagtctgttctacttggagtttgttgagctttgtagatgtatttcatcagatgtgtcaagttcttttgccactattttttttttaaataatctttttgcccctttccgctccttctgtcactctgattatttgtgtgttgctttgtttggtggtgtcccagaagtctctgagactctgtccagttttttcctccccattcttttttctttcacttcctcagactggatgatctcaatttgacctatcttcgagttcatggattttctcttctccaagtgacatctgtgagatgaatttttttctagagaatttttcatttcagttattctacttcaaaatttctctttggttcagttttatcattgctatctttatattattctcagtttaatgagatactgttttatactttcctttagttctttagacatagtttatgtcactgaatatatttaaaatagctgattttaagtcttttttttttatttttttggagatggagtctcgctctgtcacccaggctggagtgcagtggcacgatctcagctcactgcaagctccacctcctgggttcacgcaatgattttaagtctttgtctatgaagtctagtatctgggcttcctcaggcatagtttctgttttctttctttcttttcctgtgtacttcgtttctttgtataccttgtaattgttgttgttaactggacattttgaatattatagtgtaacaactctggcagtcagactgtctcccctccccagtatttgttgttggtgagtattgtagatgtttgtttagtgacttttcatggctaattctgtaaattttatattctttgaagattgtgggcaccctgaagtctctgtttgttagtttagtggtcacctaataattaacagagatttcattaaatgcctagaagcaaaataycttccagtctttgcccatggcctctgtgtatgcattagggcaggccttgaactcttacccagggagtttacaaccctgccttagcctttactaccagcttctgcagagcattaaggtcaacaggtggtgagagtttggagcctactccatctttcctgagcrtatacacagccctactcatgcatgtggccctctagatttccaggartatgttggaccctttcaaagcccttacagactccccagcttttcctctcaatctttagactagtgtgttgttttcttcaacagttatctgtcaggcagcagcaaattaagagattagcataaatgttttcaactcctccacccgtcatgtgccccagggaagcactaagccagttctaagttaggcaaaataaagacaatccttttgaggtggtcttccatggagtcaccagacaggtaaaccaaataattaattacaagtctttggctggatacagtggctcacacctgtaatcccggcactttgggaggctgaggcaggtggatcacaaggtcaggagattgagaccatcctggctaacacggtgaaaccctgtctctactaaaaaatacgaaaaaataggtggctgtggtggcgggcgcctgtagtcccagctactcgggaggctgaggcaggagaatggaatgaacccaggaggtggagcttgccgtgagccgagatcacactactgcactccagcctgggtgacagagcaagactccgtctcaacaaaaaaaaaaaaaaacaagtcttcatgaaagaggtccattctgctgtctttcataccaggaatgtggaatgtggactgttattttcatggctactgctaagctaggaatcaagggatagatggggactgggtaaaacaccacagagtttgctgttcttaccaagaataagctggggaagagggttgtttttgtttttcagtaaaaattccctgggctgcttcaagccgttgattaattttcaggttccgaaaaagttcagtttgacagtttttgccctttttatttgcttttatggatatgtagaacttgagttcttttttccaccagttttgctgacattgttttaaaagcactttttgtaaaacccaaatgttgtctctctcaaggctagccaataattaaaaatactgttactcccctttgattttggaaatgaattcgtattgaccaaaattcaatactagaggtctttcaagctgttttaccatttatctaaactttagaatctaatgattcctgtacattgtctagcatactggtggtcctcaattgtcataagttcaactttggaacaaatgaactttttgtgtgcaagtttccaattgtttggaaattacattgatgccccctccatcaaactgttattcgtgggacatctaggaatttcttacagcagctgacaaatatttcaagtcagtgcctggtagtactgtccaccaggcaacagcttcagtagtagagcgatctttatctataaggcagtgtttgagcaattgtttattagtgttttcctaactactcagaagaactatcaggggttatagaggtagctcagagagttgggtgcaagtagagaaatccacccggcttgcattacacatcttatttctagagaagctttcctttgaagaargagttctaaggtttaaaaaattaccttgaatgccacttatattgcattttaattttattttagagaaatcaatggaaagtagaaaaattaaggcactgatactagtgttaagaatgttggttaaagcttctggcaattaattttttatttccttttttaattttattaaaatttaacaattttcagtttatgctgtaatccagaccaaggtttcaatctaatgaagttaatgccagtgttgctgctacctattttgtctttagtcattcagccatgcttcctacttatactgaataagctagcttaatctaacaatcaaaaaagaaagctgttgcctaagttaagaaaaacagtttgaactgttttcaaactaaatacccagtagactctctagttgttgacaggagaatgcttaattcagaattgtcctgcagtagatcattttatctcattcctgttcttctataggatagcttatttgtttgaaattgtatttaatatgttgtgatttttgtgtgcttgtttctatttttcactggatagactcaagataaaacctggtaccctgcagtgtagctatcagtttatagcagaggaaatttacattagaacttggctgtgtatttacatgtatctaacttggaggtcactctgcttactgttgatatatcagtcatattagatgagtccctaatgagataccagaaaccccggaaacatcattaggtggaacagtgtccttaatgctttattaagtgttataggtaagacaaagcctagtactatttgtggcatcaaggttaggtgtttaaagacctgtattcttctattgtcatgttgaaattgttcccttgatgtagcaatagaaaattttagattaggcttaagttaatcagcaaacaaagataaaagtctgatactatcctaaatattttgtgtttctaaataatttaacagtgatccaattagctactcctgtagaaatgtaattgataaacttttcactctcttttaaattgccatcttgaattttacctgttttttaaagctgtctcaagtcctctctaaaaaaaggcagtcatttataaatttagaaaagcttgatagcacagaaagtcacagaaaaatgtaaacatagtttaaaactgaattgtatacaagccactagaagtacttttattaagtttacaaatattagtagagtggaactcatgcatttaatatgtttgaaacttttgatcaaatactgtgctatgaaaaacattttagataattattctttaatcatgtgtgtgtaaaatgtggctttttttgacaaccaagtagcttttctgtgtgccaaactgtgactttaaaattttaaagtactcaacagagtaaacaaaccacaaataccacttaaactgtacacatttgcacatgcatttcctataaatagtacatgggtttcaagtcttcacttttgaaattcagaaatgggttttttctccttccagtagaaataaaaacttgatttattttatttatttatttattttatttttgagacggagtctcgttctgtggcccaggctatggtgcaggagggtgatctcagctcactgcaacctctgcctcctgggttcaagtgattctcctgcctcagcctgccgagtagctgggattacaggtgcctgccaccatgcccagctaatttttgtatttttagtagagatggggtttctccatgttgggcaggctggtctcgaactcctggcctcaggtgatctgtctgtctcagccttccaaagtgctggggattacaggtgtgagccaccgcatccagctaaaaacttgatttttaaaaatccaaatcgaagacagaattgtgtattttagtacatttattagcagccttgacgctataccatatggctgtttatcatttaaacagcttgtaaaagcaaacacttcaggattcatgagtggcagaaggactgagtactttgggaaataagagagaacttttgttgaggatggttgaggaagagtccaagacaataataggcagaataagcaaaaatctagagactcattgtaggcactcaagtatgtatttgttagaatgaatggctgaacttggtatattgaggaacactgagaaagccatactgactggaagatagttcctacaagaaactggtgagacatatgttacagtctagattttggtgagccttgttaaagtttgggctttatttttatacggggagaaagtttcacaggggtttggaaatgaggcttggagctgttaatggggacacagtgaggttttagggtagtggctttcaaactgtttaaatccaaactttgatgataaccctgacataactattgtttataacttccatttcagttgtattggttttatcaaaacatcttcattgatcttactgattgcttcctatgcagattaatattataaatttgaatgtacaaaggaagctttagcagtaaaatagcaacttttatctgtcttacgtattggaggttctgcataagatttaattttttttttttttgaaatggagttttgctcttgttcacggggctggagtgcaatggtgtgatctcggctcaccacaacctctgcctcccgggtttaagtgattctcctggctcagcctcccaagtagctgggattacaggcatgtgccaccatgcccggctaattttgaattttagtagagacggggtttctccatgttggtcaggctggtctcgaactcctgacctcaggtgatccgcctgcctcagcctcccaaagtgctgggattacaggcgtgagccaccgcgcccggccaagatttaattttttaaaagaaaatattttgctaagggtttggaaactcttgttttagcaagaatggattaagactgattaaaactaaaggcaaagaggaggctcttatgtttggaattctttgctaatatttacacaatataattctctccacaaatatttaatggtaccagatattagatggttataatggcaaaagtgttcaaaggatgctatcatattcatgattcatgatcaaaatgaacattataaggctatccctcttcagaattaaatacgttactcctgtggaaaacttgcttttaatgtagaagttgtcccaragcctttcttcctttctcatgtcctcttatgtccactgctgagctaacatgggtctcactgaatgattaagaaaaaacatcttaggtggggagttctgtatatagtaaatgtttaatttattggggtggtgaacgggaagtgctgctggcaagagaggatgggaagagaaatctacccaaatccttacccgctttacagaacataaacttcctattcagtagtacacaataacttaacgatcaaggcatcttaacttttctgttttcagatgaaagaactatcgtttggcttgatcaagtatttagtatttattcgttcactcaagtgcttacgtttttttgttatctcagggttttacgttagttattaaccaaaagaactagttttagttctggaagtctaaaatatataagagaaggtgaggagtaataagagaagatgaagggagactttcggaatggcctatgaacttctagtaactataccaccttaaaatagacaaattacaatgcagttatgaagatatgtatttttcagtgaagacaactaaaatgtttgcacagaattttcttttttattgagtgttagaaattctattttggagatactaccttgcacaacataaaaagaaaaagtgagtgtggaatctaggaatctacgtggctctaggaaattttttaagtgtggaaactgaaggagagcaagagaaagggagcatggcattcccctgtttgtagttcatgaggtgggtttaaattgccttttgccaatgcagctgcacactgaggattacagaattctttttaaatgtttgtagaattatttttcacttattaggtaaaacgtgtattttttgattttctccaatttcagctttctcatgttgctatgctcmattttgtataccatatatagttttgttaaattgacaaagtggtgttttttgttcttctttttcccattggttaaaatttaaagagaaagtggaagctagaaatttatctaaaaaatgtaactttccctgtaattattaaagtatcaatctaaatttgaattttctttgtgcataatcttttttcaagctatttaccatgttgacaaacttgctttcctgtggcaaatacactagcaatacgttataaatatgtaactttcaacctatttacagttgatgcttttttagccctttggatttaaaatacaagcactgaagaggtgaggaagtaccactgctgcctcagcattatttcgaaattctgtttataaactatacaatttccaaggtcatgaatccagcacctttccaggtactaactattgggacaaagatagaatttgattttatttatttacctattgactgaagtctaacttaaatcttgcacctagtaagatcttagaaataacgtgtgtactctgacctgtaaactaatcctagtattctgtgtgtatattctttctcatttgggctcttaaaaggaaaagtaacgtacatctgatgatcattagcactgagctttttcagcaaaaagtatatgtttataaagaagtataggataatttagtaatttaataatgtgacaacatttgcgtgtgttttttttttttgagaaatacaaattgtgagaaacagaaaagtaaaagaagcagcagcagaaatatcactataggatcaaaagattgcaggaaccaaaactccaaaattattgggcataatgtactaaaaacagggcagtggaggaaagggacagtccagactagctctgagggtccaaagaaagtattaaatattgttactggagtgatttgctctgctatttgggcttgggaattaagtgaaattgttgatatactagacagatacttcccacccatttttctcttgataatcagggttcattttttctattttctatttctctggatgctccatttcttaatattaatattaatattaagctctcagtctttatgctaaaaattggttatttaaaacaatttaaatcaacttcagtctaattggcttaagttcaaatccattttaagatcgatattgtgtcctttaaaaattttatttaaaagatatttaaactgatgagaggatactacccattccactgataaactattactgtaagtttgtctattgagggctagttatttggtttaaaaatgctgagattatggaaagtggattggaatattttggagcaatattaaaaacagtatctgtaacaatttaataaacttataaattcctctttctctgttgatctatcttgaaaagacactctatgtctctaggcattccttctctgtggtgtgattggtagacagggagtaaacaacttactgtaaatgggcaccatgccagttggcttcaggcagcatcaagcttgtgactcacagtcagggttaggaaaatgccttttaacttgtttgtctctgcctcttttaaacattaaaggcacaactgtactaattattaagtatttcataaggtcttttagggcttataagatcttttaggaatggcctggaagttattagtactgtttcattgaatctgaatacctttaacatgataatgagaagtttttaaagggtggttttatagttaaacggaatttctcaaattggcttgctccttatgttgatttatttaggatcacatttgggagtttctctgccctactttcaatgtatttaatttactgaccatcactatttggggggaaaatgttatatgatatttagaaaccaagagttttggagtttttcccccattagatgtatttatttatttatttattattttttaaagacagggtcttgctctgtcacccaggctggagcacagtggcatgatcctagctcactgtattcttgaactcctgggctcagactgtcctcccacctcagcccaagtggctaagtatcaagtaagaatcacctggcaaattccaaggctgtataccagatttcctaaattagaattttggggttgggtatctgaattttagtaaagccctccaaatgtttctggtattgcttctaagaacaattgataacataatagctgtggccattataggggtattctgtcatatttagatatargcataccttgttttattgtacttcccaaatattgcgtgtttattttgttttgtttcacttacaaattgaaggtttgtggcaaccctatattaagcgagtctgtcagtgccatttttccaacagcttgtgctcattttgtgtctctgtgtcacattttggtaattctctcaatatatcaaactttttcatcatttttgtatctgttacgaccagtgatcagtgatctttgattttttctttttttttttttttttgagacggacttttgctctgtcacccaggctggagtgcagtggttcaatcttggctcacagcaacctctgcctcccaggttcaagcaatcctcctgcctcagcctccccagtagccgggcctacaggcgtgtgccaccacgcctggctaatttttgtatttttagtagagatggggattccccatgttggccaggctggtctcgaactcctgacctcaggtgatccgctcaccttggcctcccaaagtgctgggattaccgtgccagcctgatgttactattttaattgttttcaggcaccataaacctcacctgtataaggcaccgtacttaattgrtaaatattgcgcatgatctgactgctcttccaactggccattccctgtctgtctccctcttcctgggactctcaaatccctgagagacaataatattaaaattaagctaattaataaccctacagtggcctctaagtgttgaagtgaaagagttgcatgtctctcactttaaataaaaagctagaagtggctaaacttagtgaggaaggcacatcaaaagccaagacaggccaaaagcaaggactcttgtactaaacagctaaattgtgaatgcaaaggaaaagctcttgaaggaaataactagtgctactccagcaaacatgtgaatgatcagaaagtgaaacagccttcttgctgatacgaagaaagttttagtggtctggacagaagatcaaaccattcacaacattcctttaagccaaagcttaactctcttcaattctatgaaggctgtgagaggtgagaaagctgcagaagaaaaattggaagctagcagaggtcggttgatgaggtttagggaaagaagccagcgctgtaacataaaagtgtaaggtgaagcagcaagtgctgatacagaaactgcagcaagttatgtagaagatctagctaagattactaaataatagattttccatgtagatgaaaaagccttttgttggaagaagatgccatctaggactttcatagctagaaaggagtcaatgtctggcttcagaggacaggctgacattcttgttaggggctaatgtagttggtgactttaagttgaagccaggtctcatttaccactccaaaaatccgaagacccttaagacttatgcttaatctactctgcttgtactctagaaatgaaacaacaaagcctggatgacagcacatctgtttatagtatgcttcactgaatattttaaggccactgtaaagacctgttcaactgctcagaaaaaaatgattactttcaaaatattgctgttcattgacagtgcacctgggctcacccaagagctctaatggaattgtacaacaagatggatgttgttctcatgcctgccaacacatcatccatttgtagcccatgaatcagggagtgatttcaagtttcaaatcagtacattttgtaaggctatagctgctatagacagtgattgctctggtggacctgggcaaagtaaatcaaaaaccttctgaaaaggattggccattctagatgctattaagaatttgtgattcgcaggaggaggtcaaaggatcaacattagtagcagtttgaaagaagttgattccaacagttatagatgaatttgaggggttcaacacttcagtttaggaagtcactgcagatgtggtagaaacagcaagagaactagaattagaagtggagcccgaaaatgtgacggaattgctgcaatctcatgagaaaacgtgaatggatgaggagttgcttcttatggacaaatgagcaaataaatttttttcttgagatggaatctactcctggtgaagattctgtgaaccttgttgaaataacaacaaaggatttagartattacataaacttaattggtaaagcagcagcatggtttgagtggattcattccagttttgaaagagtttctactgtgggtaaaatgctatcaaacagcatctcgtgctacaaagaaatcttttatgaaaagaaaagtgaaacttcattgttgtctactttaagaaattgccacagccaccccaccttcagcaaccacctctctgatcagtcagcaggcatcaacactgaagcaagaccctccacaaggaaaaagattacaactcactgaaagttcaaatgattgttagcatttttaagcaatattttaagattaaggtaaatacatttttaaagacacaatgctattgcacacttaatagactacagtatagtataaatataacttttatatgtagtgggaaaccaaaaaattcgtctgacttgctttgttgcaatattcactttattgtggtctagaaccgaacctgaaatatctcagaggtatgcctgtattaatattattttgcaagtaaaaaacccagcatataaaaaaaacgtagaatatgttgagagttcagtaatatggatgaaaatgtttttctctaactgaagaacatgataaattataattagggaaggatataaaccaagaaaatatgtctgagatagccaattcttgcagttcataatatgaaaactcattataccaatctcagtaagaatacttttaatagctgttatttctttgggatatagaatttataaagtacacagtaatcttcttatgatcaatcctaggatcactttacaaccacttaccccatattacaatgtagtaccaagacaagcagaccaaattatagaaggacaaagtttttgctaagcatattttgtcatcagcataccgcattgtgtgtgcatgcatgtgtgtgtttgtgcatgtgtgtgattgtataaaatattagaaagccaccccagaaaagttaaatgactaggaatgttgtgaagggattaagctacccctaaaattatataacaaaactctcttcatctattattaggtcatctttagaacatcttctcttaaatttgttataggtctctctcatctgtttggattaaaattggtctgaaagcctaaaatggctttttacctatataattatttcccaactagcttgtagtataggtgcaaagctatcacacttgctaggttagtgaagtatgtaaaaactaccatctttcaattaggaaccatcggatagcttctacaggattgctggggagaacctttataaagaaagttatatctttataaattttttgtcattttacttagctgagaatataaaataagttagctaataatagagtagaaatgttttctgtaacagattaatattgatcaaatgtgttattaaatgctaaaacaccattttttttctctgtaagccatgtgtttcatgccacaacacaaaagggacaattgtctgtgttttatgacagttctgttctgtcagatgctgtttgttcattttggtgaataaatgaagagagccctggacacatctttttttcctcaacaaaagaggaaaattattcttgtctgtatgtctataatcctgactctttgaatggctttaatttttttaaagtcagcatttttttataaagataggtgtttggaatgtgggcgatatggctggacagttagattgggaccaaataatggaaggctttgaacatcatgctaagaggtttgggttttactctgaaggcagtagagaaccattatgtttttaagccaggattgacttgttctaagctgtaccttagaaatattactctggcagttgtacataggatgagctgtatgttgctttgttttgtttggggagacagttctcgaagagagactacatacgaaggcagttatatgagtcattactaaaggtctggcaagaagtagtaaaagcattaactggagtggtagcagtagggaaggaaataaaaggatagatgtgggagtcatttggaaagtatgaggcaattcattgaccttacagaatcactggttttctgcttccactccattcacattgacctttccaaggttatcagtgacctgcttgtccttaaattcagtgggcactttccagtaacctactgttggcaccagccctgtgctagacamcaggatcctgtttgtaaaggcatctgccagtggtttctgtgacacaattctgtttstagttttcctccttctacttctctagcctcttggcaagttcttctttcagagtttctcagagctttgtgctaggccctcttctcattttctccttctctaagtgatcccatccttttctgttgcttcagttaccatttgtccttatgcaaaggacagccatatctactgtatctccagctcagatgtatctctttgcctcctgacccatatttccaactatctaactgggtatcttttcttggatgagttataggtctctcaaacacaacatgtccagaataattcattgacttattctaaggcctgcttcctctttctcctgtagtccctatctcaggaaatatatggtgctatcaaccccaaagcagaaatctggacataatccctaactacccttttcccctctctgtgcacataatttcagtcattaggcctcatagattggactaaataaatacctcgcaaacccttctacttatattcttaactgctcctaccttaagccaggctaccataattttgtagctggatgactgcatcatcatcttgactggctcccttgtcatcttcaatctatattctatactgcagctagagctttcaaacataaacatgtgatcagattagtcccctctttagaacaccctagggttctcactgtcctgagtacagtctaagggtttaccatggcttacagggtcttttatgatttggtgagctttttattgtataacctttctaaactgcctttacttccctctttcttggctctgtgtctttgcataatgctgttccctatacttcacctcacgtctaaccttcatctccttttcacttctcctcttcctccaaaatccagctgaatatcacattgtcatgcaggcccattcttgatctcccacgtttgggttagatatccctcttcagtaccatcaccgcaccaggtgtgtcccctatcctagcatttgcctcattgtattacaactactgtgtactcgtctctacagctcctgctagtctaaaagttttgggagagcaaaggttcatgtttgtgtttttcactgtggtataccccagtgcctagtatatgataagctctcaaaatatttgttagatgtatgaagaaatgagaaagagaacaggaagagggtaagtttcaagactaggaaacaaggctatgaaagctgcaggaaagcagcaggttaaaacctagaagaagagtttgttttaggaaatactgtgttttaaaccactataactgaagcaaaaacccaaggcctgggtgtggatagagtccactatctgataacagtggatactgatgcatggcagagttggagaggaagagagccagattccaaaacagaaggggtaaagtcttctaagaagatagattatagtaagaaggattaggggatagaaatatgagcctgttccactcatagatctcaaacatgaaatgatgagtcatcatgaagagagtaggcaattgtccagtgaagaaggggatgctaacccttcttaaccttgaatctctcaggtagaagcagttagagaaggaacagccatcatcagatagtgttgtaaggaaaatgatatccttggggaaacctgcattttggtaaagcaaagcaactaagaaagaatatactaccactgtttaacaatcgccacaaaaagacagtaggatcatctttgacccccctcatcctttctcaggaacttggaggactaagaagagagaaatctgtagaagaggcttctctctctgatcctccctccacttcagttttaccacatgtaatgcaacaataattaagaatttgtgtaaaatttcaccaggttggcatgcatggagagaaaaattattcagatgttttcctttgtcaataatacaaggagcatttgtagggaaaaatatttacaaatacagtaagacctattctctttctatayttatgggaaaattttaagttgtgcccttgtttcatgtgtgtttctatttaaagataccatacttaatatataytgttgattcattaacaytgaactcatggctaacagcactataaatcatgtctgatcaaaacttatgatacatgtactttcttcgtaaggtacatcatagtcttctcgtacatgggaactctaggtagtacttcaggactatgcatagaggccattttaaacagcaaaattcccaacaaaaagcacaaaactcaaaaaatgtgccactaaatttaccatgaaaaggacacttgtttacagtttgagagctaaaacaagaaggtggcgtgtcacttcgtttgacttcagctgggaacatgcatatcagtcgactcaaattttttgctattctgtgcttatccacgaatcgataggaaagcaagtgtggatttgggggttacaaataaaatgtagcaaatgtgtaaacttgcagatgtggaatctacaagtagttagaatcaactatgttagtctgatcattaaatcagttttttaaagtactattgtaacaccttataacctgccccattcactgagtgttgtagtttatagtttcattgggcattttcagtagttttatctgaagtcacatttcaaattttgtaattgaagctccaaagtatgctaccggaaacacragctgatgctgtgagacaaaatcaacaggtaatccaccatcacaactgtgggctagaatgctcaagaaaccttggaggcccagagagctgagatgaatactgaagaatcataggcaggtttactctgtcaagctgcctgtattttgagggtgtagtcctcaaaccaaaaagacaccaaatgaacaaactcagatggcctcactggggaacagagattgaaagctgacactggaatgtgtacttaaaaaaatgagagcccgttttggaaaggcagactgggcacagaatgtggagagctatatttgctaactgaagaaatttagactttatcctctacaaaacaaagctattggtttttgaaggttgcataaaagctgcattttagcagcatatattttggtagagctgttacctgcctgaaaacatcaatgtcatttcacacaaatgatacttatcccttggtgtttgatctaaatttctacaatgagaatgtgattttatagtctttactggggaaggaagtaggtttttcaggcygaaattcttgtgtagcaaaaattaacacttaagttagcccttggcaatctccagttctataatggtaaaatggatttcccagaaagtcactctctatccctttgaatagacattagaaataacatgtactttaagtgggatttacagaggaagggggcctttaattctttactagtgtgatgccctgtaaaaaaataactaacattagagttgaggcctagaaatagcagcactgggttaaagtctgttttcaagtgcaagtttttctttttattcgtgtgtgtgtgtgtctgtgtgtgtttcacatagaaggaggaaatgccaatttcagttcttacaaatattaatgactgcaacttataaaaatgttacagactatattcttcccttttgtaacagatgagaagattttgaaatttagtctctactttttagtttggtaagacaatttgaataaactgcaataattgcaaaagaattctgaatatttgaacatttgacattttctatgtcaaatatacatttcttgtactatataaacattctagaaaagagagacaggcagggaggaaagtgctcattaaaaagagcttcaccctctctgaaaagggatttcctttacagtgctgtgtactaaagcctgtgttgtaaatcagaaagcactgagcacacatgttgctgctttggtagcatcagaagtcgattttcattagccttataccattcactatttctgccaagcaatcttaaattataaaagaatcttatttgattttgtgattctcttgttttctgctcataaagaaaatatcctaaattgaacaatggcatgctacgtttttagtttttaagacagctaatgtgtaaaaagacatttaaagtatagttgtgttaagtttttgaagtttacagttgtttcaattttgctgctatactttgttaacatattttaggaatatttcattttagtcacaactaggatataaacattattttggtggcgatctccttgtaatcacgacrtcaaccaaatttgggaaattttgatttgttagatttataaattttacagtaacacaaaagtctaatttcctatatattttcaaggcccctatacctttgtcaaaataaagtatcaatgaaaaatgaaaaaatcataaactatgttcaggccaaactgatactgactttgttaaaaggctagatagaaatctgttttcctcttctgttacatctcctcttctggagaccactctgtgtggactgaaggtttgagatcctaggacctaggctagaacagattaggagattgtgctgtatgttaagtggcagataccatggaattctaagcctgttacgaaggaggagaagaagaggcacaatgaccctgacacagcccctgggttgaccacagcagatatctcacttgagcaagtagatatcatctcaattgcttgctgattatctctaacttgtcagtaacttactttgataacctagatttaggagtctgacagcatgcagtgtatgcctcataataatctgctgtttatgaaagtcataacattgtatgtttagcataatggtgaagagcctgccatctggaatggtctacttatttgggatccacatacagtaagctctcacttaacatcatcagtaggttcttggaaactgtgaccttaagcaaaacaacctctaatgaaaccaattttaccacaggctaattgatataaacaagagttaagttcctgtggcatatttctggtcacaaaaacatcactaaacttctaaataaagacccaaaacacttataatattaaccactgaaataaatgtgagctatatatatacatttaagaataataaaaacaaaaaataattatttacccaatttttggtgaaccagtgagtgatagtgatcatagtgatggtggatgaaatcaaggaataaatatttgcaaagtgaaaattgtaagaagcaccccctgtcaccacatagctcagaaataataattagggcaggcttgctgagcatttttaaactgcactgtttattgtcatgcatttgaatgattatcgcagactttatgaattttcattttatawtaatttgtaggccaggcacagtggctcacgtctgtaatcccggcactttgggaggccaaggcaggcgggtcactggaggtcaggagttcaacaccagcctgaccaacatggggaatccccatctctactaaaaatacaaaaattagccaggtgtggtggtacacacctgtaatcccagctatttgggaggctgaggcaggagaattgcttgaacctgggaggtggaggttgcagtaagccgagattgtgcccctgcactccggcctggtgacagagctagactctgtctcaaaaaacaataataataatttgtattcattcattttccaatgtgttcattccagttcagggtccagggggcctgcagcttatactcatagctcagagcaactgaccctatagacaggacgccaccccattgtagggtgcactcaaatgcacactcacactcaaactgggacccttcagacatgccagttaccgtatcacacacagcttcgggatgtgggaggaaagcgaagtatctggagaaaaactacacagacatgggaagaacgagccaactctacacagacagtggccctggacagagctgggcaggcatcagttttttttcttttttttgtggggggtgagggtggggcatggagtctyactctgtcacccaggctggattgcagtgcagtggtgtgatctcagctcactacaacctccacctcccgggttcaagagtttctcctgcctcagcctcccaagtagctgggattacaggcgcccgccaccacacctggctaatttttgtatttttagtagagacaaggtttcaccatgttggccaagctggtctggaactcctgacctcaggtgatccacccgccttggcctcccaaagtgatgggattacaggcgtgagctaccgcgcccagtcagcatcattttttttttctcatcaacgttaaaacaatgttgaacaaaacattattcaaagacctgccgtatggctattttctagttgtgtgactttctttgggaaagttagcaaccctttctgagcttaaatgtcctcattcataaaatggggctagtaataatgcataaggtttttgtaagaattagaattaataaagtacttagaccataataactmattagtattagttgttgtctttgctattattttgatgtggtggttgtttggtttcacctgtgtactatcaggacatgctgaaataaaatttaagaattggctttataatattagaaaagcaaacttttgtacgatatgggtatgaaaaattgttgggagtctactttttctctcttacctaatttgtcttagtctttttaaagcttagattttccaaatgagccatagcaaaatataatgtttaaaaatgtttaaattctaagcactatgtcatagttaaataacttaaaggtgctacatcttatacagtccaaaaggaacataattagtaaaattctacaatttagaaaaaaaaatagctgacagtgactgatttataaaagtaaaatatcttttgttaatactaatattctttttataaattaattgatgacaaaaaattgagtgaatgagatttgcagttcatttatctatgatgctggtttatttaatctctataatttgctgtatttgaaagagcatagtgatagaggtcatgataaaatctaggcccagtgccacaastaaatccctgtaggaactctcaaggttttgatttcatctctgaatgggaataacaccttccaagaatattatgaagattaaaaagttacgtatcataaatacacacagagtaacaatactgggaatattgcaacttgtaagaaagaggaagcatatggcatattctgatggttagggatatggactctgtagctgggatgcctgaaagagaactctgactccactaatggctagttatatgaaattgtgcagataatttaacttctctgagtttgcatttttctttgtctatataatggggataataatagtacctacctcacacatagtgttaatttctattagtggttctcattaagatagtattgttgttcatccctggttgttagccatcatgtatctgagttagagagtcattgattttagaaagtcccgaggagactatcaggtcaagcaacctgcctcctgctagacaattagctttatccatgagttaccaaagagggagccgaaacccagggaagctgaaagagctgttgattgtcaccctgtgagttggtgatagaaagatatctggaatcccagtagttgcccatttcctagttctgggctctgcattgcactagaatactgtgccattctaaatatgaaaaggcagtatgaccattgtgcttgtcactttccattccctagatgctatcttatatttgtccttatgaaatttaacctgtgactttcagatcacttagaaccttggttggacagtgttttctagtgttatttagtatatttttttgtcatcttctgttgtctttgggttcccctaaaagagctatactctgggtgccaggaaacttcacacatgactgtcttctcttcctcgacttccctctctacttacctttccagctcgtagcaaatcagaagacttctctgacacctctctatgtctaaaggtcctttgatattctcacatggcggcatgaatcacagtgtattttaactggccttttccttgtrtgtctcctacaatgagctgttgaagcttcatgaaaacacaatctgttttactcagggcagttataattccaattacaaagcacatttcctggctcctggctaggaactcgatcatttttcgatgcttccttgctcaggactttctgattccttcttaaaacattttggggcatctccttctcctggtttttggaaacatattctcatactgctatgaaggtttttactgacatttccaacttctcttaaattgattcagcaaatgtttttccataataaatgtcattgatatgtcatcaatatggagagcaacaacagaatgcattgagtaaactcctcccctggaggtctgagaatctagattccagttctcacagagccaccaccttggtgaccttggacagtagaccttctaagcctcagtttccttatcccttaagtggggatattaatagaacccattctcagagatgttgccaagattaaaataaccaagataattcctgtagatgatttggcatagtgcctgccacgtactaagcaagagttagcctccgtcattatagtatgatcataaaaaatgaacagactaaacgaagtaaccagaaggaaagaaattttaattcttaaaatgtaatagtttcttggtttttttttttctgtgaaacacctgcatggcacctttttgttattcatmctgttttgactgtggctgtcgtagattcttgttgaaagtctgagagactgagacttgtcattttgaacatggcatcagtggaacagcttatgattcaataattgcatcatcctggacaagcaccagtagaagtgagtcaggacatgtgataaaaagacattcattttgcccctcctccctctctgtattttctttgctataaaattattgatgttaagcccatagtactaatatttcagttcaattcataataaaatttgagggcatttgaatatattatctgttgtaaattataattttatatttgaccacagagtatttgaagtgggtcttttctttccccaaaattctattttaataactaaaaaatattcttaggagaagtattatttaagaacaggtttatattaaataacatcatttcactttcaactttctggtggtcaaaaaatatgctaatactaattaggatatgatacacatgttctgttagaacagttttggcagttagaagacttctcttcttgtgtttgaaagggatgttacttggggtagttatgagccatgtatccagatgtcctgaaaggaccagtggtagatgtatttctatttttgtcttttcttttttctttctggcattctagttgctgagtgactgacttttgttttcagctcttctcacaatcaccattgttctaataactttgcttaaatagaatgtctccttttgctataagccatggggccatttaccgttaattttttaaagtactgaaatgagaacctcataaattaaagaacactcctgattctgagttagcagatcctactaagccttttgcagatggaaatttcctttaaattggtttgttttcctttaacattccattatcctattgttcattctttggagctgtgatttgtttaatatatttcaggcttcttaataaatcaagtcatgtaagttattatttggatcatttcgaaactacaacagcttatcaaacctctgaaagaagaattttgtgtttgcccacagactgaagaactgattcagttttattggctgagctaccttcattattcatatttaattcctggtactgagggtgggaggagggagaggagcagaaaagatacaactattgggtactgggcctaatatctgggtgatgaaataatatgtacaacaagcccccgtgacatgtgtttacctatttaacgaaccctcacatgtatccccaagcctaaaagtttaaaaatatatatttggtaaatcaattgatgtgttttaaaaaatatcgccttttggccgggtgtggtggcccatgtctgtaaccccagcactttgggaggccaagccgggcggatcacgaggtcaggagttcaagaccagcctggccaacatggtgaaaccctgtctctactaaaaatacaaaaaatagctgggcgtggtggcgcgcacctgtaatcccagctactcgggaggctgaggcaggggaatctcttcaacccaggaggcggaggttgcagtgagccaagattgtgccattggactccagcctgggcgacagagcgagactctgtctcaaaaaaaaaaaaaaaaaaaaaaaatcatctttaaagagataactaacccttccccagaaggcagggccaaagtctaaggttcttccaggtcctttgtattccctataaattttagagtcagcctgtcaatttctatacacacacaaaaaaagcctgctgggattatgattggtattgcattgaaattaaatcaatttgggtataagagacttcaatttggggattgagtctatattgagtcttccaatccaggaacactgtatatctctccatttagtcagatatttagtttatttcaacaatattttcagatctttagttcctttcagcaatattttctcatttttcctgtaaagctcttgcacatcttttgtcccatatctattgtgtatatgtgttttgctagttattaaattatattaatataaattttattttccaattgtttgtcgcatatatagaatgttttaaaaatattgtgtcctgtgaccatgctaaattaactaattctagtcattatgtcttcattatctttctcttgaattttcattgtcttccccttctgggactccattcatatgtaaggccatttgatactgtctctcaggtccatgaagttctgttaatttttcttcattcttctttttctctgtgttcttcaactgaatgaatgccattaataatttggtatgtaatggctcacttaaacttccttttgtttttaagatatttctactctcagctgtgtctggaatcctttagtccggagccccaccaaccctcagcctagaaggaaggaggagaaggatagggtgaaaggaaggggagagcttctagcttcaggacagagatcagaacaaacaacagagcagtcatcttggataaggaaacttccctcaaacctattacttatatcctcagaaataagaaaaataatgcatttatcaaattaaaggattttgaaaaagggaacattcagagaataaaactaaactcttgaaagttaaaaggatgataacataaatgaaaagctcagttgaaggattgaaagataaaagtaagaaaatatcccagaaataagagcaaaaagacagcaatgtaaaataggggagaagataagagaattagagaaccagcttaggagttctagaaagagaaaatgtagacaacaaaaggtaagaaatcatcaaagactggagtaggggaggtcatgctatctgtttctttttctattttttattttgagttacatttttttttactgtgaaacaagcatatgtacatgagaatgaacaaaacaaatatgcagtcatgtattgcttaacaacagagataggttctgagaaatgcatcattaggcgatgtcatcattgtgcagacatcatagagtgaacttacacaaatctgaatggtatgtcctacagtacacctggaccatatggtatagctgttgcttccaggccacaaacttacagcatgttactgtactgaacactgcaggcacctctaatacatcggtaagtatttatgtatctaaacatagaaaaggtmcaataaaaatmcaatataaaagaggaaaaaaatagtacacctgtataggtgcttactgtgaatagggcttccaggattggaagttgctgtgagtcattgagtagtgagtgaatgtgaaggcctaggacatttattatatgaagtctactgtagtgtaaactctgtagacttaggctacactaaatttatagaaaaattttcttcaataataaattaaccttagcstactgtaacttttttactttgtaaacttttaatttttttaacattttgactcctttttagtaacacttagcttaaaacacacacattgtacagctgtaaagaaaattttatgtccttcttctgtaagcttttttccatttttaagatgtttttatttttaaaactgttactaaaaactaatacacaaacacacacattaacctaggcctatacaaagtcagtgtcatcagtgttcaaccttcacatgttatcccactggaaggccttcaggggcaataacaaacacagagctgtcgttttctgtgataacagtgcctttttctgatatacctactgaaagacctggctgagagtgtttgacagttaacaaaaaaaaaaaaggacaagaagtacactctaaaataatgaaaaaagtataatacagtaaatacataaaccaccaacatagtcatttattatcattatcgagtattatgtactgtacacagttgtatttgctgtacttttctataactggtagcacggtaggtttgtttataccagcatcaccacaaacataagcwkkgtgttgtattacaatgcacagctgcagctaagtgataggactttttcagctccattataattttatgggaccatcactataaatgctgtccatcattgactgaaatttatgtcgtgcatgaccatacatacaatttaatgaaaaataataataataaagctagcagtgtgtaattaccaaccagggcaagaaatagaatattgccaataccttggaggcctccagtatgaccatataagtttacaaatcctattttgttcctcctccccagaggtaaccactgccctgacaaatgtgatcgttgttttcttgtttttcttactacctatataaacatccttaaacaatataactcagtttgtatattttgaattccatgttaatagaatatcatatgtatatgaattttatgtgaatagaatattatatatgtcattttgcatcttgcttttttcattcaacattgtaggattcattcatgttgtagtgtacagctgtcgtttattcattgctgtatagaattatatcctcagagataagatatatggatgtttataaatcattccactattatgaacatttgactagtttgtagtttttatttaaccaaaaaaatgctgctgccaacattcttacacattttactgtatatgcacattaatttatttacaagtataaatttctttttgaatacatatctattgatggagttgctacatcataggacattcttgtctttgactttactggataataccaaactgtcttccaaaatgattacatccttaaactcaggacacatcttattgtcaaatgtttaatttttgtcagtctgatgggtatgtaagttattttattgtcgttttaatttgcatttccctgattactaattaagctgagtaacttttcatatgtttattggccatttggagttcctgtattgtaaagtataagtttttttgtccatttttctagttttctgtccttttagttgaaatccaaatttgcctaaatctgttattctctgagcacaagtaacttgggatgctttcctttagatttagcctaattctttatcattttgtcagcttgatggtgcttttaaggagatatatatgtgtgtgtgcgcacacatgtgcgtgtgtgtatatatatatatgtatatgtatgtatgtattttttgagacagggtctcactctgtcacccaggctggagtgcagcggcacagtcttggctcactgcagcctccacctcctgggttcaagcttttccctgtctcagcaacccgagtagctaggattacaggtatgccaccatacccgctaatttttgtatttaatagaaacagggtttcgccatgttgacargctggacttgaactcctcacttgaactcctcacgtcaagtgatctgcctgctttagcctcccaaagtgctgggattacaggcatgagctaccgcgcctggcctggatattttttaaaaatattttttatctagcactttggtttttggcaggcaggttggcactcatagtctgacctaccatttctataaaaagaaacctgtaaatgttcttaaacagactttgaaccagtcttcctgattttgaacccctacctttacccccagtttttgagcctttcagaattttttttcataataattaggttgcttcttagctttccccactggtgacttaacagatcttaggaagccaacaatccttgtccatctgctttctgtcttgtgaactgttgctggtattgtctcttctctttattcttagaggtgtatgcttttaaaaacatatactgggtttgagagggagctgaaataaaagcatgtgttaaatataccatctttaaccagaactacatttgactggtcattttattttcaagctcacatacacttcaaacagagrtatggctaaaggaattatcatgtgaacaacagccagggctctgaacatcacagattatatcatcatacttgaaatatttgaaattttgattcaaaatgagagctttatagctatgtcctcaatggactaagtgtttaagtacttaacatccaaaacattcttactaatcaagagaagacaaacaccccaacagagaaataggcaaattttatcaatagccagttcaccagatttgttttctgttagaagcgaatatggggaaatacatgtgtccatgttttgcctacttttcctggagcaggtaaggagaggcagtttaaggatccatgtgataaaccctaaagttgtccatcggctttccagtcccttctaggaatttaacttagggaaataatcagacatttgcaaaggtgtgtacagtggtatttataatagtgaaaaaccaaagaatgaccaataacgggagaatggaagttacagccaaatactttacaactactaaagaatcatgtaaaatatctattgacataggagttttatcaaaatgtgaagtatacagatgaatagtaccacacataaaaagcaaggtgcaaattagccatttatattgttatccccaaaataaatagatgcagtttttttaaaagatgcaggctatatatggaagtgtttgctggttttctgtcaaaagaatggcgactttattttctaatttaaactttttgctgttttctaaattgtctaaatagttatagtttttataatgtaaaagtatcttccaatttagcttcatttgacaaattaccttttcattctatctagctatgtaattctaaatgaatttacagcagtaatcttagagcagatgaatttacaacaataatcttagagtagactacggattagatgtaaaaacatgagttgggctttatggttacagagagttttcctcagtgtggggatcatagctgtattgagtttattcagttttcctttcccacatgaatgaaaaatggggccagcctacaactggaagggcctcggcatgtaccactgtactgtgtatgatgtgatttcttgatgctagtagggagagaatcaaattgcctcctattcaaaccaagacccacaaatagcgtcaaccagtcatttcagctactccctgcagtgtcaagaaggtgtgaacccctcatgttctctattgcatacccttgtctaattcagtgtttcttcttcttttcaggttttggctttatgctacatttcagaaatcataataaccttttctggtattattttattctttttcgcactgtgagaaaaattaaactttcaagtggatgcttcttataaactatttatacccttttgctcccttttgggaggcagggacagggacagagttcctcctcaggctaactaagaaaacttactgcttccaatgtaatttaaaagatctccctctttctattgctctctgtactcttaattcttttttttttttttcacagcagagacaagtgaacatttatttttatgcctttcttcctatgtgtatttcaagtctttatcaaaacaaggccccaggactctccagattcaattatgtccttgggcttggtcgactgctgtaggagtctcagggagccttctacaaatgctagagtgactcatttaccaacattaaaccctaggatacatgcaacaaagcaggactccttcctccatggaatgtgccgatttcagatgacacagcacccaatgtagaaaacgctggaatttttccttggaactagactgtgatgagaggtgcttgacatgaacataagctactgtcttttctttttttttgagacagagtttcgcttgttgcccaggctggagtgcaatggcgtgatctcagctcactgcaacttccacctcccaggttcaagcgattctcctgcctcagcctcctgagtagctgggattacaggcacgtgccaccatgcccggctaatttttgtatttttagtagagatggcatttctccatgttggtcaggctggtctcgaactcccaacctcaggtgatctgcctgcctcagcctcccaaagtgttgggattacaggcatgagccaccacgaccggccagctactgtcttttctttgacccttcctttccagtttttgaagataaagcaggaaataatcttctctgaagatacttgataaaaattcccaaaacaacaaaacgcatgcttccacttcactgataaaaaatttaccgcagtttgtcacctaagagtatgacaacagcaataaaaagtaatttcaaaaagttaagatttcttcagcaaaatagatgattcacatcttcaagtcctttttgaaatcagttattaatattattctttccccatttccatctgaatgactgcagcaatagttttttgtttgtttgtttgtttgtttgtttgttttttgagatggagtctcgctctgtcgcccagctggagtgcactggcgcaatcttggctcactgcagtctctgcctcctgggttcaagcgattttcctgccttagcctctcgagtagctgggactacaggcacgtgccaccacacccagctcatttttgtatttttagtagagacagggtttcaccatgttggccaggatggtctcaatctcctgacctcatggtctgcccgccttggcctcccaaagtgctgggattacaggcgtgagccaccgcgcccggccagcaatacagtttttagttactcgacatctttaagcctataactcttaggctatgcatagccccatgtcctaatcaggcattcactgatcccagcaggtctccatctatttgtaccagcctcctctttcctcccaatctcaaggttactcttaaatactagtaaatgcaaaaagaacttgtaaagtggcaaggcatggcctatcaaaagtcagcccaagggcagttttcagccctgcctcacctgggtctagttcagctgacggatgagctgattgatgcgttcaccccgatagccaggtgtgcccatctccttgaggaagcccactctatttttggtagcatgatgggccactgagaggtggaaagggcgcaagaaccatgagatctcctggaaatgcttccctgggaaggcaatttcatgaatgaggtcttccaagcaaatgaagccaaacttccccaggtgctcctcaatcactgtgttgtctgtcagagggatggtcttattcttgaccttggcttgtccacgtttcaaaatgagttctcggacagacttcagatttggaaatccccaggtcacataaggttccactatatgcagcatttttagattctagggggtaacttttacaaagataccactaaaaattttctttaggcgaagtcttgcagtggttctctgcacccgtaaactcacgccatcaatcctttcgatgcgtacaacaaaggccaaggaatgtttatctggcaattccaaggcatgaggtttcacttctagtcgtctgagacgcaccttgtcacgtttctgccgccaggaatcatgtaggaatgattccagtcgcttaaacctgagcccttttcctttcttctgtcttgctactgccatctttctagtggtgcagctactcaattctttttttaattataatttttattttaagttccagggtacatgtgcaggatktgcaggttacataggtaaacatgtggycatggtggtttgctgtacctatcaactcatcaggtattaagcccggcatgcgttagctatttttcctaatgctgtcccgcccccccacccaacgggccccagttacactcttaatccttatagctcagatgttatgatccacagtgtggttcttacagaaagttatggattaaaaaaaaaaaaaaacactcaaagtgcccgaactttcttaaaataatcctggtacagctaaactcatgcactgactgtccacctaatatttaacagtctgtgttgtgatatattgttttaatgttctgaatgcttgtcagctttcagtattgaagatgtgaatcatttatcagcaatgacacatttagtctaaggttgtcagctatttatgctacaaattaatgacttgtccttaaaatatcaattttgtgattcatgttttggcaggtggttagatgttttgtgttctaattttaaactatggataaaggttttgtcataatcattgttttattggttccttttctcccctgcccactccccaaaaaaccctgcaattcttttttgttaaacttttattttaggttcagaggtacatgtgcaggtttgttatataggcaaattttgtgccacaggggtttgctgtacagattatttcatcacccaggaaataaacacagtacttgatggataggtttttagtcttcattctcttcccaccctcaagtaggccccagtgtctgtccttcccttctttgtgtccctgtgtactcaatgtttagttcctagttataactgagaagaacatgtggtatttggttttctattcctgtgttagtttgcttaggataatggctgccagctccatccatgttgccgcaaaggacatgatttcattctttttatcgctgtgtagaattccatggtgtatatgtaccacattttctttatgcagtcttctgttgatgggcttttaggttgattctatgtctttgctattgtgagtagtactgcagtgaacatacacatgcatgcgtctttatggtagaatcatttatattcctctgggtatatacccagtgatgggattgctgggtcgaatggtagttctgttttaagttctttgagaaatcatcaaactgctttccacaatggctggattaatttacacttccaccaggagtgtataagcatttccctttctctgcaacctcaccaggatctattattttctgactttttaataatagctgttctgactggtgtgagatggtatcccagcaccatttattgaatagggagtcctttccccattacttgtttttgttgactttgttgaagattggatggttttaagtgtgtggtcttatttctgggctctattctgttgcattggtctatgtgtctgttttgtaccaataccatgctgttttggttactttagccttgtagtagtttgaagtcgggtaatacggtgcctccagctttgttcttttggcttaggattgctttggctatttgtgcccttttttgattctatatgaattttaaaatagtttttttctaattctgtgatgaatgtcattggtattttgagagcaatagcactgaacccgctaattgctttgggcagtatggcgattttaacaatatcgattctttctatcccctgcaattctttgttgttgtatttaactatttttacttgtgaagttttttcagggatgattttgttgaaagtgacaactctaaaaattatgttggtaattaaaattttaagtaatgacttttattttcagagattccacttctcttagactttggagctgttaacagcagtgtccaatctgcagtggtactcagcagtttctgtttcctgcatgcagaactgcttatatgaaaacacagttttaaaaatgctttcttatggctgacattcacattcttattccttttgattcttttcaagagggatttggtttgttaaaattaatttttgcaatacttttatgaagatacaaactctgacaaagcttttaaaacaagtttgagagaatacagtattgatttcacttgtaaatctgacrattattttagaaaaaaggaaaatattatttactattattttgcttataaatgtttatcaattttaaagcttccacattgcacatctcccactacaacagtagctaccatttattctttctcaaaaaaagtgctaagtgtgcccttgaaatttttacattgtgcagaatatccctaaaattttaaaacaaaaattacatcatcacttgctttaaatgtttcttctttatttaacatacagtttctaaaatgttagcaaatagcattttagaagagacacgttacttttctaatgaatgttctaaaatgaaccacagtaacctatacttacttagactgtgaaaaacaaaacttatattctattgttaaattttcaaaagtgaaactacacgatagtttacttggcacatcactctgttattgtgaattgacaaatgtatatgtagacaaatatgtgaaaatcagagtacatatacattatatgcagcaccacaatacattttttagtatgttttgactgatatttaattatataatttaccaagaggatctcaccagaatgtagaaaagtattgaattttagaacaattcacatatttaaaaaaaatgtagtcagcccttttatctgtatctggagaatgcagggtaaaggaataatacatgagtattggtatttaaaaaaaggtgttaatttcttacctatgatacctgttactttgggtatcatttaacctttatttctgtgaaatagaggagttctaacatcctctaattattataatattgttctaatttaatctatcttaatctgtgatacagtttgaaaaccaagcttttactattggcatgtgcaaaaaaataaagcagcagtagacttggaatcttgaatgcaaatttagattttgcctcttaataaatgtataatatagtgttctgggaccaattctctaacatttctgagtcctagtttctgcatctgtcaaatgggattagagatacctactttcaggatgtgatatggtttggctctgtgtccccacccaaatcttatcttgaattgtaatccccatatattgagggagggacctggtgtgaggtgtttggatcatggaagtgatttcctccatgctgttctygtgatagtgtgggagatcgcaaaacatctgatggtttaaatatggcagtttcccctgtgctttctctctctcctgccaccatgtaagactttccttgcttcctctttgccttctgccrtgattgtatgtttcttgaggcctccccagctatgcagaactatgagtaaattaaacctcccttataaattacccagtctcagatattctttatagtagtgtaaaaactgactaatacagagaattggtactggcagggttgggtactgctataaagataatctgaaaatgcggaagtgactttggaactgggtaacaggcagtggttagaacagtttggagggctcagaagaaaactggaagatataggaargtttggaacgtcstagagacttgttttgaatacttttgaccaaaatgctgatagtgacgtggacaatgaagtccaggctgaaatggtcccagagatgaggarcttattgggaactggagcaaaggttatttttgctatgctttagcaaaaagactggcagcattttacccctgccctagagaactgatgaactttgagatgatttagggtatttggcagaagaaaatttctaagcagcaaagcatcctagtggtgacttggctgattctgaaagcgttcagtcatgtgcattcacgaagatatggtctgaaattggaacttaggtttagaagtgaagcagaacataaaggtttggaaaatttgcagcctgaccatgtagtagaaaagaaaaccccattttctggggaggaattcaagccagctgcagaaatctgaataagtaacaaggagtaataagtaataataagtaaaaagtaataagtaataagtaacaaggagccaaatgttaataaccaagacaatggagaaaatgtctccagggcatggcagagatcttcggggcagcccctcccatcacaggcctgagaactaggagggaaaaatggtttcctgctcagggccttgctgctctgtacagcctcacgacatggtgccctgcatccctgatgctccagctccagctgtggctgtaaggggccaagttacagctcgcaccattgcttcagagggtgcaagccccaagctttggcagctttcacgtggtgttgggcctgcaggtgcgcagaagacaagagttgaggtttgggaacctgtgcctatatttaagaggatgtatagaaacgcctggatgtccaggcagaagtctgccatggaggcagagccttcatggagaacctctgctagggcaatgcggaagggaaatatggggttggatccctcatacagagtccccactggggcactacctagtggagctgtgagaagagggcctctgtcctccaggccccagaaaggtagattcaccgacagtttgcagtatacgtctggaaaagccacagaatgccagcctgtgaaagccacaggggtaccctgctgagccacaggggcggagctgcccaagggtatgaaagcccaccccttacttcagtgtgccctgaatgtgagacatggagtcaaaggagattttggagcttttagatttaagggctgcccagctgggtttcagatttcatggggcctgtggcccttggtttgaccagtttctcccatttggaacaggaacatttacccaatgcctgttccctcattgtatcttggaagtaactaacttgcttttgattttataggctcatacgtggaagggacttgccatgtctcagatgagactttggtcttggacttttgagttaatgctgtaataagactttgggggactgttgtgaaggcataattggttttaaaatgtaaaaagacatgggatttgagagggagcaagtgcaaaataatatggtttggctctgtgtccccacccaaatctaatcttgaattgtaacccgcatgttttgggggagggacctggtgggaggcagttggatcatgggggggttttttccatgctgttcttgtgatagggagttctcaggagagttgatggtttaaatgtggcagtttcccttgtgctctttctctctcctgctgccaggtgagacgtgtcttgcttcccctgccccttccaccatgatcataagtttcctgaggcctccccagccatgcagaactgtgagtcaattaaacctcctttccgtataaattacccagtctcagatagtatctttatagcagtgtcagaatggactaatacaggatagtaatgaagattacagaatatgtagatgaagaagtgctaagtaaatagcagctattattatgtagtcaaattgaatgtatacattgtggtacttcagtgtcctttaaattgaataactagaaatttgttggctttctcaatctgctcacatcagatgacatgttaatttatgcctatacttttttctagttaatagatataaatctattcactcaacttctattgacagaactggtagtgtggcaagacatctcatttctagttaaggctgtataatattaagttcattttacttaaattaactatggtttgggaaatgcttttcatgtcatcatgtatgcccaatttgatactttagtgggacagtatatttcagaaaaaaacaaatgcttccccaaaaattccagggttgaatacattagtcagacatataacaatgtacttcagagttcctctaagggcaaaaatcgtggtatgaatatacaaaacactcctatttatacttttgtatttttgaaatgtagtcttcatgttaatttagcatttcaatgaccagcatgacattatcttaataatttggaatgccaatatgttcatttaagacttaatatagtaagtatctaaagaaaaaaatggaagtgactgaatgcttttgtatctcttaattataatttgtgctccattgtgatatgaaggatagaaggggcaggatagatagaaaacagaaattaactttgatgtttaaccttaccttaagactgtctgttaagtgacccacataatcttaaaaaactctgtcaagcttaatggatgctactctgcaggcccctgccaggcaacagtcacaaggttatgaggtgcatagattttggaattaggcagagctgaattcagatccaggtgttgccttataatgcgactttgggcaaataaaaggcccaatttttgtattcttatctgtaaaatggactcagtaaaaattatttgagataatttatttgtgtactgtacctaggcatgcagcttgacacacagaattacaagtcagtagtttccagtatgattattattgtgaaagagatattttgtttcacctactgaaaacttttttcagtcttaaattttttatctaactggctgtattgcagatgtctgctatataacttttatataattttaaaaactatttctttyctccttgatcttctaggggtaaggttaccaatgttttcattatttactaaatatagcagcccccaccccttattcatggaggataggttccaaaacccctagtgtatgcttgaaaccacagaccacagataatcccaaatcctatatgtatattgtttttcctatacatacatacctatggttaatgtttaacctactaattaggaagagtaaaagagtaatagtaactaataataaaataaaacaattgtaacaatattccagcatcactattcttgtgctttagggccaccattaagtaaaataagggttacttgaacacaagcactgtgatactgtggcagtccaactggtaacagagatagtgatgcggtttggctgtgtcctcaccagaatctcaacgtgaattgtatctcccagaattcctatgtgttgtgggagggacccagggggagctaattgaatcacagggtctggtctttcccttgctattctcgtgatagttaataagtctcacatgatctgatgggtttatcaggggtttccccttttgcctcttcctcatttttcttttgccaccaccatgtaagaagtaccttttgcctcccgccatgattctgaggcctccccagccctgtggaactctaagtccaattaaacctctttttgttcccagttttgggtgtgtctttatcacaagcatgaaaatggactaatacagtaaattggtaccagtagagtgggtgttgctgaaaagatacccaaaaatgtggaagcgactttggaactttggaggactcagaagaagacgggaaaatgtgggaaagttaggaacctcctagagacatgttgaatggctttgaccaacatgctgatagtgatatgaacaataagatccaggctgaggtggtctcagatggatattaggaactttttgggaactggagcaaaggttactatgttatgttttagcaaaaagactggcagcattttgcctctgccctagagatttgtggaactttgaacttgagagagatgatttagggtatctggtggaagaaatttctaagcagcaaagcactcaaaaggtgacttcggtgctgttaaaagcattctgttttaaaagggaaacagcataaaacttcagaaaatttgcagcctgacaatgcagttgaaaagagaaacccattttttgagaagaaattaaagctggctgcagatatttgcataagtagcaaggagcctaatgttaatccccaagaccatggggaaaatgtctccatggccatgtcagagaccttcacagcagcccttcccatcacaggcccagagacccaggaggaaaaagtggtttcgtgggccaggcccacggtcctcatgctatgtgtaggctagggactttgtgccctgtgtcccagctgctccagctgtggctgaaaggagccaatatagagctcaggctgtgacttcagagggtggaggccccaagccttggcagcttccacatggtgctgagcctgtgggtacacagaagtcaagaattgaggtttgggaacctctgcctagattttagaagacgtatggaaacacctagatgcccaggcagaagtattactgcagggcagggctgtcatggagaacctttgctagggcagtgcagaagggaaatgtgggattggagccctcacacagaatccctactggggcactgcccagtggagctgtgggaagagagccgtcatcctccagaccccagaatggtagatccaccaacaacttgcaccatgtacctggaaaagccacagacactcaatgccagcctgtgaaagcagccgggaggtaggctgcaaagtcacaggggcggagctgcccaagaccatgggaatccatcttttgcatcagcatgacctggatatgagacctggagtcaaaggagatcattttggggctttaaaatttgactaactcactggatttcagacttgcatgggccccgtaacccctttgttttggccaatttctcccatttggaacagctgtatttaacctgtgacacccccctaccccctgccccccatccctccggcccttgtatctggaagtaactagcttgcttttgattttataggctcataggcagaagagacttactagccttgtctcagatgagactttggactgtggacttctgggttaatactgaaataagctaagactttgggggactattgggaaggcatgattggttttgaaatgtgaggacatgagatttggaggggccaggggtggaatgatatggtttggctgtgtccccaccctaatctcaacttgaattgtatgtcccagaattcccatgtgttgtgggagggacccgggggtgggggtgcagtaattgaatcatgggggctggtctttcctgtgctattctcatgatagtgaataagactgacgagatctcatgggtttatcaggggtttccaaaacttttgcctcttcctcatttttctcttgccaccaccatgtaagaagtacctttcacctcctgccatgattctgaggcttccccagccatgtggaactgtaagtccaattaaacctctttttcttcccagttttaggtatatctttatcagcagtgtgaaaacaactaatacagatggctagtaagggactaaccggcagggagcgtctccagtgtggatatgctggacaaagggatgattcacgttccagggcataagatttcattactcagaattgcacagaatttaaaacttattaattatttctggaattttccacttaatgttttcaaactgtggttgactgcaggtacctgaaactgtcaaaagtgaaaccacagataagtggggagtcctgtacctaagattattcctttaaattgtttcagtggatatgtagggacctgagtgtgaagtgagagcagcagcatcaaaacctgagggaaatccagatagcaaaagaaacttgtctagtatactggcatgacagagaaaccaaaaagttctcaagttaatgtgagaatctaagaattaaagaattaagcctttgcctttgagggaaggaaaggggtaatgtggctttaaatcaggttgagattggttctgagggttccttttccttcctttatattgatatgaatatagacacaactgttctgcatttccatttgtttttataaatgtctttttaggatttaggaactgctaattatgcaatatgagatatctgttagtttgaggaacatttgaaaatttggtcaaatgacacagatcgtcacacagttttaagacaaatgtttttacctatttgacctagtctggcaatccctatttgggcaaaaatcttcatttgcaggtcatgattggaggcaggcacagaaaaaaaattgccaccttttttgcattatgtcatcaagacatcaaacttcagcctacaaagtagaaagtgttatttctcaagttgaaggcctggatatacctcagcttctcagttctgacactttatcatagtggaaaatgaagaagattgcttaagaacactgatgttggtgtcagaaagacctgggtttgaaccctgactttactagttacttagatcactttaggcaactcaacttttctaaatcttgtttcttcatctgtaaatgctgaaaatagtacccacctcttaggtctgtggagaggattaaatgagataatctatacaaagaaagagcttgcataatagtgccaagtaatggtgaggttatacctgtattctgattataatctcataaatatttaccatgttagctgtctcagagttcttttgcaaaacagatamagatagaaagtataaataagaaaaataagtgaacatatactgaactttgtacaagatgctggcgatatggagagacccaagacatgggccctacctaaaagagattattgatagaaacaggatacatatacatcaaaaggtaacataggatcatctgtgcaaagtgctatatggcagtgttttaggaagtctagaagctgtcatggatcaggaataccatggtggacacttcaggcagggaaaacagatcttagcaaaagctactcctatcataggtacttgataaatatttgtagaatccaggatccctgtagtgataaagaaactacatggattatgtaggggagtgataagacatatgactggaaaaataaaaagaccaaattatggaccatactgagcttgtactataaacagtggaggagcccttcagatttttaatcatgttgagaaaagagttttagcagtgtgtgggggatagaatggaaagagaagccagtgccagaaggactacttagtatcaaccattgcagtggttaaagcaagaggtgagagaaggcatgcattagaatggcagcggtcagagtggatgggaaggaataggtcctgacatagtgttacagggagtaataaataggatgtggaagatgggttagaattggcaaaatctctgcatgtaagtctgggttactaaatatagtgagagaaattcaaatctstctttaagaatcgaataaaatatttagaaataagttactgttgtatttgaggtgaacacaaatggcatttcaaagatgctcgagataccttgttggaaaaagtcaataactgcactattgtctccaacatgttcttgccttctctgaagacatcatgttcctaattctgaattatgaaccatctattatccttgtatgctcttatgtgtgaggaaccataaggtgggaacaaaatccggtcttcattctagaaataactatgcgatcaaaaagtttttagtctttcttcttaccatactggttcttggtattctgtttaccattcaatgtactattattgcttctgcttaaaactcrcatcccctaatgcaagcctgagcaaacagaactgataacacacagcctgagaagggagtgcttggggtctcaagacttattctgtttttctccatctttgacacttggtttgaagagcaaagaaggatacagctgttaggaagtaagttacccaaacacagtgaccaaactggattaattcttccaatgagaaagaaatacattatttctgtgagacagattagactttaagtagcatagataacatgattatattctctctacaaataaatacacaggacctaagaaaccctttacagatccaagtgttttcctctccacttttccatccccaaacccatcttgcaagatatggccagcttatttggagttaattaaatcaagaccttcgttttacagacagggaaaccaagcccagagacactgagtagtaggccactggtgtcttagaggtctgaaaaatcctttactgaacattctcttgatctattaatgtataggttttgttgctgtaaccctctccccaagaggagtgaatataaatgatgcagagtttggatgaactatcttaataagaacctaaagttgaaaccaatgcaaacctctctcaataaatgcaaagcaaagagaataatcagtctttctttggcttgttaaataagataaaatgtgttctgctaaaaccatttaacagaaatattgtgaaaggtttcccctaaagcatttttctatttgatttgaaaactattccatagcttattatcaaacaaatcagtaatyctttagctaatgcagagataaatgggcagtcagaaaatataatcacctggtgtgtgcagctgagtatttacatttttcctaatgaacaaagataagaaaagtgcaggtgactttaatgtgtaaaaactaccttttagtgctagcgctagagggaaaaagaaattactggctcaagccaatcctgtacttgataactaagccgtatagtccatggcttggcttcagttctgttttgaatctctttttggacttgtcttgaatggactgtttagggctgcttcagtagtgcagttgttgcatttttaagcatagtttaggttttaaaatgtttctggtccctttttttttttcttttccactttatgttgcttaaagctttatggccaggttttctcatcctcagcattattgacatttgaagctggatacttctttgtggtgggggctgtcctgtgccttgtaggctggttagcagcatccctcgcctcttctcacttagatgccaatagcatttccccaaccgtgataaccaaaagtgttttcagacactgccaaatgtctcctagagagcaaaattgctctctgttgagaactactgtgttacggtgtttggacaaaaactgacaagccaatgggaatattctattggtagttgtaaaaaattaatccagttatagcagctgtatttctggaatttttttccatattaacacttgctttctgaggtgataatatctttgttttttttctcccaaatagatttcttgcattacactgaaaaattgctgattaattcacttaaattgaagactaagccaatcatgtcatttgggtaatagtttaccaactctgcccctttctctgtcagggaagcctctaatttagtaagcgatactgtatccttttgtcaggtacattaccattcctattagcaatagggcaattgagattgagaaagattaaaaggtcaccaagctattacattgtagaattaggttatgaattgtagcctatctggtttagaatctttaccttactagtctccataacaacaattcttccagtgtggtccatggggccctgggagtctccccttaaagggcagactattttcacagtaacacgtactttatttgccatttcattatgtcagcatttgcaataatggtacaaaagcaaagatgagtaaaactgttggcatcttagtatacagtagttactgtattcactgtcatgcacttaaaatctttgaagaagcaaaaaaattattaattacattaaatttcaacccttaaatacatgtggtctttctcatgtcagtgtgacaaaatgagaaggtgcataatccacttatatcgcatatagcatttgatagttgtctcaaagaaaagtgtataagattaaactgtgagttaacctactttttttcatggagtaccatgagagataaactctggttttcagccttgggtatttggcgatgttttcccaaaaatgactgaagtaaacttagcactttaaggaaaacaacttaaagtatttgttgccaattgataaaatataggtttcaagcaaaaatcagaatttttgaagacttgtatctgccactgtgagcttgacaaatgtgactcttttatattacataatgaactatgtcaacatttgaaagatctgcataactcagtgaaccagtattttccagatgactaatgcatgataatacaaaatcatgcatgggtaaaagatacattcaaagtgcaagatagactgacatatttcaatgtaacaatcaaaagttcattgataacagttttggattccacattgcaatactaaaacctttaaaaaacgaaattgtccaattttggtgtagtaatcagaaaaggcaatctataattacctgaacttaagtttctggaggaccattaaccttctacaggctcatggggaagactgtagcacttctctttccctaagatcctccagaaaggaagaaggtaatccttgggggtagggtagagacctattgtgtgatgatcaccaagtatgtaacaatgctttatataactctaatatatataatccacacaaaccccctaaaatggcactaataagggaatggactcaaagaagttaagtcagctagccactgtcacagctattagagcactggaactaggatttgaacccagatttgtctgtatgtaaagctgattctcttcgtaatagtactgagacacaagaggcggctacaaaatattctggtactccatcctagaccagagtttcaaggttcgttatcatttgtagcatgatactggatcctcacagtgcttgcctttcattcaggtgccaggaaacgtctgcctgaatgaatgggtgtaatttacctgcacattttacatgcttctctaggtgtgtgawtaactcataatccatccatgactttcacccataatcctccttgtagcaattgctttgcttgcaacaaaactaagtagacatatctagctttatgcatggttttctctctctgaactctaacataaactcagcctcaggaattattcggtttctactacatttgccattctgattgggaaccaccagcattcaggtattcacctggaacaaggcattttgttccaagggttcctcacttaaaagcaagcaccctagcaatagttcataatggaacttcttaacattctcagaatgtttggcacagctgtgagtgaacacacattgagcaatcaataactattacagataatgatgcccttaagaccaggatattttagctttcccattcaaagggggtgaaatatgcactcttactatggtatacttttggttccttctgccatgtatccttaataaaagatgtcaattccatatggttttctcttgagttctaaccattttgttgtaccctagcccttttaacaatatcaaacttgcaactgaataccatttagcattcatccattttttccaatggtgttcattataggctatcttactcctcctatttgtatgacaaaaattggcttttttcaccgatgtctatggtacatctggcagctttccatgtactcagttcttatctgatgtagcccagaacgactgcctgaagggatgccaaaagcctgattgaggttccaaattttcagctactgtactatcaatccatttgttcatttttactttcccttgtcatctgtagcttacagttgagtggcctgaacatgttttgcatacattgtaatatctaagaatttgggaatacggtcctaggatttagacttaatactaccttccatttatataatacttactcataaaatcttcagtgttcctgaaaaagaaaaaggaacatgtattgagtgcctgctagaagcaggaacttgtagtagattttctatgtgttaccttattttcacaacacacacacaggtgatatccttcccagtttactgatgaggaaactcaggggtcaaagtagtagatacctacccaaggtaacagaagctgtgaagtggtacagctgggatctaaaatatgtcagcttcaccgtagataggctccctgatgaaccacctgccacggcccgtatgaccgcatccaggggtgatgatgtcattttcacagggttattgagagctaaaactacgaagtactayaaactattatttaaaatataaatacatactatatatgcatatgtgtgtatatataattaatggggtaaacattacagaatactgtcctaacctttaaacaatgcactcgttttctgtaaactaatatacaaacaactgtttggtccctaaaaatagatgtcaggtgacagagactggctgagcaagaataggagtatcttcagaatagaagccagaggagtttttgcttccccaacacattgtcgcaccattcactgttccaggaccttcctacttctctggaaaactctggcccaaagcagctcctctacattagtcacaagtttccattaatcaggggtggcctgtgccggacctacagcagagtcatttcaggttattctgttacaggctttcgacgtgtagtcagtccactcgcccaaatctagcagggaatgaatgccttgtaatacggaagcatctacaaattcttcttaacagtgttcagagaacaatgtgaaaccctggggccttttcccagaattagggtggtgggaatgctgtcctattgactaagcctgttaggtaagcaggcagttggcaagattcaggaagcttcatttgaagatagaatttagggcgatcgtttggatttactggcttaattacttaaggtaacatttataaaagaaattgtcattccattattattaccttttaacttttattcctaaacggaacattagcaacaaactacattacttgataaatgtaatttctaaccagattgataactagaaaaaaattttaagttactttgctctgtgaattagtttaaacatatttgtaattgagacttactactgttattggctgaaataaataaaagcaagagataataaagaataacagagacaacgaacacccaatttaagtttatttctaagttccatcttttttagagaaaaggcaaattaagaaaagtttagagagaggtactagtatatttatgaacttgtatagatgataagcaaaacggactttaatatgtagaattccagaatcaacaggttgccagcatccatgtttttgaagatttgcttaagaacacaaccaaaaatggaatgggcagtctctaattacaagcagaaggctacaaaatcattttagctgcataatacagttttggttctaaagtcagcacgtaagaggaaaattccttaggaaaatacaacattgaaaaccattgtgtcatgtaatatgaaatgcaataattaatttttcctccagtaatagaaagatcactgtttcattggtttataaaaatatatctttatcattaaatgtggcaaaatgttaagacttggtgaatattggtgaaaagtatatatccattgtacaattctttccaattttttttgagattgaaaatttttaaaacaacaaattatcttttaaacagctaataatcactagacctgcactctttgtggtgagactatgaaaaatgttagagacctagtaagagaagcagattcacatttctgtcttcttcttcaagccaaacagtcatagagtggagtgggcagaatggaactcacttttgaaagcctagtgctttgtccaatcttactgcaagccagacaggaaggttatagaaaatgtttctggatcagtcttctctgagtcatatgaaattgtggtttcagccaagatgacattaggaattagagacatgggacaaaaactttaagattgtaaaaaaattttgactctagtaggaaacatgggtagaattgtaatgacacttgattgaattttaaaagatgcctgtataagatcttaaaattaggaaaaaaattatggcctaagcaattaaaggcataggaggcatctttttgggatgatggaaatatcctctctcctgattgtgatagtagttacatgaatattcatttaacaaaaaccataaattatagacttagaaaacagtaaatgttactgtatgtgacaccttaataaacgtgattataaaaataaatcctaagcatctaaaaaaaaaaaaaaaaagaagaagaagtgaaccagaaccacaccattctattttggagacacttcaaaagaaatgacctcattcttaattttgtttaaagaagaatataacatgatttgaatatatttagctaggatattttagtgcctgctagcacytgaagccagagttcactgtgagcattctgactatgaagtgagaagctaagagaactgtattttgatattcctttgacagttaaatcataacactgttcttccccttctttagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagtgtgtgttttgaagagtttatttttcctctacttggttttcatttctcagggtggattttgaaatttccattatatgcaaagcccatgaaaggctaaatatcagttaagaggggagaggagggtggctcctaggtcctctaatgggcaggaaagtatttaaaacracaatacaaaaagatctagaataaaatagaaaagtacaagttgatgtctgggagtttggtcagggagcataaggtaacactataagaaagtgctatcatatgaaatgatggtgttaagtttgggcataacataatgttcattgtattagaaacatgggctttaacttccataagctaataggtttcaaagtcaccaactttactggcctggcaaaaatgagtcacagtgagaactgtgacaggaaaaaaaaaagatattcatttcatttcttattcattttttttttctattaagccagggcactgtgctaagtggtataaataccaataagacctgatccttaccctctgggaagtcacactccactgaagtgaaagatgagttaacaatgacaaggtacagagattataatatagatgagggagagagaaactcggcctgaggaggtcaggaaaggtattttagagaaactgatttcactatataaatgttgtattaacacaaatcttactttgttatggattcagactgctgacagggcaacagcattatctccctaaagaatgagaaattcattccatagcaaatttattagaagagagtctaaaatgtcctaatactaccagtgactcctctaggaaaaaaattgtcatataatttagttatttctaaagcagtttgaaagtagcttggcctaaagctctgattatattaattttttaaagaaacaattattcattcactgtatgaggattattattatttgtctcatgttgtgtttgcatatccatgagagttagatgagtcattttcttttgttttactttttaatacattagcaaattataaaattactcatattacaccacaaagattacaaggatggcagctttggccagtgtagtagtcccacctattgattagagtcaaaagtaaagcccagccctgctttgtgcattgctcctaataaagtggatgttacttaacacatacgcagaagacagaagcgtcttcgtgtcctcactttactcctcactttcttaactgcttaagtatttccacgatataaatgcagtgataataataatacggacagtccctgacttaacgatttttcaacttttatgatggtgggaaagtgatacgcattcagtatggctcctcgacttacaatggggttgcctccagataaacccattgtgaattgaaaatatcttacacttagcactccattcttaatacctgctagaattatagattatccctcaaaattggcatagtataatatgggtatcagcaagttgttgcactttattcagagctttacactaggcaggggtgggctttacttttgactctaatcaataggtgggactactacactagccaaagctggcatccttgtggtctctgtggagtaacgtgagtagcattataatttacatcccccataacaaatgatccaagagagtatgtgatcaatgcagcagaactattgtcttttattatctgatttcacatgtaacatgccatcacttctgccatattttattggccacacagaccaatcttggtaaaggacggaaagggactgcacaagaccatgcattcaaggaggcagagatcactgggggccatcttgggaggctggctaccacacccaccataaatagaaaaccagaattatttgccaaaaatagactttaaccacaaaaatgaataccatataaacaaaacaaagtcacaaaatttcagctgacttgaagactcatctttctattagttagaaagggaatttaccaagtagtagaagacacaggaactccaaaataagatatctcattgtcttatcagaagggttgacaggaaaatgggctgggcactgtggctcaaggaaaatgggctgtgcactgtggctcacacctattatcccagcaatttgggaggccaagatgggaggattgcttgaggcctggagtttgagaccagcctgagcaacataacgagaccccgtctctacaggaaaaaaaaaaaaaaaaaaaacgttatccaggcatcgcacctgtagtctcagctactcaggaagctaaagcaggagattcaggctgcaaagagctatgacacaccactgtactccagcctaggcaacgtagcaagaacttgtctaaaaataaataaataaatgagtcaaggaatgaatgaatggattgacaggaaatgactattagttgtacgtggccatgtgttatgaaatagtgaatactagttaaaactcctcattttatagataaggaacagatagatagacttgtccaacttcatgctaataaccacaaagggctatttttaacttatgaaggtacattgcctctgatcctatagctcagagtcttagctgtgcacaagacatacctgggataaagaaatcaagattggcgtaatgtgcacatcctgacatttcagttggatataaacaaaactttggaatttttcatttttagcagtgggtgattttttttctttttttcttccagtaactgtaggacagtgatttagagattccttatagggtataacttttttgtattataaccacttcatcaatagatgtatctgttgatcgtacttttgatttataggggatagaattgggttagtgcttccattttctgtccaagtaaagaagctaggatatttatagagtacaaaaagaaattgaaacagctggtacagatatttggcattggagagcagctctgaacaaaggtgaattatagtctagtggtcaattttgtggcctrttctttacaaagaattgaacctgatacagttaaccatctaccccaaactattatttgtttaaaacacaatctattggctgggcgtggtggctcatgcctgtaatcccagcacatcgggaggccgaggcgggtggatcacgaggtcctgagatcgagacaatcctagccaacatggtgaaaccctgtctctactaaaaatataaaaattagccaggcgtggtggcgtgcacctgtaatcccagctactcgggagtctgagccaggagaattgcttgaacctgggaggcagaggttgcagtgaggtcatgccactacactactacactcccagcctgggcgacagagcgagactccatctcaaaaaaataaaaataaaaaaacataatctatcaaactgtgtaaaacacagtttatcaaaaaagtagttacccttggtgggtactggctggaattgggcagaaagggggcctgttggggtactgttctgtttcttgatctgagagctgattacataaaggttcttggtttgtaaaaatttattaaatggttcactgatttgtgtactttttttatatgtgaatactgcaataaggttttttattgcactgttttcagtttgttgaacagaaaaagggagactctttttgttgtttttgacctctcgacctcataatggcaatgtaggcaagaacattccctcaaggcaatacctgtgggtgtcttggttatattccaccggaaacaaagacagaggctgtccktataaaatatgtttgaagacctgtgaaactttaatagtgccttttattccatataggacagcacaattacctatgtgctggaaggaatgattgcatcatcgataaaattcgaagaaaaaactgcccagcatgccgctatcgaaaatgtcttcaggctggaatgaacctggaaggtaatataaatatctgaaagcaattgtttgtctctgtagcttataaaaatttatcattttacttttgaagatacacgtaagcagatgtaattaatgtagtcagttcagtatatatatgcttgactagcataatgttactgcccaataaaaatgggaaatttttttcatgaatatgtcatattgtttgtttatccaccagttcttcttacacacactgaattcagtacagccagactatatacaaagaaaggaaattatgtaataatgaaacttacacaacatgcagcaactttattattcttactccttttttcagcctcaaaactattccctagggttggaaatgtttctgtatcagacatatttacatgtccatttttctgtttgccttttaaaagcataccttttacttggagatctgtgttttattacagatcttcaagcggggggtggtgggaaaaaaaaaacctcaaggaagaactggatgggttttgttttggttttcaagtaaagaagaaacctgggccgggtgcagtggctcacgcctgtaatccccgaagtttgtgagaatccttctgtctagtttttatgtgaagatattaccttttccaccgtaggcctcaaagcgctccaaatatccacttgcagattctataaaatgagtgtttgaaaaactgctcaatcaaaagaaacgttcaactccatgacctgaatgcacacaacagtgagaagtttctgagaaagtttcttggtctccccgcactttgggagaccaaggcaggcggatcacgaggtcaagagatcaagatcatcctggctaacatggtgaaaccctgtctctgctaaaaacacaaaaattagcggagcgtggtggtgtcacctgtagtcccagctactcaggaggctgaggcaggagaatcacttgaacccgggaggcagaggttgcagtgagccgagatcacaccactgtactccagcttggcgacagagcaagactccgtcttggaaaaaaaaaaaaaaaaagaaacctgaaactagttataagttagagtttcatatccctgtttatataacaagttgtataattaacactgatctcagcattaaaaaattttcctctgaaaaaagtttggaattctgctgtggttgaaattgcaagttctgtgaaggtagtggtgatctcataacacatatgcttagtatttattgtgaaattagcacttttattcaacaaatatgcaccaacaaggcagtcactaggtataaaatgaataaaatagtgcctgtattcaagtagtttatctgctagttaggttgcagagtcagtcacaaaatagcrtggcacaccatagagggcatagggccacaggaacaagaggaaggtcacctaattctgtcttggaagtcaaggaagaagtaacattgaattttamatctataagctgagtaggaattagatagatgaaaaataagggcagagacatgatcagatttgtattttacaaagactaatcttacatggagagaccaattaagtgaatatggcagtcctccagataagagatggcagtactgagagagaatggaaaccatgtggttccttttatgattatgatgattattattattttagagacagagtctaactcttgtcacccaggctggagtgcagtgacatgaacatggctcactgcagccttgaactcctagactcaagccatcttcccacccagtagggctacggatgtacactaccatgcccagctgatttttttttaatttttgttttaattttttgtagagacaaaggggtcttgctatgttcccaggctggtgtctaactcctggccttaagtgatcctcccaacgtggcctcccaaagtgctggtattacaggtgtgagccactgcaactgacctatgtggttcttttgataggagagactaattgttggtgctatctagcacacactgtgtgtagacatcttgttaaatagaaaatagatttatgggtatgactatgaagagtctaattccccaaaccacacacacaactctatmtacgtttgaccaggctatttaaacttaactgcagagtgtcagcatgttaaacattgatttacataaaatgatagctgcccactttcttgtaaatgttataaaaactgyagagattaactaaaaaatgcacacagaagtttgctttcagttccacaagggtagtttatttttgttataaaaacagtattccccactttcttagataccagatctctgcccagattttacccagtttcatcttgctgctctctaatctcctatgtatgtaatatactttgaccatttaaatatgtattaagacacttgagtttttagtgccctttggtttattttctccggtcccaattatctctaatcttcattttttcattttacctattttatatttcgaaataggttttgaatgaagctcaaaggacaaacccaaataaaattctgtcgtatctctaatatattgtggttgcttacccagtaacatttttaggtgcttttctgaatacatataaagtttaagatctttggagttttaagtatataatgtttttctgggcaatttctccctatccaaactatgagggccttctttcatcaaaagaaaaaagatatatcaactacaaagtaatgattttgatggactaggctacgaaatctgtccattttttcctccttcttacagtttaatagcaattgcagtgccctttgcccttactgtactagaagacgaccccaggcagtgactgacatctgatttttctattaattataccatcactgccatttccagttgaatcttttgttggacatcagaaatttttcttacatgaataaaatttaagcatacggttgggcgcggtggctcatgcctgtaatcccagcactttgggaggcctaggcaggtggatcacgaggtcaggagatcgagactatcctggctaacacggtgaaaccccgtctctactaaaaatacaaaaaattagccaggcgtggtggcgggcgcctgtagtcccagctactcgggaggctgaggcaggagaatggcatcagcccaggagttggagcttgcagtgagccaagatcgcgccactgcactccagcctgggcgacagagcgagactccgtctcaaaaaaaaaaaaaaaaaaaaaaatttaagcatacaatttaggctgcagtttctcaaaatattgtattaaaaataaccaattatatgcttttatagtcagtataacgtatccagttagtgtagaaattggcatttgttgaaaactactacatgttagtctttgatatacattcttctactttttggaccctgattattaaaaacacctttgaatagggccatgatttactttatatccatttttatactacatagtggaagaaaattctgatttgttatttcctactatgatatgtaccgtgtggcacatatcatataaatgatccaattctacttgtagatgaattgaaagaaaggcttaaaaaagttcttagggtttgtgtgtgtggtttcactgtaaaactatcatttttgtattgaactaacctcagtatacataaaatctttatttggcctggtatgtacgtatgccaggaatctttggcagaccctaacacttacaatacagatgagccatgtgtttcacactttttttttaacaaccttcagaaatattctcttgttcatcagagtgcttcccctaagccaagcagtttcgatgatagccccagaataactttgcccaagtctctccataaatgtaacttaggactccaagtggtgtatttttatactcttgccccataccaagtaaatctcaagatttattttaagggagtggccttcactgcttaaagggcctagcatttaagaacagataagatttttaatggtgatcctaaatgtttttttttaaaaaacttgcttgtttttctcttgaaactaaatgtttttattcacttcattttaagatatattgtaatcaatccaaagtatggctttatttttagtataaacagtcaaatgaagcttagtcttgtggcattgtcagatttataaccaaatattactgaaactaatttttttaagttcaaaaacccaatctagtagtttctctcttattttcaacttttattttagattctrggggtacatgtacaggtttgttactaagatacattgtgtgatgccggtgtttggagtatgattgaacctttcatctaggaagtaagcacagtacctaacaggtgctttttaacctgtgcctcccttcctctatcccccctcttgtatttcccagtgtctgttcccatctttatgtctatgtgtactcaatgtttagctcccatttataaatgagaacatggtatttgtttttctgcattagttcatgtaggatactggccgcctgctacatccatgttgctgcaaaggacgtgatttcattctttttgtggccacatagtattccatggcatataaataccacattttctttatccagtccactgttgatgggcacctgggttggttccatgtctttgctattgcaaaccatgctgcagtgaacatatgggtacatgtgtctttttgatagaatgatttatttttctttgggtatattcccagcaataggattgctaggttgaatggtagttaaactcttaattctttgaagaatctccaaacttctttccacagtggtgtcattgtggttttgacttgcatttctctgatgattaacaatcagcatttttccatatgtttgttggccacacgtatgtctttttttgagaagtgtctgttcatgtcctttgcccatttttaatggggttgtttttgcttgttaatttaagttccatataaactctggatattagggctttgtcagatgcatagtttgcaaatattttctcccattctgtagattgtgatagtttctcttgatttgcagaaactctttagttaggtcccattgtcaatttttgtttttgttgcagtttcttttggggattagtcataaattctttcccaaggccaatgtcgagaaggttatttcctaggttttcttctaggattttcatagtttgaggtcttacatttacatctttaatccaccttactaatttttatatggcagtaggtaggggtccagtttcattcttctgcacatggatagccagttatcccagcaccattaatggaatagggagtcttttccctatggcttatttttatcaactttgtgtagattacatggctgtaggtgtgtgtctttatttctggactctattctgtaccattgtgtgtggtttttttttaccagtaccatgctgtttcggttactatagcctgtagtatagtttgatttggggtaatgtgatgttgccaactttgttctttttgcttaggattgctttggctatttggggcattttttggttccataggaattttagaatgctttttgctaattctgtgaaaaatgacattgtagtttgataggaatagtgttgaatctataaattgctttgggtagtatgaccattttaactatactgattctaccagtccatgagcatggaatgttattccatttgtttgtgtcatctttgatttctttcagcagtgttttgtagttctccttgtaaaaattttaaactaacttagatgcattcctaggtattttactctttttgtgactgttacaaatgggattgcattcttgatttggctctcagcttgaacattactggtgtatagaaatgctactgatttttgtacattgattttaaatcctgaacctttaccaaagttgtttatcagctccaggagccttttgrcagagtcttcagggttttctaggtatagaatcataagtgaaaagagatcgtttgattatttattttcctatttggaagccttttatctctttctcttacctgattgttctgactaggatttccagtactatgttaaattggaatggtgacattgggcatccttgtcttattgcattaaggggaatgcttccagcttttgcccatttggtatgatgttggctgttggtttgtcatacagggctctttattactttgaggtatgttccttcaatacctagtttggtgaaggtttttatcatgaagagatgctggattttatcgcaactttttctgcatctattgagatgatcattattttttttgttatgtggtgaatcacatttattgatttgcatatgttgaacgagccttgcatcccagaaataaagcctacttgattgtggtgaattaactttttgatgtgcagctggattcagtttgctagtgttttgttgaagatttttgtatctgtgttcatcagggatattggcctgtagttttgttgttgttgttgtttctctaccaggttttggtattagaatgatgtttcccttgtagaataagttagggatgaggccctctttctagattgcttttttagaatagttttagtaggattagtaccagctcttctttgtayatctggtagaatttggctgtgaatccatctggtcaagggctttttttaattggtaggttttttattattgattcaatttcagaactcgttattggtctgttcagaatttcagtttcttcctggttcaatctaggcaggttgtgtgtttccatttccacatacatacttactccaaataatggctttatatatacgggggtcagctgaaaacaaaaatgatactttcatagtaaactccacccgcccccccacccacatacacacacacataaaccctagattttttaaagcctttgttccaatttatccatttcctctagattgtctactttgtgtgcatagaggtgcttgtaatagtgtgaagatctttttcacttctgtggaatctcttgtaatgtcatcttttacattttttattgtgcttatttgggtcttcactctttttttctttgttaatcttgctagtggtctatcaatcttgtttatcctttcaagtaaccaacttttataaactaggttttaagctaattaagatttctctactttcattaagaaggaagtagtgttaccacagactcatgaacacttctgtggagctcctgtattgactgctaatcaactatatgctccaatgggtcaggaatttatataaagttgtattaactaagttgctttaaaatagtgattgcttaactaaatgattcagttcagttaactccttcctgaagatattttgaaaaattaattagtattatttcttgctctagtcagtacagcacagttgggttcaattgtactttctgagctgtattgaaaaacatcagttttctcatttagaactatatataagtagtgagaaattaattacaaactgagtcatagaaaatgtttttttttaatcctccagcttgttactctttcttccttgttctaatgtggagtaaagaaatatgcattccaaaccatttaaagttatgactaattgaggctgtcaaagtactgtttcagtgtattgatttggcacatgtgtgttctcttttacattgtcaacaaaagtacattttatgattttggatcaagatttcactgagatacttctggttgtttaaagagtttctttatgtattggtgtctttcctttttaaaattttatcactcctctattaagttgtgatatccaaatttaaaatattctaaaaacatgttctcctgcaagttgaggtaatgatagttgttatgtggtacttactataatatatgccaggaactgttctaagcattttacatatttaattctcacaacaaccctatgaggtagggactaatattgtcctcattttacagaaggggaaatgaagagtcagggagtaacttgcacagatatccagctacaacatggcagaaccaggacttaaatccaaatatgctgatttcaggtttctgccctttagtcctatatcatactgtgcctccaagagagcatggtaaactaattagcatggttctatcatgattctgtttctattttgaactattaataaaaatttttgcaattctcagttaccccatttagtatagaacacaataagaatggaaccattctattctaacattgtacattgagatatcgttcccaccaccatatctgtcctccatagactatatggtgtgtcattttaaggacagaggatctaaaaatgatttttaaaggtgatttacatttactcttccctttgcaaaatggtttgcatccctaataatttagacaagtacatttcttcgtgatataaattacatttcttgcctttccctggaattctgagtactttccctctgagagaacaatgtaattcttatttatttagtcactaaaataacttcaggagtatgaataagtctactaaaaagtctacaggatccatgttgtagtttgagtagatggttccataccaagtcaaggtaaaagwtaatttatatataatatgaaaatggctgctttaggtttatagagtaatcaatataaatcttccttataaaagggaaatttcccacttataatttatgtaatgtaaagtttttcatttcatcttcccaaatgtttttagtcccacgcagtatttatgttagtacctatgtaaaggtgaaaagtgaattttttctactggtagaactaatactatttttagcatgtaatctgctgtcatcttcctatctttataagtggctttgaacaagtgtaaatagtgtaattctcttcattatatatactaccatgatttagattaatcttaaaccacagtttgtaatccgttactccaagcttagatttttttttcagtttatagtaagagtaatttgccttatataaccaatgaaattgttgcatttagagtgaaagtgagataaaaaaataatttatagaagaatttacaaaagttatttactcagattgttttaacataccgttataatactttgtataaggaataactctaatgaagtttctggcctatttgtaggcaaaattaattgggaataggttcctctggatcttttgctttcagaaaaaaaaaagttttttctccttttccatgtcactttatcataattgctaaataaaatatttctcccatcttaatagttttagaaagtaaaaatacttcttgaataaactgtgtagcgcagaccttcccattacagttcatttctatgtatttktttaaatacccacagctcgaaaaacaaagaaaaaaataaaaggaattcagcaggccactacaggagtctcacaagaaacctctgaaaatcctggtaasaaaacaatagttcctgcaacgttaccacaactcacccctaccctggtgtcactgttggaggttattgaacctgaagtgttatatgcaggatatgatagctctgttccagactcaacttggaggawcatgactacgctcaacatgttaggagggcggcaagtgattgcagcagtgaaatgggcaaaggcaataccaggtaagatgcaaaacataaaagagcaactatataaacctttgtgttttcttcagcaaaaacactttggcttttatatcatcgtgagcccatggcttatcttgtttctcttagttctggggaytatgaaggggagagtcaggtgaatacaggtgatagggagtttataataaaacatttacattactccctgcttttcaaatcattatgcacaggatggtaatttcacataggatgatgtaatatcagaattcaagttacaagactcactcaaaactccttttacactgaagtttggggaaagaaaatgtttttagttaattccatttgttttccttcattgtgccacttttaaaaatcaggttgtttgtaagattggtaaacatcaagtatgttgattgtcaaaatttgtactaaagtagaatgattttaacccttcactaaatgaaatgctacacattgaatgtaattttaaagataattttaaataaaagttaccctattggaatttggtgtggaatggcagaggtcaatgttagtgtcagctctgactttaaagacagggaattgacaagcctgtgttcacgcaaatagttagggagagagcaagaaagtaacctgacctcctgtcatccttgttttattaagggggaaagaggtgtgaatagcagggcaaatgttttgcttaactcattgattaatacctcaagccaagattcttttctgttttttaaaatcaatacataatagttgtacatatttactgtacatatttatatttagggggtacatgtaataatttaataaaagcatacaacgtgtaaggatcaaatcagagtaactgggatatccatcacctcaaacatttgtttggggaacattccaaatcttctcttttagctattttgaaatataaagtaaattattgttaactatagtcatcctgttgtgctactgaacactaaaacttatttcttctaactgtatttttgcacccgtcaaccattcccgcttcatccccatcaccactatctttcccggtcactggtaaccrccaagccaagaattttggctattttactatttagttcatgtttacttaagcagacagaggtgacaaaactggctttttttttttttttttacattaaaagctattaaaaagcacctagggggctgggtgcgatggctcacgcctgtaatcccagcactttgggaagcccaggtgggtggatcagttgaggtcaggagttcgagaccagcctggccagcatagcaaaaccccatctctactaaaattacaaaaattagccgggcatggtggtatgaatctgtmttcctagctacttgggaggctggcactgagaatcacttgaacccgggaggcggaggttgcagtgagccgagatggcaccattgcactccagcctgggtgacagagcaagactttgtctcaattaaaaaaaaaaaaaaaaaaaaaamcacaagagggtttgtgagtcttaaagtgtcagatgacagaagaaaactgtgtctacctagtatttaatttccattttctgttaggggtgcccttgttttgacagggctaattgatctcattgctccttggcaattcccacagagatgatcttctgaagagtgttgcctcatacctttatttctcttaattcaggtttcaggaacttacayctggatgaccaaatgaccctactgcagtactcctggatgtttcttatggcatttgctctggggtggagatcatatagacaatcaagtgcaaacctgctgtgttttgctcctgatctgattattaatgagtaagttgtatgtgtgtcattttccctgtattcatagggtatctttaaccagctgatgttttcctgattgactgctattgtgataattcaggactgaaacaatcctactaggtatctaggatctaggcaaactggaaatagagttatgagtgcttggggcaggacaagtgtaatgtaaagcaaatgtacatgtggcattattactgtcccaggacatgtttgaggatatttaacagcatatctgaggttagtaaagtctgtcgcaagcaacaaggaatcttactgtgatatcatttacataaccctattccagaaagaaaaaggagcatggtaaaactcatgtggattcagtggggacaattgtagatgaggatatctaggctgatggggtgggacatatggacccagacacaagaggtatctctttgcatggcaaggctcacccagtgtctgtggtttaagaatatgggaacaaatttgttttgtttaactgagagaagaccaagcctttaagattttataaatcagctattctcttatcctctaagcttattcctgtgtctgcgaaatacttcaggtgtccatttccccttacctcattgcagttgtttcctcactcgttttctccctccagtgtaacgttcatcatgttggctaatgtttgcttcctcaagcacagtctgactgcatcacatatctccccagtacacagattgtcttcagtatcttcccactgaccctccagtacatattctgcatgatttcagactttccagaatctgacctcacttcctctcccattgttttccttcacacactcttcattcccatccatcctttccagcatactcttagactcttggtgttcacatcaccagatacacagcagagaagtcacatcctagttactctcactttctaccttgtattactacttttcgtacccctagcttattgctattagtacaatgtaaacagggagttcacacacacatacccctggtctaagaagaataaaaaatgaaggagatttctgtttgtatagaaaacagaagtcaccttgacttttattgccaaaaagaggactgttcaaactactgcatcacaatgtaacaagattaggtagttggatccaattttaaattaactggtaaatatatttagtttctggggaaactgaagacattattactcatcataatcctaccatgctgtttaaaaaataccatgttggcagtatttgttttttagtcactttctaatatgtaatttgaaggcatttaagtggaattaaaagcataaacagatttgtatgaaacaccaacttatcctggtttataaaactaacctaatttagggtttttattattagggcattcagatttagctttaagcagtcacagcaaaatctaatcatgccacatacattccttacataaagtgggatttataattttttttcctcaacagatttacattagtttcattttcattaagggatatgtacttcctattcttgtgttctcatgctgctgcctaaaagatgggcagtcctccacctttttcttttctttttttttttttttttttttgagacgagtcttactctgtcacccaggctcaagtgcagtggtgtgatcttggctcatggcaacctctgcctccagggttcaagtgattctctgcctcagcctcccgaatagctgggattacaggcgcactccaccacacttggctaattttttgtatttttagtagagacrgggttttgccatattggccaggctggtcttgaactcctgacctcaagtgatccacccactttggcmtcccaaagtgctgggattacaggtgtgagccaccgcacccagccctccacccttttttcttagcccactatgtttccatactgctctggtgtctgtgacaggcagatattgcatatcagaaagtatgcattcaagttctgaccctctatagagctgtcaaacagtctctcatggttgcccttaggtcagaacgttgtgggggaaaaaaaaattgttgttgtttttacagccaacaagaatgagtttttacttattctactacactataactttgttgaaattttcagttatatgagtataaccatgtacaagaaactaaaggaaaaaaaggtgcctcccagaaaaggagtgctttacctactattaaggactagggaggtgcctcttcggtaagagcagattttaaatttgaagagcctctgatcactttggcagcatataagtcatgtctaatttattttatataaaggaataaaccacatattcagtagagaaaaataataacctttctgttgttaagtccaagacgactttctgtcagaaacttaaaaaaaaaaaaaaatcttgaagcattttaaaagctgtgaactgggcccagtttcaggctcttagtgtcatttcacaagtcaggaaactttagagacctatttgaaaatcataggtatgtaatgacttcagaatcataagcaagaattggtttagtacctttagtttaaagaatattaaggcatatgcctgtcagaggcagattttgagcatcagaagtctagaatcaagttctaggtctcgccctctgcataactgtgaacagtgtcacacatttttgtctttaggatggactgctgtgaaaaaatttacctttaaaaatcaagtgtgtaggacctaaaactgtcgtctaattgaccgtattcaaatgataaaccttgatttaaatgagcaactagtaataagttctataagaattctaacactttaattaaataataaaataatacatggcatgcatgatagaaaataatatctccactgttacattagattattcattagtctatttaaacagccaagatgcaggaagtttaaggaaagttctccaaaattctgattttatagggaattagcaataatattattgcagtagttgtttttctttatgagttcatagttttgcaaaacaaaacaaaaatgtgctttttggggggaagtagcagtatttctaactaataccctgctatttatctttcacaggcagagaatgactctaccctgcatgtacgaccaatgtaaacacatgctgtatgtttcctctgagttacacaggcttcaggtatcttatgaagagtatctctgtatgaaaaccttactgcttctctcttcaggttggtagaacaccttttcaccttatgtcaaaagcatgaaatatgaaggcctagaaacaaaggttaatttatatacatagtactaataattataccaagtctactattatttcctactagtcagatgatttttatgaatgtaaaatattagaaaggcacagtaagtgacaccaagattaataagacaaataggtatggcagaaacagagaggtatatgagctgcatagggatctctgttgataagaatctgtgtagacttttttctccttccttcctttgatctttgatcatggraagacatggaaaaagaaagctaactacagtgattttgtcyactacactgttatttggttaaaaattttagtttcctaatgagtattagcatgtatgagaaattatgggagaaaaaggcgcatcctagaaaaggtgtgcttaattactattggggattggttaacatagcatgggagctggattgtcagagattcattatctagaaaatggcaacaagagtttataaaacgaacttctgtgagattactttttagctagcaaagacaaagatgtccttcagtaggtgaagtgataaactatgatacatccagatgatggaatactattgaggactaaaaagaaataagctgtcaagccatgaaaacacatggagggacgttaaatgcatattactaagtgaaaaaagctaatctgaaagggctacatactgtgtgattctaactatataacattccataaaaggcaaaactgtgaagacagcaaaaaaaaatcagcggttgccagggtttagaaggaagggagggataaatgtgcagagcacagaggatttttagggcagtgaaaatacttcgtatgatactacaatggtggaaacatgtcattatacatttatccaaacccaaagaatgtccaccaccaagagtgaaccctcaactatggactttgggtgatgatgtgtgggacaggaggtatatgaaaaatctctgtaccttcctcccaattttgctgtgaacttaaaactgctctaaaaaaagtcttttttaaaaaaagctctatgaactagttgstattataaaccttaggccatttcaagtaaaaattacatatcaatgtttattaaatactgagttaatagctgaatacctctttcatatacaaataagtacatttgcaattttttaaaaagtcttaattccattagtaactgtggtttcatagttgccaaataactgtaagctatggatgttgcacaagactgtgattttatttaatcatttcatatctatttaaacatttccaaagcgcacattcatcttaatgttttcacactatttttgctcaacaaaaagttattttatgttaatggatataagaagtattaataatatttcagtcaaggcaagagaacccgataaagatcattgctagagacgtttaatgttacctgtagcggtacacttgttaaagaagtgattaagcagttacataaaattctgatcatagctttgattgataccatgaaggtataattcagtgcctggatactaacaactttacttgtttaaaaaaaaaaaaaaaagaatggtttcaattgtatacatcccagactaattgagctatatgatttttttcattgtaaataatatcacgagttcttcttgttaaaaaataatagaatcataaggatggaaatatataccttaagatatagacttctactatgatagactactggaataggtatataacctcccaccaaaaatgctagactaaaaaaattaagaactaagtgaaggcaggaacctacagagataagtggaactcaagccaacttgctctttgacggcatttgtagaacctggtaaattagtaagtttagtaagttggggtttttttaagtttataatcttttttaaaatgatttcaataggtttttggggaacaggtagtggtaggttacatgaataagttctttagtggtgatttctgggattttggtgcacccatcacccgagcagtgtacactgtacccaatgtgtagtctttcatccctcatcccctccccaaccctagtccacaaagtccataatatcattctcatgcctttgcatcttcatagtttagctcccacttagaagtgagaacatgcaatatttggtttcccattcctgggttacttcacttacaataatggtttccagttccatccaggttgctgcaaatgccattattttgttcctttttgtggctgagtagtattccatggtatatatataccacattttctttatccactcgttgattgatgggcatttggactggttctgtatatttagtaagtttaaaaacaagggatggaaatataaatgcagttgaaaaggcagtggatggatctaaaagcagaagaatacaattgtttttaatgattgtgtatatgtttgtgtatataaaccacaagggaaatctgtaggtactgaaaatcacaacaggaaaatggcaacaaagctatagaaactggaaaagcaatgacttttcttagatccctcagagaatggaggtcataggacaaaccaccacttcaaaatctagaagaatagacaaatacagagaaacagccaagatcagcttactgggaaaagatgccactgaagccaggaagactatggcaatttgggaaaagatgccactgaagycaggaagactatggcaattttgatgaattgctggaggctgagtgaggactagcttcagagttaaaaactcccagggacccagtcttagtgggggtttcctgcaatttcttgggtttaccccacaaaatttctaacttccagaaactccacaaggttcttatggtgaagatgcaagaaaaattccctcctttttctggtaggagtagagggaaggtaaaatttggaaatacgtagcagagtgttcacaacaaaaggcctgccctgtaaggaaaactaattcaayaggcccttatgtgacctgggggaaaggcaaatagaggattctagcccttccttagccttcttgtctcatttctgaaagtcacagcccagggattcagacccactaaaaaaaactgagatttaatcataaagattaaaaaacaattcccctccccctccccaacaccttaccaccatataaacagggctccaggataaaataacagtggattacaactgagagagctgcaagacacaagctgtttaaggagctcttaggaaacccaaaaacaacagaagaaaaagtaaataaaaacaaggaaactagaggaaactgaagcctccagtacctacaattatggcaaacattaaatacagcccagctcctagccagattagcatgaaacctcacactaaaagtctaattacttcagttttgatatatcaatcatgtccagctttcagcaaaaaaactacaaggcatgctaaaaggcaagaaaaacccacggtctgaagagacaaaacaagcatcagaagcagtcctcagatatgacacaaatatttcaattatcagatagggaatttacaatacctatgattagtaggttaaaggctccaatggaaaaaagtagacaacatgcaagaagtgatgtacgcagagagatggaaactctaaaaataaatgctaaggaatgctgtaaggaaatgcagaatgatgttgatgggctcatcagtagactgagcacagccaagcaaagagtcagtgagcttgaagatagataggtcaaaggaaattcccccaaactcaaatgcaatataaacatagtagacattaatccagctgtatcagtaattactttaaatttgaatgctctaagtacaccaatcagctatttttttaactaggaggtgaaaataaagtttgccaccagatgctcactaaaaaattattagaggatatatcccagccaggcgtggtggctcacaccggtaatcccaacactttgggaggctgaggcaggcagatcacagagtcaagagatcaagaccatcctggcttacgtggtaaaaccccatctctactagaaatacaaaacttagctgggggtggtggtgcgcgcctgtagtcccagctactcaggaggctgaggcaggagaatcacttgaacctgggacgtagaggttgcagagagccaagatagcaccactgcactccagcctagtgacagagggagactccatcttagaaaaaaaataataaaagtaatcccatctttaagaaggactgaagaataacaaaagtggtaaataatatagatacatttaaactgacatttactatgtatataaaataacaacagtaacaatttccttgagggctaaaaagtagaactaaagtaagtttcaaggatgacaactagaaatagggtatgcagggtatgcaaagtaccaaaccattgggggaagagaatacctaagaaaaacaatccaaaagaatgaaagacatgagaggagggagaaaaaaatgcataaacaagggcatgataacaggaagtaacagataaggtacattagtacagctaaattcaaacacatcagtagtttagtttcattaaatatagagatggggccaggtgtagtggctcacacctataatcccagcactttgggaggctgtgggcagatcacttgaggtcaggagttcgagaccagcctgaccaacatggcgaaaccccgactctactamaactataaaaagccgggtgtggtggtgcatgcctgttatcctagctactcgggaggctgaggcacaagaatcatttgaacctgggagatggaggttgcagtgagccaagatcgtgccactcttctccaaactgggtgacagagggacactgtctcaaaaataaaataaatgtagagatggactgaatgctccaagctaatctgacaggattttagaaataatccaaatttatgctatttaaaaaaagctatatctgaataaagatattgaaaggctgaagtaaaaggatctactttgcatagtataacccaagacatggccaactttttctgtaaagggccagatggtaaatgttgttagctttgcacagtctctgtcacagctactaaactctgyccttgtggcaggaacatagtcattgacggtactcaaatagaacaggcatggctgtgttccaataaaactttatttacaaatacaggctgcaagtaggatttggcccataggccaaagtttgctggcccctatattgaccaaaacaaaaccgaaggagctacattattaccaagcaaaatagatgttaaggcaaaatactccttaaagcatttgttcaggaaaaataattgtaaatatatagtttcaaattacataatacaaaaattcatagaacaagaatacttagataaatctagtaaaaataatgagattttactatacctttcttacaaattaagcagacaaaaaaataaggatatggatgtacatttcatctctcttgggtcaatactgaggtgtgagatcactgggacataggttgagtgtgtgtttaaatttatttttaaaattgccaaacttttccgcaattgttaacatttaccagaaatgtatgagacttcttaagatccattctatatcctcctcagtacttggtactgtcagcctctttcatcgtaggtatactgatgattaaaaatattaagcatcttttcatgggcttattggccacctatatttcttatttggtattgtgcctcttttaatcttttgcccattttttaactgggttttaagaattgttcaaatattctcaatgtggccctttgttaaatatatgttttgcatgttttctttaagtggattacatttacagttttcttaaaaaaatgtagagatgagcaaaagtgtataattttgaagaaagcttcgtgtctttgtttactaagaaagttttgcttaatccagggttaaaaagattttctactatttgttttcttatagaaattctgtagtttcagctcacatgcttaagtatatgatgcaaggtaagggacaaggttcattttcttccccaaaatccatatctggttgctccagaacttgactctcttttccctattgagttacttggcaattttgtagaaaatcagttgtttgtatatgtgtgggtctactttcagactctttttcttacccaacgatctgtatttcttacccaatgatctgtatgcctatattcatattgataacaccctgtcttgattactgttgcattacagtaaatcttgaaatttggtaatatgaattctccaaatctgttgttcttttccaaactgttgttttggatattctagtttccttgcatttccacttccttttttttttttttttttgagatggagtctcactattgttgcccaggctggagtgcagtggcatgatcttggctcatcgcagcctcagcctccccagcagtgggattgcaggcacccaccatcatgcttggctaatttttgtatttttagtagagacggggtttcgccatgttggccaggctggtctcaaaccctgacctcaggtgatccacccacctcggcctcccaaagtgctgggattacaggcatgagccactgtgcctggtcttccacgtattttttaattagcttgacaatctctaccaaaaagtcttttggggctgggtgtggtagttcatgcctgtaattccaccactttgagaggccaaggcaggcagatcgcttaagcccaggagtttgagaccagcctgggcaaaatgtcgaaaccctgtcactacacaaaatagaaaaaattagccaggcatggtagcttgtgcctgtagtcccagctacccaggaggctgaggagggaggtcaaggctgcagtgagccatgatcatgccagtgcactctagcctgggcaacagagtgagactctgtctcaaaaacacagtctgatagaatttttattaggatagccttgaatctatagatccatttgaaaataattaacatcttaaatttccaatttctggccgggcgctatggctcacgcctgtaattccagcacgttgggaggccgaggtgggcagatcatcaagtcaggagttcgagaccagcctgaccaacatggtgaaaccctgtctctactaaaaatacaaaaaaattagccaggcgtggtggcacatgcctgtagtcccagctactcaggaggctgaggcaggagaatcgcttgaatctgggaggcagaggttgcagtaagccgagattgtgccactgtactccagcctgggcaacagagtgaggctccgtctccaaaaaaaaaaaaaaaaattccagttgttgagaaagaataggaattccagctttggaggagtggggagaccatcaaatcctctttccaaaaatactactaaaatactactgagcagagtatagttccacaaatagtcttctgtaaagagactcacagtacatatttgtctttgtaggccatatagtccctgttgcaatttctcaattctacagctataacaggaaagcagctatatacagtatgtgaatgcttgtgttctaatacaaatttatttgcaaaatcaggaaaatggcttgaaatggtttaagatctagttttctgactagatcatggtatataatcttttccatatatattttgaatttggtttgctaatattttgctgatcatttttatatctctctttatgaaggatgctgatctacaactttcttttcttgtgatatctttttctggctttgctaccagggtagtactagcctcttaaaatgagttgagaagtattttctgttttcttaaagagtttatagagtattgatcttatttattctttaaatatttgatacatgttaccagtgaagccatctgggtctgtgttttctttcagggaagatttttaattatttgcttatttgttatatagatctattcagaatttatatttttccttgacatagttttgtaatttgtgtgtttctatgaaatgagccattttgtctgagttgtctaacttgggcataaagttgtttgtaatcctttaagttttgtaggatccatagaggtgtcccctccattatagattttcataatttgtgcctgatcatctttttttcatggtcagtctagttaaaaatttatcaattttgttggtctttacaaagaaccaatttttagtttcattgaaatttttagtttcattgattttctctttttgtttcctatgtcattgattattatttcttcttttctgcttgcttttcatttaatttgttcctctttttctagtttaaggtagaagcttccattgttagttgaagaccttattttcttatatagatgtttaaagctatacattttttgtatattttcattcatttcattttctaatgtccttcatgatttttttcattgacccatgtgtattgcttaatttttatatatttggggattttccatatctcttcctattcatttctaatttaattccactgaggtaggaggtacattgaaggactctaatattgaatgactccaataagtcttctgagacttttttaggcacttgcatatggtctatcctgagtgttccatgagtgcttgaaaaaaaacttactgtgctcttgttaagtagagttttatgaacgtcagttaggtcaagttgattgatagactaattcaagttttctgtatctttgctgattttctgtctagttgttctagatcctacaactttgtctacatccttgccagagcttggtatggtttttttattatcgctatcctagagagtatgtagttgacccttgtgacttgccatgcatttaatgactgcccatgttcatagcagcattattcataatagcaaaaaaaacttttatcatatgcttttgtgcctcaagatcatatatttttcgtttttagtcactaatatggtataatggtataatatactgtttaatttctgagtaattgactagcctttcattccggggataaatcctatttggttatgatatagtatcctttttacatatagctgaattcattgtactaaaattttggtatttttgcatctaaatccatgagggatatattctatagctttggtgttatgataatatggtattatttctttcttaaacgtttggtaaaactcagcagtgaagctgtcttggtttgtttggagccttttttgtagaaaggttttcaagtacaagttcatcaaatgtttactgataatatgtttattcttgagtgagctttgttggtttacatctttgaaggaatttaactgtttccttcaaatgttgaatttattggtataaagttaagttattcataatattcccataatatccttctaatggctccagtatctctagtgttattccctttcattcccgacattggtatttaatatattcttgctttttttttttttttttaatcagtctggctaaaagtttttcagttttaccaatgttttcatagaaccagcttggtcttgattttgttgttgtttatgcatgttcttagttattcgtttctactctttatcctttccatttttcttgtgtttagggtagaagcatatataattaattgagacctttcttttctaatcaaagcttttaatgctgtaaattttctaagcactgtcttcattgcatcccacacattttgatatgctgtgttttcagtactagagatttttaattttatgataccttatttaatcatgatgccttatttaatctatagcttattaaatgtcaaattctaaacatttgggtttttctccagatatgtttgttactgacttctattttaatctcatttttgtcagacagcattcattgtatgacttaatcctcctaaatgtattcagacttgttttatgttctagattaatgttctgtgtatacttgaaaagaatgcaagttcttgggtagactgtttcagaaatgtcagtcaaatttaagtcttgtttattcttattgattctgagacaaaggtgtttataatgttagatttgtctgctatatctctgacattgccaaatatccccttggaggcaaaatctccccctcccttttgagaaccactgatctatgtagccttttttctgggactaatttagccttgcttctgagatgtggcccctaggtctctactgaatgcccggcatatttaattagatctttctttcctctatggcctcaagggatttcaccctaagtatgcacaaatttttattcagccgaagactgtacagatttctggaggcctttctttgtgtacctccttcgtttccagtagtctgacccataaattgtacagatttctggaggcctttctttgtgtacctccttcgtttccagtagtctgacccataaattaaagctgctttagcctccccaaacttcaatctctttctcctcaacccagcaagattgctagaccctgggttccctttcccttcactgcagtatgataattactttcaagcacaaaggtttagaattaagatttcttactcctgggctaggtatggcttaccgtatttgtttctcytttcctagggatcataatcatgtattgcttgttgtccagttttccagtaggaggggaattccaggctgtacttacttcctgcagccaaaagaggaagtaatgttagtgatttcaatattaaaacattaaaaaaaaatttaagatggatgaaattcttttatatgcatattgaattgggcttcaccatagttatttttagaattaggactaaccggcagggaaaaaaactatacggcagggaaaaaaactataagccatcgctgttttacaattttgcaataattagattttctgtagtatagtaatgtgtaaaattaacccattgttaatatagaatgccgttatcactcctgattaagcggtcttcattttcatgttaatactgatgtcttgtaatgctttmtggaatcaaacattttcatacatattcattagtctaattctaatcataatccaatgaaaaagagcaggaaagatgctcaaggaggttatattcaagtccacatggcaagtaagaaataagactactcggctgggcatggtgacttactgcctgaaatcccagcactttgggaggccaaggtgagcggaattgcttgaacctgggaggcggaagtggcagtgagctgagatcatgccaatgcactccagcctaggcaacacagcaagactctgtctcgggaaaaaaataataataataagacttctagaagctcctaaatccatagcttttcctctataccagcatcttctaaaaatgtcagcagcagtgaagtttcagtttgggaaataatgcatttcccctctctggagagtgcacagttatatctccaagaagtactgaaattcagaagtctgcctaatatgtattaaacatttagcttttctcaaactttgaccaccaaatcctttgtctcgctctaactatagttaacacagaatcagtgttcccaggagcacactgtgaaaaatgtagcactctacaaaagtcctaatctccacaggattaagtgaaaccatgattaaccctctgttccttgtccttattagtaccattttctgaagagtaatgtatccccccaaaacttttatactagtttcactaaccagaatccatgtacataaggaaggacagatatttgctccctactaagacatatctattagctacattaaaaaaagtattgcatgccgattttaaagttataattaactggtgatatcacagatattccaagatataattgctggaataaacactgttgttgaagccttctatctatctcagtactagaattaaactcaagtgcagaatggcagacaaagttaactaaaaatcactgtattatttcatttggtcctccaaatagctttgtgagctaaggaggagaaggtgtatcatcaccacttccattttatagatgagaaatcaagtgatttactcaaggttaagtcctccaattctttgttatcctgcattttctcttggctgtagtttaattaataatcctaagaaaatgcttatattttagagtgcagtaagagtacataaacaatgttaaatgcccatcttgcatgtataaaaagttatagcaagaaatctggctgggaatggtggctcacacctgtaatcctggcactttgggaggccgaggcaggaggattgcttgagcccaggagtttaagaccagcctgggcaacatagggagatcctgtctctacaaaaaaatttagccagacacagtggcttgtgtcctagctactcaggaggctgaggtgggaggatcacttgagccaaggaggtcaaggctccagtgagctatgattatgccactcagacatggtggcttgtgcctacagtcctagctactcaggaggctgaggtgggaggatcacttgagccaaggaggtcaaggctccagtgagctatgattatgccactgcactccagcctggatgacacagtgagaccctatctatctcaaaaaaaaaaaaaaaagaaaagaaaagaaaaagaaaatcctttaactgacttcatcttaaccttttagttcctaaggayggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtaagtgtcaaacataaagccaaatataagagttttctgggacaaagtatgttttgattagtgaatataattatataccagcagcgcccccacccccgcccccagtttgtggatgttggtgatagcttgagttcaacttatgaacttcagttttgtagacatttttcctaaggccaattatgaaatatcctttcacctagtcatgtgtatataaaatcaccatgttattacagaatttagtaayactgtttttaaaaagtatgattaatccattaaattagaataatgcacccttcatatattatggtactacagtgattcatgaaataattctatataattctacatacaatcaaagaaatataaaatgtgttttgtacrgaagtgcttatttttcatctggggaattccagtgagattggtatattctaggccagataattttttcaaaatagaggacaacaaacatgagatgttcccactgaccaatttggaagcctgatcattaccatatcttctcttgcaggtgrttgaaaatctccttaactattgcttccaaacatttttggataagaccatgagtatkgaattccccgagatgttagctgaaatcatcaccaatcagataccaaaatattcaaayggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatakttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgayttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggkgtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctrtcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaycctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttktgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcrtttaaatttgctgttctggtattaccaaaccacacatttgtaccgaattggcagtaaatgttagccatttacagcaatgccaaatatggagaaacatcataatwaaaaaatctgctttttcattatgtgactccaacatgcttttgtagaacttgtacagttccgattgtccaatctgatttttgtttactgaaagtagagttacccctgcttcaggaaccttaagataatatggtgggcatttaaatgtcagtgtggcaatgttcgcctgctaatatggcatagattcaaaataagcttaaccctggtgccaaagacctgaagattatcccatccatgcctcaaatggttgtgtgccaattactgcaaagggtactaagggaaggagaaattcactcctgaggctgcttcaaatgtatgtctttatcacaaaagatgacattttatgtaagctaatgttatctagtcaaaattcttagcttattttaaaatcaactcttcaagaaaaggaataaacatttaatataaatatcatagcagtattgcacatagaatagaaaggtcgggcagggtagtggaagtcagctattctatacaatccattcggtattttccaaaacatttgatgttcaggccatatccaggaactggatgacctaacaaacttctctgagtacctttttttccacaagagatctccatcactaagaaaaaaagcattgtgatttaaaagccaaatttgccttatccatcatcatgtgcaccaagtatttgctacctgcctactatataatattgaagatacaatgtgaataagaaaaatactattgctaccctcaatcagagtatgtgattggaaaagtgtataacaaacctttcccagtgtcttcaggtataatgcagagataccagatacggcatcaatgtgtatacacattatggctgtaccattcactttaagtagtaaccttacatttctgtagaacaccttcacatacatttttaacaagcctcactgaatgaattaatgacatgaaaataatgaggcagattattctcgtttccattttataaggaagtaaactctgtaagaaagtaaacaggctcagaatttaagcactgattcatagcccctagctcccatgttattgaaatttgaatggaaagcctctaatgaggccattcatctatcagatgtcaaagagcatgtctctggcctatgagcctctcagggaactggttatgtttttctgttttaaattaaactaatgctttactgagcacttactatgtgccacgcacaatgataattcaatatattatttcatttaatcatagtacccctctaaagtactactgtaaagcagtgctattatcctcattgcatttatatcaggaaactgtggcttaaagaattgagtaacttgcctacagtcacaaagctagctccagaatccatagttttaaaaaccactattgagaaattactaatatgagctaactagggcgaatgaacccatattgatcattatgtgtctggccttttgacatgtcctcatttaatctaatcccttttgctaccgtatcaattttgacttagaaatttaacaatgatacattagtccccgcttatctacggaggatatgttccaagactcccaatggatgcctgaaacatagatagtactgaactgcatgttttttcctatattacatacctatgataaagttaatttacaaattagatgcagcaagagattaacaataactcaattacaacaatatactgtaataaaagttatgtgaatgtgagctctcaaaaaatcgtactatactgagggtaactgagaccacggaaagtgaaaccgcagataaggcgggcactattgtatttccttctcttaaaaacgtgtcctgtaccctggggtggttgatggtggaaaatactagttgcccacagattacagaatgccctttggtttgtctaatatacaacagggagcctgtctcactaatgcccacagaaaaatcaaacatttcttcaagtgatatggagcatatagggtacagtcaaaccaaggaagaaagttgtttataaatgagaactatagtgcaagttaaaatttgctcctagttttgcaggtaaagagccagactttgggtgtagaaaaaaagttgaaaatactgaggcttttacataaggtgattttttttttttttttttttttttagaatttcaactaatctcttttaacttaagtcgttcttaacagtattggtaacttcatagcactttctttctggtgaaataaccccatcctccctcttatttaggcttcctgtttcctagttaaaatggggcagtactttgttagggaagtatttttacttcacttggttacaaacatgtaagtctcagaacaaaagagtttgtgcagaccatatcagacactcaaaagactttcttcactctacccacttgagtaagagacaatttatattctgttcaccttatgtaccctcaccaaaaatattcaatagggtaataatgtgtatataatgtaaataaggcacacgtttttctatttttgttaaagttgcattgtcttaaaagtactgagtatatacatggggttttgctagaaataaaaatctaggtcatccaaaacctctacagttgttcactaggattgcaaagaatcaagataaaaatgaaactctttcaatatggcaagaaagggggacagtgtgcataaaagcaagcaaaggctcacaaaacaggagaatatgtcacaaacaccacctgatcaatttcaagacctactatgtggcaagcatgctagatgaagcaattcaaagaccactaaggcaatactaagactccaaggagaggttcctgccctcaaggaattaaagatgaaaggcaaatgactaagcaattctactcctatgtatctactcagaagagatgaaaacgtgtccacacaaatgacttgcatgcaaatattcttagcagcattattcttaatagtcaaaaagtggaaacaattcaaatatccatcaaccaatgtacagataaacaaaatgtggcacacaaaatgtggctgggcacggtggttcatatctgtaattccagcactttggaaggccaaggcaggtggatcacttgaggtcaggagttcgataccagtctggccaacatggtgaaaccctgtctctatgaaaaatacaaaaaaattggccgggcacggtggctcacgcctgtaatcccagcactttgggaggacaaggcgggtggatcacctgaggtcgggagtttgagaccagcctgaacaacatggagaaaccctgtctctactaaaaatacaaaattagccgggtggcgcatgcctgtaatcccagctacttgggaggctgaagcaggagaattgcttgaacccgggaggcagaggttgtggtgagccgagatagcgtcattgcacaccagcctggacaaaaagagcgaaacttcatctcaaaaatatatatatatattagctgagtgtggtagcgctcgcctgtagtcccagctactcgggaggctgaggtggaagaattgcttgaaccagggaggtggcagttgcagtgagccaagatcgtgtcatagcactccagcctgtggcagcagagtgagacttcgtctcaaaaaaaaaaaaaaaaagtgacgaacctcaaaatcatgctaagtaaaagaatccagacacaaaaggaccatatattatttcacttacatgaaacgttcaaaaaaggcaaatctatatagagaaagaaagcacatcagtggtttcctatggctagggataatattagggtttaagtgcaaatgggcacatgagggtacttttgggggtgatggaaatgttctaaaactagactgtagtaatggttgtgcaattctgtacatttaataaatgctacacttaaaatgggtggattttatatggtatataaattaaatctcaataaatacgtattaaaaatagaggcagccaagcaaatgtgtaattgccattcagttgtatcaaaagcaggtacaaatgcactaaatgcactttgaatgcactaaaacaagtgcagctattttttttggaaagcctgtcagaagatgtcttcattgtgctacatgttaaaggatgagctggagttcagcagcacaaagccttactcgtttaatattaatggatgcccctgtaatgtttaattagtcatatgttctacccatccccagagagggcaaccatgtacaaagagatcaccaacatgacaagtaaaaaaactcacagcatatacatgactactcatgtcttgtatgaattctaagtgttaataactgttaagaccttagtggtcttacaacttcggaataaacaaatctgggttcaagccttgcttctttatttactaagtctgtgattttgagaaaattccataatcactttatatctgtttctacatctgaaaaatatatgtagctgcttagctcaactcctaccatatagcaagcattcaatacacgttagctgttttttaagtcctcatgaaaatctaagagaaggggaattttttaatgctgtccccaaaaatgtatagaagtgaggcaaatgatgaagagcagtatgaacacagtaactgcacacaaatttccaaccctgcatttcttaattaatcaaagctatgcataaggctgagggaggctgttctgttatttgccaattctacagaaacttccaaaaaagctgaagcggggggaatacttctcaactaattccatgaggtcttcattattctgataacaaaattagacaaaatataagaaaactgcacactaatatccctcatgaacataaatgtaaaagttctaaccaaaatcttagcaaatagaatataataatatattaaaggaagatacatcatgaccaaaggattatctcaggaatataggtttgacttagcatttacaaatcaaccaatgcaattcacaatagtggaaaagaaaaaatccatgtgattaagatgccagacaaaccatttgacaaaatctaacatacactctgaattaaaaaaaaaaaaaagatcagcaaactagaaatagaaggaacctcctcaacctaataaagggcatcacacacaaaaaaattatcttccagcattatacatacttcatggatactttcctcttaagaacagtagcaaaacatggtctgctctcaccactttcatacactattttactggtgtctccagccaatgccatcaggcaagaaagagagataaaaggcatccagatcaccaaagaagtaaaactctttactaacagatgacgtgatcatctgtttagaaattctgatgtgatctttaaaaattaaaaaacactactagacttcaaaaaggctgggcgtggtagctcatgcctgtaatctctgcattttgggaggccaaggcaggaggactgcttgaggccagaagttcacgaccagcctgggcaacacagtgggaccccatctccacaacaattttttttttttaaaaataactgggtataatggcacatgcctgttttcctagctacttgggaggctgaggtggaaacatcacttgagcctaggaggctgaggctgcagttagccatagtcacaccatcacactccagcctgggtgacggtgagaccctgtctcgagaaagaaaaaagaaagttaaatgcagaattaccatatgatcccacaattccacccctaggtatatacccacaagaatgaaaacaggtactcaagcaaacacatgtagacacgttcatagcagcattattcacaacaaccaaaaggtgaaaacagtccaaatgtctccatcaaggaatggcagataaacaaatcatagtatatataaaaatgaaatattcagccataaaaaggaatgaagtactgatttatgctacaacacgagtgaagctccaaagtattaagcgtagtaaaagcagccagatgcaaaaagtcacatatagtgtgattccatttatatgacatatatagaatatataagcctatagatacagaatgtagattgctggttgtcaggggctgggggaa

SEQ ID NO: 17768 - DNA, 61177 bp, Homo sapiens
  misc_feature (1)...(61177): n = A,T,C or G, or insertion/deletion polymorphism (see Tables 1-2)
attcaaccttaacccaaagtataaattaaatatccacaagtccttattgatatagtgattaaataaatcaattggaaattaaagacaaatttcccatgtggaggaattcaaataatttacgtagctactccaccctcaaggaggaggaacataactcctcactccataaatgtgggatgtacatagcatttccttccaaagagtgcactatgaaaaaaagggtgaagaaaaacaattaactttacaatggagaaatctgacaacactgctgagccaggtgatcaaagtcaatgtaaatagagataaatcatgttgatattatgtacctctgatgtaatgtggtatcaagaaaatagcactttacctctgtggtattcctcctccaaacttaacaacctcagtcaaatcatgagaaaaataccacaaaaattcactagaggaatatcttgcgaagtatctgaccatttctcctcagagctattacagccaagaggagcctaaagatacttgagaactaaatgtaatgtaccctggatgggagattggaaaagaaaaaaagaattaggtaaaaacaaaagtaacctaaataaagtatgaattttagttaataatatattaatattggtttattaataataacaaatcaactacactaatgtaagttattaacagaagtaactgtgcaggctatatgagaaatctttgtgttattttagcaatttttctgtaaatctaaaactgttataaacaataaacctattttaaagtaacatatacattatacaatgtgagaaaatataatggcaaaaaaagaaaatgcaagcacaaactatattccgtctctcagggataataattattaaggtgttcagtgaatattgttctaatcctttttctgtgctcatatgtatgtatattgtttaaacaagaaatctcaaaccatatctacatctgctgtttaccagactgcttcctttacttactaagatatggtaaatatactatatttacaagtttacatatttacatataccaaactatacaaaatacacacttttatagtattattttaaaatggcttcatggaattctgttgaattgatacgccataatttattgaactatttttgtcattaaccaaacatggtatccaaattttcactataccacaaagttccttgtgacaccatttttaatgttttttttttgtgcactttatgcctaactccacaagacactgttattaagagccagtgtgtttctccaccatactttctttgctcttcatcccttcttgcatctcagattttatctggggtcaatttttttctaattgaagcagatttttaaagatgtcatttggaggagtcctttactggtaaattttcagttttagtttttctggaaaatctctatttcaagtttatacttaaaagacatctttacagaatatatatagaatacttaattcacaagtattttctctcagcacattgaagacaacattctaatgtctcctaattttcattgatactgttaataatttagtagttgtctgcttctctttcttcttgaaaataatctgtcctctctatctagttcctttaaatatcttctctctctctctgatattctgcagtttaattatgatgtatctacttgtgtgtatgtgtgttttaaaaattatcctgcttaagacttattgagcctcgtgaatctgtggattggtatctgtgataggcagacaatggctccccaaagatcttaaatgtcttaatctccagaacctgtgatagtctaagttaaggttgtagatgaaattaaagttaccaatccacagacctcagggtaaaaagattatcctggattatttaggcaggcccagtataatcacaaggattcataaaacggaagagggagacagaagagatggtcagagtgatatgaagtaaaaaggattcagcttactcttgctggatttgtaaatgcaggaagggaccacgagtcaaggaatgcaggtagcttctagaagctagaaaaggtaagaaacaaattctcccctaaagcctccagaaagggatacacctgccaatactttcattttatccctgtgagaccagtgttagacttctgacctccaagagtataagacaataaatctgctgttttaagccactaagttttgtggtaatttgttatggtagctatggagaactgatacagtgcctttcaatagttcttggaaattcttcaaatatattccccaaatattgcctttgcaccactcactctatcctctatatctcttgacctctctttaacattttttattttcttattttggtaattatttaaaacaattggcttcttgttccacttcaaataaattcatatttttatatctacatattaagaattagttcataaatgtaattgttgtatcgtatatactttaaaaggaaaattgcatttatacttggatattattatattttaggttttgaaatttctttttttaaatgtctgataaatttattctgatcaaaattaaaatcttattgtatttacagtagtctactaaaagagtttacatcaattctctcctttaaatgctagcaattcagttttgtgtggtcaaagataatttagaatccttttatggtaactgatatgatacaaaggatttttttggttgttgtcaaatttgtatgtgcgtatatatgtatagggggtagaaaatttggttagtgactctattttggaaaaatgaatgttctttttggagttttagattcccagtgtttcaaaccaagtttgcttttgataaggaattcagtgaatctttattttctcgtagagaatttttaaacaatacctttcaaaatattgtatgtattcctatataattttgccttggaataaaaaaagtcatcacattaagaatatttttaacttaagaaattttttcaagattctttcaaaatgctaactccctcattgatttgaaaatacttttagagtttaaactattatgaccatgtagggataacttaaagtgtccttctaaatttttttttcattaatgtcatgcttctttctaagaacaaagtgtttcaatgttataaacagactgttttttcacatagctttcatacatcctgactttctatatctagtagggtaatacatttccttccaacctttagtggggtgaagttcatttgtcttctaatctaagaaaatacgttaactcctgacaayctctgacactcaacagaaacacaactgtactttggaattaatcatccatctttatttcatagtctccttatttatcaatgcaaatggaagtatagcaaatatttcacagtgtcatgtactacctaaggaatttcattgcaatagcattgttttgaaatgtatcatttgattttgatctaactatcatagatcagttttacccctgtatgttcagcctgaatgtctaaccacaatttcacaaaaatcaagggctctgttagttttcatacaaaattgtgatgacttattatgaagacagtcccaattaacaattgcatgtcatctgtaagaaatcaatttttttctcactccccacctgtaattttttttaagcaaagaagaatacttgggtctaggtttcaaggtttatttttctgtagtcctaatatcacttcagtaaattaatctgagactcatttttctaatatgtcaaatgactgttgtaaggattattataaaaacgtaaggtgattaacaaagtatgtaattgttccatagatggcagctcttgtttttttactgtgctttgcttctgccctgcttcacatattatgtaaaatagctggtgagttttaggaggtagtgctcacatgtttgcacagtgtttgctgtggacgatcaacagtaacagaagagcatacttcttcgatacacagagtttactgaatttggaaaggctttggcattcttatgtcatctgtaatgaaacaatctccagaagtcttttctaaaatgtccttgtaaaaagaaaaaagttatgtttatattttataaaaggatgatgttatttataaccagcagaagcagccttatttgaacatcttatgttgaaattgctacttaatacagtgactcataggagctttctagtggaaatcaaatgctcaaatgaaatagaatttagtttgttaggcaatagtgatatgtcttttattggttggactctggaaaacacttgacaacgaatagtactttacccgaagggcacgtatcatgcaccacatagcctaaccacaaacattaaaggtcttgtaactgtgagcctcaaatgaaaatacataaggacagctctcatacaatcaaatacaatacaaactagcttttaatttaaataaatatgtaagtaaagttcaagtgactataatgattttatatccctatgtatgtatcacagaaattgtggcaaactgtagaaatctattcaaatggaaagtaacaaagcactttcacattgccttgtattcaaaatccctactcttcataaaaacttatatttctttaacaaagctacttttctgtttaactcccggaaaacttcgtatttataacttaagggggtttctccaaccaaacaatttatttttgctaggtactatagctatattttttatacaaaatttgtgacagcaaatgaaattctaatcccaatagaagaacaaacaattttcatgtttcgatcttcatatatataattcaagaggaaatatgcttaactttgtagatttttacattttaaattgcattgtgtctgtatcaagtctactatcttttacctagattgtctggaagatttaagctcaaggttacggtttgagaaaagggttttgagagtgaccaggatagatttaagaattcattttatactaaaatatggccataaatatttttaaatacattcaaatagccctttgctggcacattttttcccttctttgccaaaacattcccacaggcggcctaagtcacctcattttataggtttagtaggtttagcaggctttatgtgctctagtagggttagtaggttttgttcatatcaggtctctctcatgggagtttccagggacaaggattgcttcagttagtatggccttagccatactagggtatttgctttaattctacagaagttttctaattaatattctgtagcaaaagaactaagatctggaattccccctcttaatctcttcctagaaatgagattcagaaaggacaggactgcatccagcctgtttgggaactcagacaaatgtgtgttgtcacagacacaaatagaggtctactatgaaataattggcttgctagtgtgctaatgacagacaatgctgatttgctccaacctcatacagtttcacacataaggacaatcatctatgtttcatgaaagttctatctactttaacattattttgaagtgattggtkgtggtatgaattaacagtttaaatttaaatcctaaaattcagtgtgaattttttataatagcataaaaattcaaagatgtccatacaagaaaaattaaaatttggttaggtttagcagagtttgagaatccttactaccctcccacatagtattgtaatgtgaatataggcagttactattacaggcataatgatgattatgtattaagcagaaagaagtatcaccaccagtttttttctttgaatgcccctcagtacttctgcatttataggatggtagactggtttggtttagctctcaaaagtgaaaacatttaaagtttcctcaytgggtgaaaaaaattaaaaagagtgagagactgaaaactgcagcccacctacgtttaatcattaatagtgagcccttcagtgaacttaggtcctgattttggagtttggagtctgacctttccccaaagataaacatgattgttgcaggttctgaagagggtcactccctcactggctgccattgaaagagtccacttctcagtgactcctagctgggcactggatgcagttgaggattgctggtcaatatgattcttcttgctgtgctttttctctgcttcatttcstcatattcagcttctgttaaaggtaagtttgtgttgccttttgctaaactttaatttccatctttggagttggaggcagatacgtgcgtgtgtgtgtgtttgtgtgagtgaatagtgaaagagtttctgactaaactatcttcaaaaccatgtaactttggaatgtttgtgaaagcatggctgagttgaaatgaaaaccaaattcaaatccctacaaacattaagaaaacagatatttcttttagtttcagttcctcagaccagtgtgttcttgcttcaatttctcattcatggtctgtttttaaaagaaggaaaaaagatacccactattgttacctgctgttgttggtcacattgaatgcagctccttcatttgaattgtaaatgaggattttttttaaaaaccgagttcttaaattttcttttagttgcttagcaatgtgacctcaagaagaattagacccaatgaaaaaggcatttgatttgccaaagaattatgaatgaaatggcacaacatatatttaattccgttacaattaaaaaatgatagaattcatagtgaattaaagaaaattaaatttcctgatacagatttaagaaataagacattatctttggaaaaataatgttgctacttacagtttctattttaagatgaaattaattttaaaaatacatatgaattaataccattgaaaaggcaagtgaaaaaacattttatgaggaatggtttcataaaactgttgtgaagtgtattaatatagaatcatgtttcagatcagctacattataaacatcggttttccaaatgctgcattgtgtaaaatgatcactttttagtttcttaggaagacacactgttaaaaaccaattgatataacaacatagcgttatagggaccaattttaaaaccatgtactctaagtaattgatagaaaacaattcacttataaacttataaaacctgttagggataaatgtggcttttgatattaaagtaaagtttgcctcaggattttttgtgtagaaaatttccacatgaggaaaaaaacctaatcttcattattggagcaatagagggttaaatttaaaccaattcacctcagcaaatcacactgtaggttcttgaactaaagaaaatattttcaccaatttctaaatatttactatttaaacatacagttcttacttggacaaaagaaattttttaatgagaagaagatttataaattatatctgactgagagtgttatatagaggacttactatttcatctgccaaataaactgttgagtagtcaaaatatgtgtgatttaaataccatagtatcaaacctaataccataagtattttgagaaaaataattgagacatggtacttatcatgagcttctcctgttttcccattttataaactagaacattgggtgacctcatgttttcaaatatacttataaaaaatttaaggccgggygtggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgmggcaggagaatggcgtgaacccgggaggcggagcttgcagtgagccgagatcccgccactgcactccagcctgggcgacagagcgagactccgtctcaaaaaaaaaaaaaaaaaaaaaaaaatttaaatatacacatacactagacaatggcataattgggaaatggcataaatgagaaaatgtggtttagaatattataggtagctacagtttattgtaaacaagcttagtagtaaatctagatttttaaagcttgaaacatatataatttaggggccacttttgagaaaagattacaaaaatatcttactattgcaaaggttactgaaaaagatatggcatgtggatacattgctagggtccacttctggagtctttggaaggatcctgggcaagagagcttaagcttcatcagcatcatggtacgttgcttatgctgatatcataaattaaaagtgtacaacttgagagcttctttacctagatggaataactttttgcattatggtaccatgatttaattatagattctttgcccttgtaacaactgacattaattagcaaacaacttgtgaagagtttaccttaaaatcagtccatttaaaatttggggatcccatgcctcattgcctcaaaactcatctctaaattaccaatgcaactgtttggtaaatcctcagatctgggtggatgttgaagggcaggttagaatctaaagaaaattgaggctgggtgtggtggctcatgcctgtaatcccagcgctttgggaggccaaggtgggtagatcacttgaggttgggagttcgagaccagtctgaccaacgtggagaaaccccatctctgctaaaaacacaaaattagccaggcatggtagcgcatgcctgtaatcccagctactcaggaggctgaggcaggagaattgcgtgaaactgggaggtggaggttgcagtgagctgagatcacaccattgcactccagcctgggcaataagagcgaaactctgtttcaaaaaaaaaaaaaaaagaaagaaaagaaagaaaggaaggaagaaaagaaaaaggaaaattgaatggcagattggaatctgaagagggtattaggattaggataaaagagcacatctatatgatttgctgtgtgaactttctaaagactcaagttttccctactttttcttaattatactttgtcatggttggactattttcagcgccttctctgtgttttccttatatagtatttttaccttctatttaattttgtcacctttaaacctgtacacttccttcatttccagtctttctctcaatccctcaccccacccttactttttagtcaatttttattaatcatcttccagttcttttttcttcttacccttcatcttcttttttaacttctgaccctttagttttctgttgggttcataaatgccattacctatcacccttatcatcactgcatgtctcttcaaacctcaccaataactcagctctgctttgtcttcttgactaagccagttatcagtgattgtactcatataaatctgacaaaggagtatttaaaaaatatttcttgaagattcaaaactaacagttttgttgcttttaagtcacttaaaaattctaaatgcacttgaagggcaaatgaaagagattctgacttttttggctaatattactttctgttttggttttatctaacaacagttatcaaaaaatrttactatacatactctgaagagcactatcctacaaaaggaattaagtcaacaatataaatgggacatgccccaatgcccagtgttgccagatctctgcaaagcataaacagagaaatacttatcaaaaaggaaagtataagaggatgacactctagcacagtccaccttatttgaaccgttttaggctttatctcctgttgaaagaggtaggaaacagtttggaggaataaagggcccattcttttctgtgctttaacatttcctactcatagtcaaaaattgatttattatatggccagtaaagtagaggtaagaaaagaagtgaataacataatagtttggaaagctttggaatttaagaaaggttaccttcctacaaatgtttcgtagttattttaaccagaggacaccttaatatagtccacagaacttggattttggtaaatttaaacatcaaatctgcattatatttgctatgttgggttgaacttggggtcagcttctatctgctgtcacacaatgcttacttttcagaattgctctgaggattagataagacaacatgtatttcctttatgccctatgtggaatttgataggtgtcataaaaagaaggcctcctgaccgaaatatttttcctgaccagaaagcyagtatttgaacccgctatagagtccccaattacaatgcagaagacatagagataagagggaatcccagtcttcatccccttcaaggtttttcctgactctctttgccttctgtgtctcacacctcagtttctgcctgacttggtgcttggacacagcttggttttgtgtatacacatagatcctttcatacttccttctcctggctcttcttgattcctatgaaaatgcttgtcccttttctttgaaggttcgacagattatgtgacttcactacccaaaattctatggcagcgtcccatctcactcaaactccccaaatcttcctgccacccatagrtacctcctttaccttgtctccttcactgtgtcttttacttatttatttccagcctctttggtctccctgctcttcctccattacacctgcaggagccctcctcggggcctttgcacttgctgtttcctctgtgaggggaaggggtagaaagggtaggagttgggggagggggatgcccttcccacagatatccatgtagctcaccgaaaacctttgtccaaaatgtcacctttccacagaggtttttctctcagcatctccattccctttcctgcttcagttttctttatgagcacttctatcatactatataacttgcttatgtactcatttttttattgcccttctccatcgcatttaaatgtaccttccaatttacatttacaaagggtagaaaatttacaaagggtattaaatttacaaaaggtagaaactttgtctgctggttgggtgcggtggctcacacctgtaatcccagcactttgggagggtgaggtgggtggattgcttgagctcaggagttcaggaccagcctggccaacaaggcaaaaccctatctctacaaaaatataaaaattaactgggcttagtggcgtgagtgtgtggtcccaactactcagaaggctgaggtgggaggatcacttgagcctggagatgaaggttgcagtgagcygagatcgcatgactgcactccagcctgggtgacagagtgagaccctgtctcaaaaaaaaaaaaaaaaaaaaagtaaagaaagaagaagaaactttctctgcctttctctgcttgttaactggtgtagtcccagagccttaaaaagtacttactattcaacaggtactcactatattctagttgaatgaatgaataaatttctagctcactgcctaggaatggaaaataattcaacctatagttttagagatatatagtatagataagagcatcatctttagagacagacagcctggattaaaatcatatctccagccagacgtggtagctcacatctataatcactttgggaggccgaggtgggtggattacctgaggttaggagttcaagaccagcctggctaacatggtgaaaccccgtctctactaaaaatacaaaaattagccaggcgtggtggcacacacctgtattactagctactcaggaggctgaggcaggagaattgcttgagcctgggagatggaggttgcagtgaactgaaatcgtgtcactgcactccagcctggccgacagagtgagactctgtctcaaaaaaaaaaaaaaaaaaaaaaaaaagaatcatgtctctatgatgaattacctgggtgaccttaggtaaattatatagtttctgtgtcccctcagtctcttcatctataaaatgagactaataatagtgcctacctcattagatttttgtgaggattaaataagttamtacatgtaacatgcagatgatggatttttgaccaccatttcctctgggcaagtacgtgctgtcatatgtagaggagacagtgaacagattgttactgtgtaggtgggtaaggccttttcaggcattgcaaagtaatttttgctatcacctttctcagctgctttgcttcttgtctagtcaccccaaaccccttttctgtccctctccccatatgtatatttcctgagagaaaaaaagattatggttgcgtgtcatagtaaactgggcaatgcaaccccattagcattgaggaataaggtaaactgaagtcttttttaactatctcctgagagccatacatagaaaatatacaaaagaaaaaagatttatgtgaccatacattttaagtcatctctgggaaagacttgctccttggcatttctttgggctaggtaaactgaattggatactgtgtgaactcattcatacatcagttttcttggctcacagtacagatttgtatactatttgatctttttaaattaccccatgccaactttaagcctgtactaagatttcatatagtaaaacattattttattcgggcacagctaatttaaagttacatatgtgcaacgctgaaatgtacctttgtactaaaagtttgataattacattaatagagtaaattacactgaagagatgtttcttaaatatcaaaaatgtccaaattaaagaacttccttctaaccactaaaactaccttggcattgatctgcttgcatttaaataatacgttaattacgaatggctcatattaaatttatcaaccaattcctggtgggtcctctacttgaaatcatgttcatataattaagagaaatacaatggcatttaaacaaaaaaaaacccaaaatatctatagttcaaccatggcactatcggataagtgattaggaatacaaactaaggttctctgaaatgggagtttatttgtttgttttttgtttgtttatctatgtttttcaagtcaatgatttcagcagatgaagtagcaccatgtttcaatcagcgaatatttaccaagcttcctgagccccactgtggtagagagatgcactgatggtgagacagcatgttcccttacaatgaaaactggatatgtgtcattatctttatgcaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacggtgggcattttctaccagataaatgcaaagattagatatcagaagtttttgagaagtgtaccattggacagcacttgtattgggttcccgtttataaatccatttagtttcttatctatcactaaaacaagcagttctatgtatttaaaggttttgctgatgaaaagtgaactgatctttccaagttattgcaacagacaatagaaggtatatactggtaaacgaccagagtatggtgttcaattctatagatcatgttaatagggaagttatactagagtcttttcaaaatgttctgggagagaagggtcaataatccatgttgtatgaaaaacaatttagaccactctaactcaagaggagatcagttaggaggttcctgcattccttgatacaacaggtggaattactgaagagagagtaaacctagtctgtgttcttcctgaggaaggaaccaagtactcccctgaataacagtgtttggtcagttaaaatggtttagatttatgtgytgagaagggaggccaaattagttggtctctggggacttttccaattgtaatatatggtgattcccttatttgcttctcaagaacctaaagataatagattccttgagtaaagtcagttattcttctacatcttggtgtgaaacaggtacacaggacaaagtacttggaacaagtagttgctggtgtcctttatattgaggtgtcatagcaatacatttacaagtgatatttgcttctttgggtgtctctaattgctcttgtgttttccaagttagatctaagcatcatcatccatctctctgagccatttctcaatacaacagtaaactgttctccagaaaacattatattcctccttattcagtaattagactttatttttatttacacagataaggtagaatagggcaggggtcctttccaacaagtggtaaagaaagtgaagtgatcaggtagacagcaaccacaaaaaacaaatgaagagtggcaatgataggaaagaatcacactcaagtcacaattattttaagcctaaagtcacagagttctttaagtattgctatttttgccttattaaaaaacctagtttttaaataccttctccattcttttaaagtgagtggcaaggtcctataaatcatgaattgaaaaatgacagaagaaattgtggccaactctttctgtttctttatcattttattttcagagatactctgatgaagacagatataggaagttttttttaacagctttctttctgttactccagatgaaggatgtaaatgttgaaaatgtgaatcagcasagaggagasaagagcatcttcaaaggaaaaagcccatctaaaataatgggaaaggaaaacttggaagctctgcaaagacctacgctccttcatctaayccatggaaaggtaaaggggcgtttagattccacaactttttctccaacttcatatttttcttcccttcagtagatattattttgaggtaatcacattgtaactacttttatggtaaatggaatttcttcaagaactaaagaacagaggttgtaaattaaatgtttccaaactgaatcaatgccctgagttcccttacatttactagccaatttgtttcctatttttctggaaatctttatagtggaatgaagtatttatttattgatgaaaggcattattaaaaggtaaatttctcatcaaattataagggattacaaacrtaatgtaacaaagcaagtcatcaaagcatgattggatgaattyaggaaaggagacaaattatgagactgaaatgatccaactgagattagtaatattgatttgttatgagattatcgatatctggctaaagtacaaggttaaagattttaaragggtatgacaagtctaaagtagagtttttttaaagcctttagaaattattttaaaactatgacatggaaaagccttttatatattaaaataatgattgaacactttataatatatatttgaaaatctgttttaaaaattctatgtgtgcattacttatggcttgattctagtcaattgaaatggtctaaataaatttggaattgagaaacaattgtgatcagttgattattaggcattacatatttgtgtttatgaaaattacagatagtgtgttgacatacataaaaatgtgtctaaagatgagagctcaattttaggaacaaaagcaggaaaacagaaagggaacattgagttataattccatacgtctctgaaatttcactttctaaattcaaaataaagaaaaactgatctttatatactgataaagtaatactttatttattttcaactgaagtatttgaaaacaaatactttggacatttcatatatgtatattgctaatcatgatgcacatttttatatgaagttctaaaaaggaactcacaagaagaaatcttgtgttttcacctcgcctacaaccaaatatgaatcactatcttcaagaatgctttctcttccttctttacttgtcaaaatacttgccatgtttctgactgctcacatgccatttctgtcataaagttcatacccttccagccagctggaaataaccatcactctttagaatgctcttagcactttgcagctcactcatgacccttatcactttgtttttggtcatttgtgttcattgctagattatgggtgttggatagaaaaaaatccaattcctctttgtatttcagcctctccccttcacctccatgcccttccactccctccttccccaaagcacccagaattatgccttgcactgaatattttatgaagccttctccgacatctttccaaacccctgggcctatttctgtcaaagcgtttatcacagtgtattgtcactctccttttatgtcttggctctccacattcagaataagtttctcatgggcagagttgtatctgtctattcagcaccttgctcataggggatactgaatatagatgcttctaaaataaaggataaacaaataagattatatggggctcaactgagttgaactttgataaaggttttacttattgtttacttaataatagctaaaatgaactaagcacttactgtgtgctaggtgctgactaaaggcattacacgaactgtctcttttattcttgtaatggccctgagcagtaagggctgccttatcaacctcttgtgatagatgaggaaccaaagttaagaaaagttaggaaatttgcctatggtcatacaactggcaggtggtggagttgggacttgaaatagagtctatgctcaaacttctatgcctactgtcttccagctggaaagtatttggagaaatgcctgcctctttggttgacttgtagtgttccttatttacatcatgagatcagttgacttatttgattttcttatggctcaactttgttaacaacaagaaatattgttattttcttctctgagcttccaatgtggcaagacacttgagttcatagatattatttgcatttataatcttactgacaaccaatcattttatagctcctttggtagcagctgagtacaaagtcttctgctacacacatgaaaggactcagtaccctcactgttcaaaggctgggatggaactgccacatcattattttaataactgcaatgggccaattctagaggagctatgatttgcgatgatttactgtaaccacaggttaaagtacatcattgtatctttcaagtatataataaaatatttgttggaaaaaacttaacaatgaggactaagaagccaacaggaagttttggccatgtcactgtcagaaagatcattacttaaattatcatttcagtttactatgagagaaattatggacaggcagagtaaggctatggacaggctattttcttagagagcattttctaccacaggctcaaattaagttgtgctcctgaagtttctgggatttcaaggatgctcatcagcatgtaatttttgtccttccagacctccccctgtctccctttcccatctgaggctctcatatttacattttaaaagagagtccattaaaatacttagatacatattcattgcacatcttcttttttccatgcccactcatcttccctacataagtgggcataactctagttttgtctacaaatcattaagttgtaaacgtgacagttatctgattacgttgattaatgctgacgagtgaaagatgcctcaagttataccatggattcttttttaggcctgaaatgctgctccaattaactggataattaccagatttccatttctggttttggctttgtgttgattaaattaaccacgtggctgctgagtcagacctttattttgtattgtttcygggcattgatttgctctctaaatcascatggctcttgtacacacactgaactgccacaagaaatgtgacaccttgaaagtccttctgaaatttgttgtatatttctttacttgtttgttctccagtgtgtcatttcctagccatgctctgtcttagatagatatcaaagataaaattactaatctttgtttgctgggattctttttattatttttattgtttggccacttaatggaatttagtctcctcttattcttaaaataaatataaaggaaggtgtggagaaaggcatcttcttcctaaggaaaaaacaatatgaatgatgcctacctatttcaagaggaaactggcccctcatatttggctggaagaggcactgtaccaccttcccagccattttacccagtctccctctagctgtggtttccttgggttaaagacttcgtttgtaaccaggtcatacctgctgctgctctttggaagctctgagtactgtaaatttagataagaacctgtgctcttggatgttcagaactaatttcattgctgaatgaagtaatcaactttatggcctgagtataataaaacttactcagttcctgttgtgaaataataaatttaagattattgctgtgacagccatgtggcttgaaatgcaaaattctgatttcagattattattttttaaatgattacaaggcagctcaattctaacagttttgacatttagctggtatggatatcagtactatcttcactttggatctcatcagtctacactaaagaaacagaatttaggccctagaagtagcagtcatataaaagaaaaagagatgtgttcatttttctagttctggggaagcaataaaaactaatagaaaggattaaaaaaacttttttcattgtgtytcacagtttatrtctatcattcagcctgccaggagggaaaaaaggctctaacaccattttctaagggatccagaggtcaagatcaaaacttgatccattgcagtgggtcagtaacagataagcactgaaccttatgcacagtccaaagattaaatccaagaactgggtttccttaccttttaggtaaaactttaaaaatagctcagatacattttgtagcctggaaggaaagtgacatagtggtgacaatactggtatttttcccacttaggagatcttgctttctaaagtatttaaggttcataccaaaaagacatgggccatatagacatgtgtgcattgccactgagtgaacacttctgactattttggggcaatctagttatgaacttctaatggtcatgatacctggagatacacttccaaatatttgaaaaggaaattacactgtgattattagaggaaggagatatagtttacaaaatagaacttcagaaactcaggcttgggtctgagatattgccagtgatttgtttgagaatatgatactgtgaattttcagacactgaggtcattattccagttcctttctaagtcggacaaacactattccaacatttataggttagtccagtctaatgactaaaactgattgccagataaagtacctagtaaatccatcactaggcagagtatatgtaggaagtaaaaatagagatttgagacacttgtttggataattcaggaaaagtattctcttcttctaaggcacaagataattttcatgtagactaaattactgagcttggtattatttggattcattgcatagctattgagctttatgttttactttagaagctatggttggttttaaagagtactaggaaggcattcaggatatttctggtagaaatgctcagctataattatcatagaccttgggaatttttacagggaacatgtatctatcctctatttctaaattgtgtgatgcatatcaagtctacagggtgaaaaccaacaagctgattttcattaaattcactttgtacttttatccttgtttcttaaacattagttaaattatcaaaatggcaaaagacacttatcatctctgtgcctataaatatcaaagatgataaaacaaaactaagtggcttactattcctgccaaatcatagtcaccctcctcatttcaacctcctttctctgccttctgatggtaacctcaaagcagtgcctggggcaggttatgcagcagtagcaatctcaacctcaaattttccagccttctgaatatatatatacacacatatatatatatgttcatatatatacacacatatatatatgttcatatatatacacacatatatatatgttcatatatatacacacatatatatatgttcatatatatacacacatatatatatgttcatatatatacacacatatatatatgttcatatatatacacacatatatatatgttcatatatatacacacatatatatatgttcatatatatacacacatatatatatgttcatatatatacacacatatatatgttcatatatatacacacatatatatatgttcatatatatacacacatatatatgttcatatatatacacacatatatatgttcatatatatattcatatatatatatattttttttttacccaataccaatataaatgctctggagggtggaaaacattgcccctgtgaaatgttgaccatgggtattatggccatgcctggggccttgcaatagcccataaaggctgtgccatctcaggaatctcaaaggtagtgattgccattttcgtccaagaacttttttatttgctattattttaaaccttagttattttttgtttcaagtacagttacaggtagagaacatgctgacatgttcaaacagaatkttcatcatttctcttccctgggccatccttgttttcatgaggctcccagcctatatcagtgctctctcccaatgctgtgcccatcatgcaagagccttcattatcggtctccctaaacttcatattctgatggtctcagagatttaaatagcttcttttcacaaaaaggaaattccagatttggagtgtcagatctctttctcccaggattaatacaggtaagaatctgaccttgcctgacacttatttaaatctgataaatgatgcatttttgctycatttgtgttctgttcccctctccccaccaggtcaaagagttctactcatatcaaartgaggcagtggccatagaaaatatcaagagaggyctggctagcctatttcagacacagttaagctctggaaccaccantgaggtacttaccaatattaataaggattcagcatctcaataaaatttgtaaggatttctacttayacaatttcagtagaagagttactactaaggtaatgctcagaaaagrtgacttgtgtagtgaagtcgcatttgcctatgaaacaattgccatttatcccaatgttttgttaattaattacaaggtagagaggattagaaatatttatactaaaggagcttcgtggggatcattccagtggttcccagatatcactgtgcaccactgtaccatggaggggcttgttacaaatatagattccctatattcatcccagagattctgattcagtagatcggggaggacccgaacgtctttttttttgagatggagtctcactctgtggcccaggctggagtgcaatggcgcaatctcggctcactgcaacctctgcctcccaggttcaagcgattctcctgcctcagcctcccaagtagctgggattacaggcgtgtgccaccatgcccggcttgtatttttagtagagacagggtttcaccatgttggccaggctggtcttgaactcctgacctcagatgatccacccgccttggcctcccaaagtgctgggattacaagcatgagccaccgcgcttggtcaaacatctgtattttaacagtctttgtggattatttggatgcattgtcaatgtagggaaccactggtctataccaacactgttcattttgcaaaagaagaaactagagaagttaggtggatcttccagtatcatacctggagtcaaggctggagtccaagtttcttagactgaattcaaccagcccatgagtgggtgaaaaatctgatggtagggttggaccaaaagaatgttggttagcttgctagaaaagagacctctgcttctgtgatgctggcagaggccccaggaaaaagctcagagaagctagacagagtctgtattgggatacatttgcctaaactcaaactgatgatgtagctaatgatgatttgagttaatcccagtggattttaattaatcccacaggattttaagaatttctaatcatgttcagctagttgaagttacacacacacacacacacacacacacaccacacacacacagaatctagatacagcattaacaatcaactcccttgccacagaattacccatttatccaaagtttcaattattaccaggccatttgtctaattttaattggatttcgagagaagtaggaaatcccacattatttgtgaaaaaaaatgagaaggcgctattaagacactcaaccaaagagaatgggagggaatcaatgagctaccagaaaccttgttcttgtctttgtatcttatcatcctgggggagaaaaaaagtcccctatggcctattagagacctcaattttcaagccacttctcactagaattcaaatggccyacaaggaatcccaagcattatgcccttgcctttctttttagrtagatatctctggaaattgyaaagtgacctaccaggctcatcaagacaaagtgatcaaaattaaggccttggattcatgcaaaatagcgaggtctggatttacgaccccaaatcaggtatgatagatgtcactttctttgaggcattaaaataattacattttgtagagactaatttaatgtaatagaaaaataaagtagaaatagaattttgaaacatttgtaatttttagtttaggctacaaattcacacatatgtaatgaatagacccatttcaattgttgtaggtgttagtaatgagggatgggtgtaatggggaagctgtttgtagactgaaagacagtttgctatttgacttgattcaataatttaaacgatgattacttgttataaagatggctatttatttatttaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatcatagagtatacatacacaaacctagatggcatagcctacactacattatatggtatagcctattgctcctaggctacaaacctgtatagcatgttgctgtactgcatactgtagacaattaaacacaatggtaagtttttgtgtatctagacatagaaaaagtcagcagaaaaatacagtataaaagatactatgtaggtgtacctttattcataaaaggtacataagtgaaatttgcagggctgaaagttgctctggatgaatcaccaaatgagcactgagtgaatgtcatagactaggacgttactgtacactactgtagactttataaacactgtacacttatgctacgctgaatttctaaaaaacttttttcctccatcataaattaaccttagcttactgtaatatttttacgttaaaaactttttaatttttgttaacttttgaastactctgtaataacacatagtttaaaacacattgtataggtgtacaaaaaatattttttctttaaatctttataagcttttttctatttttaaattttttatttttatttttttcttttaaaaatttctggttaaaaattaagacataagcatatatattagcctcggcctacacaaggtcaggatcatcaatatcactgtcttcctccagtggaaggcacttacaacctccaaatgttgtctcactgaaaggtcttcaggtgcaataacatacatagaactgtcacttcctctgataacaatgccttcttctggaatacctcctgaagaacctgcctgaggctgtcttacagttaatttttttaataagtagaagaagtacactgtaaaataataataaaatgtgtggtataataaacacagaaatcagtaataatcatttgtcaccattatcaagtattatgtattgtacgtaactgcacgtgctatacttttatataacagtagcacagtaggtgtgttaaccaccagcatcgacaaaaacacgtgagtaatgctttgcactgtgatgataggacagctatgatgtcactaggcaagaggaatgtttcagcttcataattttatgggaccacctttgtacatgggtccatcattgaccaaaatgtccttgtgcagcacatgactgtatttattgtgcttcctcatttcaactgtgagctccttgaaaatagtgattatatcttgttcatctttattttttacatcatctacaacaattcacggcacatggtaaataattactttttaaataaaattgtattaaaaatcaattatttattgaacaggttttaagttttaaaaagacaaactacttgattcattctagttcattttctaatttctctgtcaaatgtttttaatattaaggtaaaaaagtggtagcatttgtaatttttaagagtttttaaaaaaaattgttgttaaaaaacataaaaagttccgtagtgaagagatgtgacaaaatttttgatatgacttatgcaacttaaatatttaggcctgtttatcatttgaagaccattctctggacagaattgttctaacaggattaagaactagaatgttaaatcttagagtttctgttattttcagattttaattcagaaaacaatgttttctagcagtgaatgtgttataccttatgccattgcttctcaaaaaatttctctggagtagctgtaatattagcaccaaatagatgcaaaatagtagtaaaaatgcctgattaaaatgcttgaaattttatagaagtctcatctggaatagaattttgcattctacttcatatactactggtatatctatagtgttttattatattttcatataaaataaatattttaaataacttatcaggcctatgagatttccattgctatgtaacaaccccagatttagtggtataaaatgcaacaatcactgtactgttctctgtcataatttacaggcttgccttggccttgctaggcatctattatgtagtttcagacagtcaaactattcaaaggtggttcccccatgtatctggtgcatgggctggaaagactcaaacatctgaggctcctcatgcaactatctttatttccctgtcgcctctcagcattgcagcttcatgtcagacttcttatgtagtagctcaaggctccgaagcacatgtactgatagtgtgccagagaaaagctgaattctcttttaagacatagccttagagatcacacagtgttactttcagtctcctctattagttgaggcagtcacagagtcctacccaggttcaaggagagggatgtagaccctaccttttgatgacagacaggttctggaagagcatgtcagacaaaaatagagttgagactatttttggaaaataagattttctagctgtcttggttaataagtaacacgtggttgtattgacgatatcattttcagaaagctgggctaaattcaaaagagctgacattgcatatcttattcatcatccaggcaatttttcttccctgtatactgttgaaataatattttgaaaatgcaaacttaaattttcaaatcttttaatataattgttgctccagaaagacttcataatgagctttcagttacctctggagatatcacagtttgaaagacrtggctatatacaacttgaataaattactatcttgtttgccaaaagaatggcaattagtatcttgttcactcaaaagaatgattataatatagcatttccctttggtattatgcaggcagaaattagagctgaagacaaccgaagcaggcccaagattgatgtctggaaagcaggctgcagccataatcaaagcagttgattcaaagtacacggccattcccattgtggggcaggtcttccagagccastgtaaaggatgtccttctgtaagtgcagacaaatatgggaataatcatgacatcagactctgttttcattttgtctccagtgaaagcatcaactcattcaatgaagacagtttctaaagaactaccagctaccacagagttgtgatgacagcagtctcacaatatgcacctgacatagtgcatgacacatcaataattaacaaatagttaccattcattcctctcaaaaagtgttataactcaagggcagcctttaataagtcacatctagaattcagggaggatagagggcttaatgaagttagggggaagcatatggtgtcaagaatgtggacaacggctgaaccttgaaagttcwgtcacataatagttatttgtccacaggtgacatactttactggcctcagtgttctgattattgctgcaaggactgaaaaaggataccaggatctttgcctaaattaggaaacatttatttaccccagtttcccctacaattcctgtcagaaatgcgatatctcatccccagggcaaagtgtagatcattgtaacatttttaatccaacaaagaaaattttccttttattgcatgaatcagttatgatatacattcagagaaatgacttaccacccagmatttccttatctgtaatctcttgtcagaagagcaaaccattggcttcatgctctgtgtgtaactatagggagatgctctttccttcagtattactggtgttcagaaaagtgaaatcatcaagatgtaataccataatttgcttaaagtacaagacagtaattgcttattagtttctgaaattgagttagaggaaaaaggaaacattttaaaacacaaaatcatcattttcaaacattgtttcttcttttacctgttttttttttcatatgtcatttaatgttctaatgtaattttctaatgctgtatgagatggaaattatttaggaaggtggctaataaaactaawcttttcttatgctctgcactattaatttctctcccatagatattaaacattatgagccatctaagatttttgataattatttcttaattattatagaaaatgatttatttatgttattgaggaatttgcttttccaaatttggaattccaaattccaaatttgcttttgtaaattctattgcagccctttaaagtaaaacaaaaacaaaaacacctgaattcatattgatatgctctctgccttcagaaatgacccagtaaatctttagctaagtgcagctggaatttcacttggaatatcttcttaagattacatagytaaaaggcacttgaaaaagagaaaaaaaaggatccattgcttattaaaagtaatgaataatttaaaaactggcagcaagttattactatagagttagagagttagtagtcactgataggatttcataaaactaggggggaaagtagtaaagtatgaaaaataagttcttcagttagtttcaaagccgagagatgctgttaattagaactatttattaggttgttgcaaaagtaattgtggtttttgccattacttttgtgacaacctaatattatttttaaaaccrcaatagaataacttagtgtgtgtgagaattacctttatctaaatgctactctaaaaaacatagatataagaaatgaataattcagaccttagcaacagcaaaacattgaattttgtacaaataataaaataaagagagagaatagggagctcaccgaaaaattgattttcagtgaggtgcaggtaaattagaaacctgatgcaattcttcagcagttctcattattttatctctgaaatattttgctgttaattaaagttctgcacaatttaaattgcactatggtagtcaaagcctggcctcggataaattcccttggtgtagccgtgaaatgacctatatacccagaaaccagttaattattgccctaggatcttcaagctaaatatgaatagacaaaaacagtcctcctatagaggaatggttcacagagtggatggaagtcccaggggtatgatatgggcagggaactgtcatgtgtattgaggtaaggtacaaaaagctgctttcgcttcagacacaagggacattttattcctaggagaacaccctttgtaaatgtggatgttcacagttatgagtggggtatgagcctgcagtgtatgttttgcagctctcggagctctggcggtccacmaggaaatacctgcagcctgacaacctttccaaggcygaggctgtcagaaacttcctggccttcattcagcacctcaggactgcgaagaaagaagagatccttcaaatactaaagatggaaaataaggaagtattgtaagttccccaacctttgtgtggggttgtctgtcagaaacatttctggattgttggttttttgaagtaagaaagaccccttttaaaccaactgccccaccwccaaaacaattattttcttgtactacattttcatcgaaaagttatgccacagtgcagtaatttaatggtcacttgaccagaaatacaatagcagattttcagcagggactaggaataaacatgttgttgtgtttatgagtttaaatcaggactagattggtacatagataagtgaaggcaaggcttcgtcgtgacatcgtggggcatgtgctgcctcgctgtttttgaaattatgttcctcatgctgttaattgacacctgaacagatttgagttcatttaaaagaaaacaacaaaaagggtttgacttcttcagttgaaaatgtgatttcactaaacagccagttgaaactatgttttatgtaaaaaattgagaactgaggcgaatggtgaaaagaatctggagaaaataaatccatatgttacttaatatttggtgaaactatgatccattttacatgtgtaataaacagagttgacttaatttttccccaaaacattgcatctgtttctaaatagaatgtatttttagtctatcatacagaatttgtgtatatatacaaattgagcttatgataccaattatcctaattgatgatatagaacaaggcccaattaatttgacaaacagtgaaaaacagtcattaacataatcaaaagtggaaattagccaagttacacacacacacacagcagtagcagtcactgagttcaaagaactgaattccccaacaggaggaaaattgcagcttttttctgaaaagtctgtttatgctcaattgcatttatttacttgccttaaggacattaaaaaattgataggaattccaaatgactaatcaaagttggttattctcttcaaaaataaataaaccagaaattgaaaaagaagcaaaatcataaattatcaggctctgttttaattacagcatgttaaaatatattggtagagggacttgtcttaacattattttttatatttttaagattctttaaaaattttaccactctcaaagtacataggcattgtcttaacattaaaggcagacattactgagaataaaagtggaataattaggtattaatttagaatagagattacattaaaccttattagcattatctgtatcctaaaaatcttaaggcagcaataatttggaggactgcatgatgtattttctaaatcagattatttatacaatattgaaccatataacatgcaacacacatgtagtgtagtgtaatagaaaggatactaagatgaactaaaattggaaaatttagtttaaattctgacctccaacaacagtatatccttcaaggaagtcttttttttttttttttttttttttttttagacagtgtttcgctcttgttgcccaggctggagtgcaatggcgcaatcttggctcaccacaacctccaccttcagggttcaagcaattatcctgcctcagcctcccgaatagctgggattacaggcatgtgccaccacacccggctaattctgtatttttagtagagatggggtttttccatgttggtcaggctggtctcaaactcctgacctcaggtgatccacccgcctcggcctcccaaagtgctgggattacaggcgtgagccaccgcacatggccaaggaagtcttttatatttagcttctctgagcctcactttcaacatctgtaaaatagggataataattctttctatttattgtaggctagtgagaggcagggtggtggaatgtaacatttcccaaaaagcctatatgttgtatcctgtaatttgcaggaagttaacaggtatgcaaaaaggaaaagattctgtgagcaactgagtttgcaaaactggatgaaaccttgttaatttctctgttgcagaacttttcagtatctttaatcagataatattctggtaagttttgaatattttctaaaacacatgatcttgaaaatcccttttcttaaagcattttgtaagactagtgttaacatggaaaacactttgagaaacatcactataattaagaaaccatggactccagagtcagaaaaacctaggtttcaatcccagcaatgccatttaccatttaccagctatatgaccttgaacaaatgactaggtrtatctgcgtctgtttcctagcatgtacaggggaatattaatattaaactgacagagatgttcagtggattaaatgaggtggtagtattagtaacagctaatatttatcaatcacttactatatgtcaagcactcttctgaatgttttacagagataacataatttaatcctcccaacaatcctgaggtaaatactactttggcttcattttacagatgaagaacttagagattagacacataaaatttttagtacagtgcttgcacaatataaactcaataagtattatgtcttctagttatctaagcttaattcactagttttttgttatgatcaaaatagtacaagtatatcattttttaaaagtataaactactaagcacatgtcacattgtctggtgtgcttatataggggtagtatgtaatatttacatacatgtgttaattagtatgacaactatttttagaagttttaccatcccgggctcaaaaagccaaagatttttgatgactagaatatataactagagttttcctgtaggggttccattctgttcacacatattcattgtggttaaacatagaactatactatggtgtgtttttatttttaaaaagaggaaaacctttccccttggatttaaggttaaaggattttccatcaaataatactgctttagttcaattaggcacttctgaaataggtttgtttgcaaagctaattaaagaaagagaataaatttggggacccatagcttttatgtattactcatataggaaagaatttgaacttaatttataattgtatttatataatttttacttacaaatcgccaaattatacttggcttaggttaatatagtaaaattagtttgtatattctgagtatacattgtttgagtgagagagaggggcgttcaaggagaaaattaaaataaaatggggaggggtctttttgagaaagtcttaatcattttttcatttgttcaaattaaaaaaaaaatcacttcttgagaaaactcaaaycaatagaaactctgtgaatggtagagatttttaagtattccttcccctaaacattgatatccatgattatgcctttttttatagacctcagctggtggatgctgtcacctctgctcagacctcagactcattagaagccattttggactttttggatttcaaaagtgmcagcagcattatcctccaggagaggtttctctatgcctgtggatttgcttctcatcccaatgaagaactcctgagagccctcattgtaagtcaaatagaaaataaagaccctcaactcctataaaacttcttaagaatattaacagtaattaaaagtttcttagatctgaatgaaggctatcaactagagacttctgagtattcatattcaaattggggtattttctatccactaattattaactgtataataaattatttcagttagtgcctttttcgtaatttcagtaagtagtataaactatatggaaatttaaagattgtgttcacctatcatgttatatagcataggacagaatttcagaggggagaaatctagcttatgcttcagtaatcaattttacaagatttgttttgacttcaaaaattctcatgatatttaatacacctacattgaagagatacaattcttctgctgttaaagatttatgttgaaaacaaaagctagacttctcttgtgtccaagaatgttatctatttaattgcacttgtctacctatgatctagtggaatagttcataatctttatggaaaatgtacccattcagaatctgataaaagtgatgaggcccctttttactcatacataaaattttataaccctcacccctcctttttttttttttttttttgttcattgaccccatgaatccaatccataaatttccagggttaagaattccctgtaccacaggttaaaaatccctgaaaaggggattaactcttyaattcaaagctagatagcaaatgtgtaagtgtctcaaaagcaaaattctgagtttgcaatctagaaacataaaaatactttaccaagtatgtgtttattttttaactaaaagtgttccttggaaatatttaaatgtcttggtaacctattttatccctgtttggttaatagagtaagttcaaaggttctattggtagcagtgacatcagagaaactgttatgatcatcactgggacacttgtcagaaagttgtgtcagaatgaaggctgcaaactcwaagtaagtgcaaatccaatctcatgtattacatcattctacaccattgtccatttgatactcaccatgctgcctactattggcactcctaattctctttactctattctacttaccttatttgcatagcaatttttgccatctaacatatattaaaattcagtcatttattatgtttattgtatatttctatttcactagaatgtaagttccatgaagaaatggatctcagtttttttcaacaccaattgctcaccagttcccggtacatagataatatttaataaagacttgctaaaaagtgaatagtacaataacctccctacccatatactttattgagtgcccactatgtactcagttttaaatggtgtgtatgatatacttcttgttttcagagaaatattagactctaagtctatctcctagagtagaactttgtatatagtaagtgtggtttccagttttaagttttgatagtagaaatttagttacttttaatcacagagaactttatattttattttcaatttcatttgcctaaagcttttccacttgcctgagtggactatcaattttcacgtctttcttattaaaaagcaaaaagcaaaaacactttttaagtataactaaatatggaaaaccaaaatagattaatgtctaacacagtccatctttctataatgcaaataaagatgctaaatatataacaacatagtctttttttctgtccacattatacagccagtgtcccatcagcattttttctacctcagacagcactatatatcattttgcttactaagtgcttgctattaaaaatagtagggaaaatgttcttgaaaccaaatggtcccaaaagaggcaagccaaaactagaatatacattaagtatgaaaaagatcactaaaaacagtagtactgaaaaggcttgggtattaacttattaagttctggcagaaattaaatttattatttttatattagggaagcatgacttcttatatttttcaatttccataattatttkagtagctgatttacttcagctatttgtgtattaaatatcttggcaaaagataaaacccacatatcaaaagatctattcagcagtatttaatgagcatctactctgtactaggcatgatgctagtcctcaaataaaaagataaataaaatattctaccatcctcaaagaactcctagtctgtttatcaaatataaacaaataaataatattgaaatataaacaaagtgctcagacaatacagaagatgcagcaacgttttctgtttgagtgtgctcgagaagtttccaccaaaataacaatttttgcacttaatctagaagaggtttttaagtgaagaggtcaaagtatggaatgaaagacattctaggagacatacaataatgtatgaaaaggcccaaagtcaaaataggcctggtatggttgggaacagtgagaaattctgtggggttggaacataaaatatgtatgtttctgggggcagataagtgacagtggagacacaggaaagatgggaaaagagatggaaggtgagccagatcttcattaataacaagctaaggagtctggccttcattccacagaaagaagagaacagtgaagtctttaggcggatgaatgacatactcagattttttattaagaaagaagcaagatgttttgtggactgattgtttaactggattagagttagtgagatctgactggaagcatttgcaataacctaggcaagaattagtaaaggtctgaattaatgtaggggcagagggctgagaggagatagattcaagggccactttatttagtgactgataagatgtggaaaatgagaaagagataagaatccaggtgactctaaagctttcagttgaggttaccaggtgtatggtgatgccgaccacttaagtaaggtttatacagcctggttgggggtgggaggagagtagagctattagtttgttttggccatgttaagttcaaaatcctttgggtcaccaggctcagttgtccaacaggcaggtgtccacattcacctgcagctcaggagagaagttagggtcagaaatagagagtggctgaaaccttcaaagagactggggttacctaggaaagtcatgtagcataaggaaacagaacaaaggatcaaatttaaagttcttctgataatggacagcctggttctcatcacatctttaaaattaccttgaaggtagctgcaaaccatctactatcactggcattcaattttgttaatatttttgagcaaacattttttttcatctttgaggataataagatttggccatagtgaatttactacagaagaactgtagtaaaggttcagtttttcttttgaattttctgctgtgaaacactcatctacgttttgtccaaatcaaagatatatgaaagaaaggaaagaaaattatgtattgtattaaataagcacaaatttaaggtagctactgggcacactatatgcatgctgtgtaaaaggaacctgccattctgtgtagttctatagcctttcagaacttactaggataaaagctacagtcctgtgacagtctgaatggcagctagacaagtgcacaaccagtactatgccacatgtttctkttttatgtttgtcttttgcttatgttttgacctcccggcatcctaattccttattttcactgaatttgtacttgaaaaaatgtaaacctacagaaaagttgtaagaatagtacaattccatgaacacccagatatctttcatctagattcatcagttgttaacgtattttcatctttgctttatctctttctgtcttattttagttgaataatttgataataaattgcagacatctgacattttacctctaaatacttttacttcttattacttgagtgccattgcaactagtctcttacaatgaaaaaaatacatgtatttaccaaattgtgagttcccactgctatctctaattctaattctaattcaacactacagggttattttttccctcatttcatcattctattttccttcycccactgtgacaactgtggttttcgagaacaccaatatattgattcacctgctcaattctaaaacatacacaatatatttttggaattgccatactgatattactacagaaacaaactaaataaagttcaagacttttacagttctttttgtccttagaatatattccatcgcatgtacacaaagttctatgctcaaaagttacttggattaattctttttcattctcttctgtttagtcatattatcaagttgatagacatttagtttcatttgtttctggttaaactgaattttgataattttccatcctgttgatttaattttatttcttgaacatgtgaaatagtaatgtggttcaaaaggcagaactgtgttttaaaagtattaacagagaggtctcatcgcttctcgatgcttttcccccaatctcacctacttcctctaggtaaaaaaaatcactcattaaaaaaaatttttctttctatgtttctttttgcaacagtaaacagatgttcacacatttacatacttttttgcacaaaatatatcattctatacatactctttttgtatcttacatttttcacttaacaatatatcatgaaaatattccctacatagagatctttttcattccttttgacaactgcctagtactccattgtgtctatggactatgttttatttaatatctcctatgaatggtcatgtaagtggcttccactattttgctgttataaataatactgaagtgaataatctcaggcacagatttttgctattgttgagatgtagcttcagggatagagttgctggtcaaaaagcagttctgtttgtttttctcacattatcttccataggaattgtaccattttaggctttcatcagcaatttatgaaaaggcctatttccccatagtctcacctacaaaatatgttagcaaacttttgaatttttcaccaatttgatagttgagaaatgtcacttctctgattaagtgtgatgtttagcatctttccttctattgggagccttttgttaatacttctccactcttccccatatcatccattctccccaaccccatgtatgtgtgtgtgtgtgtgtgtgtgtrtgtgtgtgtstgtgtgtktrtktgtgcytgtagcctaatttcagaggttatgaatcctgtggatgaattagatcttaaaaccctttatttttaaaaaatttttcagcctagactctgtcatacaaagaatctttattttaaacatgaaactgaagcctctaaaacatatgtagtggcaaatataagaccagaacccagatgtccctatttctaatttgctttcccattaaactattaacttacactcaatccccctttttctcagactaggacaaaaggacttttctgattgtagaacatatttgaaaagtacctagtaaagtacctaccacataggaggtactgaggaaatattttttgaactatattgcagcattaattaaatttggaattaagtgaaaacaaacacttttaaaacatttagagccagactttatggttgaactctaagaggtctcacccaagttcttacttaaggaaaggtgtatggtgacactaagactccatctaattgttgctttagcaattcagtgaatgagcagttttttgaataaccaatcacaatgaaattaaaaagtggccttatatattcaaaatgtgttcaaaacaaaatatgcccattattgataatactcattgcttcttaagaatgtatatgtattttttttaaaaaaagcataacacctttatcaagctttacttgtttgcttttattccactgtgtgcctcagtcaagcaaccaatgcaaaactttgtaaaactgtaggttgctttcttggacccaagaataaagccagtctcacccaagtcttcttcaatgtatggtcatgcatatatctaaggtatatgatttttcaggcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtaaaatctccaagaatatttgcaacatttacagaagaaaaaaaaaaagcatgctgaacatgagtcaaatgcaaattccgctcaagtcactctgtattttccccaaatagtcttctctcctgcttaaaaataactcttaaattgcatttgcggctattctaaatatcctcacagggtaacgtcctatatctatatcctgaagcataaatattgaagcatattctcttattttaagaaacaaattcttttttgaaatatatttacttttataagttttaagatgctgttacatttttcaatactgaaatatcctggtttaagtataactttgtttgttactacaactacatttttcaggaagccatctaaattaaacctttgttagggcagagaatgtctataaatctcaagataaaccatctgccgagaatggtgtttccagtttatagctaagcaccttcccaccagttttgtgttgaagttggtggctgcaaatcatgatggttaggggcacaggcttttgagaaagacagacctacgtataaactctggctctgtccttccctggttgtttgttcttgggtgacttgtttaacatctacatatctgagagcaaagccaagatttgagggagttagtaaaaggtaaagggaaatgaaattaaagaaatatttataaatgcttagtatagatccttacacattgaatatcattaggcagttctaataatcaatgaagttacttgttgctatggaatgcaattattttggcacgttttcttcgatgctaatgttttgtttagaaaacaaaaggatcctaatgtaacctacagactttgggtaataatgaagtgccaggtagatttattgaatgtaagagatgtaccactgagggcattgttgatacaaggggtgattgtgcgtgtgtagggttaaaaggtgtgtgggaactctctgtactttccactcaattttgctgtgaacctaaactgctctttaaaaagtctattaattaaaaaaaagagagatgggaagattctgaggtacttcattgtaaggaaacattacttcatataactacctttccccagagccccatgccatgtagtatccttaaaattctatattagttaggtaacaccaggttatgctgcaataamaaatgtccctcaaaatctcagcaatgtgttaaaagtttatttctgagccaggcatggtggctcacgcctgtaatcccaacactttggaaggccgaggcgggtggatcacgaggtcaggaattcgagaccagactggccaacatagtgaaaccccatctctactaaaaatacaaaaatcagctgggcatggtggcacacgcctctagtcacagctacttgggaggctgaggcaggagaatcacttgaacctgggaagcggaggttgcagtgagccgagatcgtgccactgcactccagcctgggcaacaaagcgagactctgcctcaaaaaaaaaatgtttatttctcaggctatgcctaatgtgcataaggaagtatgtggtctgaagttcactacagtcatggaagaaagagatggagaaagccaccagctcttaayggcctcagcctagaagtgatcctcatagattctatccatggcgtattagccagaactagtcacgtggcccccaccaaatcacaaaggaatctgggaaatgtagtaacacatgtatatttttatgaacactcactattcctgctattcctgctgaaatgtccattttaaaaatctagatgtgcactaagtttgaacatcttatgaacaggtgaagaagaccttaaacagaatataccaccaaaaccgtaaagttcatgaaaagactgtgcrcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaakgtataatayattgcacatgtctctctgtgtattcaagcttatttgtgtgttcatggggtaccgatgtagctaataataatgatgtggtcattatgcagggttacgttgcataaaaccaaagagtgccagatttcccataatagggctatttagggggccagatgaaacaacttcactttggcactatgagtccatgactggtaactctgggtataatttttagtagggatgtcttgttcagtctggcaagtgtatattgccaaatgttttaaaagctaactgcattttcaacaggattttaaaaataagtacaacaaaacaaagtaaattcttaccaaatggttttcattgtaacatttcaagtgttaggaatttttgaagcctcatttatcacagatcaaataaatttcccatttaagtttaaaatcttaggcacggcccacatttcaaggtgattcaaaatttaaagagtgcaatcagtagagttcatcactctataactcttgctgaattaatttccttccagttaccaagtctgtcctcccaaatgcaaagtggctcccccaaggtgcctcctccctggaattagagggtcagagaaggaagtttcatttttcctgagttacatgcagaacactacccccacgaaagatcagatttaagcattcaccacagagattggaagggtggaaaataaagggaaagaaaatgaaaaaagacagcattaaaaggttgaaagaaagagaaacaaggactaagactgaaggaagacataagaaacgggtgtgagtagaacagagataagagcaggacattcaggaaagagcaatggagcaagtgagtgagaaaagaagccaaatctctctgcagccatgtatttctagttgaacgcatttagcttctccatttctttgtttgcttttatgagrccctgtgaaggagatcctgggtgtacttgctgccttcgtcttatggctctagcatttcagggacccggaaagaggagacagtggggtagagaacagactagaaattgtgaggaaaatatcaccaacattatggttcagagtctcagaaccaaaaacattagagtggggaggaacactaaaggctcccttgcttggtatctctccactgtagggctgtagtctcccagcaggtggtattcagactttgcttccctctcccgatgacaggaagctcaccatctttgagggaacttgtgccagtgttgttcagagactctcaccattatgtctttgtataatctgaaatcttcctattggctctggttttatcccaggagcaaagcaaaacacgtctagtcattcatccacaagaagaccctttgaatatctgaggatagctgtcataacccttctcatctttgcttctctaggctaaaatcttataacctagtgatattggaggggaaacctctcaggatgccattgcctcccctcaattattttctaccttagacctaggaccagatttctataattgattattttgatgttttgctatgttgtcataatgttgctattactgatatgattaatgttatgtaatcagaaatgaacatcttaacactaattacttagacaagatggacgcaatggggtaaggattaagacttactccagaggagacgatgatttctatatgggttttactgagctgtttctgtaattggaaacttcacagatatagaagaaatactggaaatgtactgttatatgtcattagtgagagagactattagggaatgcagaaaaacatttaaagaaatattgtgcaatctccccagtttggcacaattttcctttaagtgtatgcactattaaacaataaaaccatgacgaatcaaagaattttgccatgcctgaaatgtgtctactagtcaacttaagccacctcaaagctggacacccttgccttgctgtcattttgataccaaactaaatttcaaatatctgagtaatgaaggggctagccctaatcctgatgctaccacgccagctggcaccaccctggctcttggaaaggcatgaggaaaatttggcttcctcttttttccactgaggattttttttttccaaatttgacttgggaaacwgtcattacaatgaatgtgcagctttttttttcctcatatgttgcagcaaaattgtccgtcgagttctgaaggaaatggtcgctcacaattatgaccgtttctccaggagtggatcttcttctgcctacactggctacatagaacgtatgtacaccaaaaagaggttctccttccataccycacaacttagcattgctggaactgctattaaattacagttattgtgtgtcatcaggtagtccccgttcggcatctacttacagcctagacattctctactcgggttctggcattctaaggagaagtaacctgaacatctttcagtacattgggaaggctggtcttcacggtagccaggtaactcacttctcatggattttgctyaataaagtatgcaagaaatcaggctgaggtaaaataaaacatatatgctgtgggtaatgctatagaatgtataagttaatggtggcttctgtcatattttgcccatgatttccttatctgtaagaggctgtatggtttatagtcactcagagaaagtttcgaatwtgaacttgaaacctaagtaatttgatccattgaacttgacaaatgtccatttgtcttttcaaaggtgcacatattcacaaaactgaaattgtgccaatatttcttacataaacgtttaaaaataatattttatttttattcacagatatatttcttagcctcctctcacccccaagtatttaattmtagaatatattttccttttctggttgtttctatgaagagattgattccccataataaaacccttcataatagaatatgatgctctaaagagtcaatctgtatttctccaacactgctagaagagaaaagaataaaatgtaggcattcaacagctggctgacttccatccctttagtgttatccaaattgaggtgatggtctataaagacttcctaataatgacatgtactttctttttagtttttatgtacatgaaattattaccttgtaaatacagccatttaagtttttaaaatgatccaatgctataaaaacttgagtctttatcaatcttatattactataccttttggtagtactgtagtcagagtactatgcctttctgtcctgaggaatcacaatctgttttctgatatgtactttgaaatgcaaaacatccaggggttaaagggctgggtatggaggacagaaaatatgtaggattcctatttgttgtggaaataagtgtgttagccccctcatggtgtttatcgacttttttttttttttttggctagggagaaaagtttgacatggaatggggtgagtcatggcttagagaataccatgtcctcacatagcagcagccttagaatgactctgccaacacctttccatctacttttagatgctctgcaagacagctgatgcgttgtatatgacagtcctggaaagactaagagtctgtaggatgccatcataaaatagaaagctcatggttttcatagtcagacagaaggggtatgggtcccgcctctgacatttattagctgagtaaacttgaaaactttttttgcctcatctacaaaatgggtaatatcatatgtacttcaaagagtggttgtgaggattcaatgaaaaactaacccaccttatattcaggcacagaggtttttgtctgttttagtttttgtttttagctgttgcaaatatttaagtttttggccccttgagaagttctagctgcagctcagaagcttcaccattatttacagagcaggcagggagcttgcrtcatgaacattatattgattttatccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggtaattcattcagtctgtgagtatttattgagtccctaaaatacgccaggcacgttttaaatatgcttagttcttggaggatacaagacaaaattgtgcccatcttggagctcatattccaagcacttggccctcttggtattggtcccctttctcctttactatagatatgttataatttcatwtattagatgattaataagtgcctttaattggaggcaaagagaaaatgttgatgttaacagaaacaagaaagkttaggacacaacagaatagagctaccactgtctcctcacttggctctctcaggcacgagggcttaggtgatatttatcctgaaggcaggagctgaactatgtggccttataagtcactgatgacatttgtaatgacagagatgatgaagatgcatacagtgcatcattttgaccctgccaaattagtagaggcacaagcaaccacggccatgagccacatgcaagaaatcatgaagactctttgcccaaaattctcatgtatataaaatctcagaaagatgtgttcattcttagagtataggagtactttcattctctagagccacattcttcaaaatggttttcaattttttgtggcccgaaatcttatgatactgtaccaaaaaatgacaatactatctttgatgcagtaagatttaagtggccaagatactgtgggatggagatggtctgcctaattagattttctgaaaaacagaagagggttaatctgaataacctttgagtctgaatgtttggtgcttaaaatttttctttaatagtttgatttattttctgcttcactaagcatagcaacataaaaaatgatatatttgctaaataaaatcttatgaggaatcaaagtgatcactgtgtactctaattcatacttattatattgagaatatataaggagattgaaataaaaatttacagatgattggattgacttgtaaagtttactttattgttttaatacattaatggataatagcctacgtktgaattttgcctccgttaccttcttgctatgtgctcttgggcagttacttaatagccttaagccacaatttcatactagtaaaatgaggcacctggaacaggtggtctgaagattttatcagcttttttgtttgccagataatttgaggattctgatttgttaggttctggttatgaaatcatagattttaagggctgggagatatcttaggtattagactgtattaaaactcctccaaaagctcattatttgggattaaacagtgttaattttctatctttcttgttcctcatatcagctcaggatagctgtatataacaaaaacaaaaagcaatttagagtggcttaactaaatagtttcacttttatagtgtaacaaacatttggaagtasgtggtccagggttaatatggaaatcttaagatatcatcagaatccaagctgccttccttcagctcagccattcttacttgtgacttttgacctcatgcttgtcaccttgtgattatcagatggctgctccacttccagcaccacttcctcattccaagatggaagaagggaaggataagaggtcacagagtctgactctttttcaagaattgtttggaatccctgtctaggttttggaccaaaacggtgttacatggctatctctagctgagagagaagcttttgaacatagtttttcaatgggtgtctgaacaaaattgtttctgtcaatacaaatgtagaaaggacaaagagcagtgcgtcttgtatcccttaatcctcaagtcacacatkaaaaaaacagttctcaaattatatcagaattttacattgcacaattccagttttaatgaaagaatcgtctaaaggcagcataagtactgaaaaagtagtccacgttttaggacacagaggacagctcaacaccacctgtatgtgcttagctacccataaacaatgcctgaggatttgaatcggggtgtaaaaccatgaggagtaatctagatctgggtcagcaaacttgttctgtaaagggtagaaagtaaatattttacgctttgcaggccacatggtttctgttgcagccactcaattctgttactgtagagtgaagacagccatcagcaatacattaacaaatgagtatggctgtgttccaataaaattttatgtacaagaatagccagtgggccagacttgcctgctggccatagtttgccaatccctgatctagattawcttgtacagtttttctattcactaagctagggcagctaaggcaaggcatattctatgagaaagattgccccctagctattaaacatagcccagtgtctgtgtgtcaggttggagtatttggcagatctgaggttattatacaaattaagctgtctgaggccccctggctctgcagagcactccagtaatgccatcctagcttcagagacacataccactctaggtcaagtgctgacactgaaggaaatgttggcagtgggtagcccatcacagccaccagggcagatggaattactctgtgcttgctcacactttctctcttcagctaattggattactcttcagagaaagatgtctcataaagtcagtttaataaggggatcctctttagccagtaaagaacatatttccctaaatggaagcaacaggatgagttgtcaaaatgtcagcatctgagctataagaaacacttatgggaccaagaggatcaaagaggtcacattagctacaaagttctaatawctttttcctctagttcataggaaagaatctaaataaatatgcactctgggccaaacaaggacataaacctatgctctctctctctttttttttccttttttgcaatatttcttagaacaggctttcttgtacaccaggagacaaaagagaggtatgagtttgtgatagccatgaatattagtagaaaagtcttcacccaggccaggtgcagtggctcacgcctgtaatcccagcactttgggtggccaaggcaggtggatcccttgagctcagaagtttgagaccaggctgggcaacatggtgaaaccccagatctacaaaaaataaaaaaattagctgggcatagtggggtatgcctgtagtcccagctactcaggaggctgaggtgggggtgagaggattgcttgagcccagcaggttgaggctggtgtgacccatgatcacaccactgcactccagcccgggtgacagagcaagaccccatctcaaagaaagaaagaaaagaaatgtcttcaccctagagacaattggagtgtttattctggcttcatgtgtagcctctgagcctgatttttcctttcaatcttaagatataatgcctaccatggaatattggtatgaggattaaatgagacaccaaagctttgtagagctttgggcacacagtatgtgctcaaaacctgttagttctacttactttatactgcttaaaaattagcaccatgtggcttagtccctttcaaaaaggaaagagtgctttgtttttctacaggagtcagtggtttatctttataagggggtccaagaaaattcctctttgcacatgcattcttcttttgtccctttgtgtaaggaagtagaattttcccagaaatccaaggcactcctcataacccaccttgcaatggaaatgctctctccccacaaaaggtgcgttgtctaacagccatgaaatggccttttccatggcacttggtgtattttgccttccatttaatatatggttggtgggaaggccaagatccacatcacaggcctctgctggactgggtggatgaacaagattataattttcaaattaggaagagagaaaaagatgcaaagaaaggaatayttctgaggtgaggcacaccatagctttcatttggaaayaatcatgtttggagtacacatacagaactctcatattttggtcccatagttcacaggcataggtgaaaatgtgggcatgactattgtgttttcttcaggatagtttgtgtccatcacattagttataatgcctcaaacaaccccttcatcccatgcagccatattttgtcctatatcaaatgtctctttaagtatccttagrgctatctcctaatgtgtcctgarcatggcactgagaatctcatgcttccatcaaagagtgtccttcagactgaaagtagcttcatgccgcaaccgtacttttttaatacacctggttgtaaaccaagtcctttgcctggggtttcctgtgacctttttttggaaagtgaagagaactcagggagatcaacacaatccttgctagaaagttaaatcatggcagttatagctggcaaatgcatggcttgtttggtctgagtagggcagttacataaagaagttagtcatcctgccggttgccaggaatttaagatctttggaggaatatcaaaattaaggatactgagtctctttctcaaaatcattatcacttccaacactgtccccaggcaatctgattccaatccaactaaaaagttttgtgccaacatcacctcaactaatgtacatgaaaaaaaaatgcaagacttaaaggctaaatgcaggcaaacagcacaaaacaatgggtttcagacaaccacaaaatttgctcaggatgggccatgtttgtaaataattactgtccctatgaaaaatactattgagttcatgttgaacttgactattaactcagtgtcatttcaaatgtcaaacagcagggtattaggcttagttaaabttgccttcgttttctagttggatgtaggcaattcctggaacttgtatacagttggygtctctgtaaccgctggttcctcatcaaattcaaccaacctcagatcaaaaatatttggaaaaaaaacaccaaacaataaaatatagcaaaacgacagtatatattcatacaatttttaaaatacagcataacagcaacatagcatttacactgtattagrtattataagtaatctagagatgatttaaagtgtatgggaggatgggtgtaggttacatgcaaatactatgcctttttatataagggacttgagcacccttggattttgttatactcagggctgggcataggtagtcctataacaagttccccttggatactaacggacaaacacactccactgggagttttaaatcttgtctgttattttctagcaggatgcagttgactgtatttgccacagcacataactagagaagtgctgaaggacctcgagagatcacctgatccaaacctcctccccttacttccctggacaaaaagccacagctagatttctgatggagatgccttcattttccttagttcaaaagtttccaaatttaggtggatcagaatcatacaagggcttgttaaaacatagattgctagaccccatcctcagagtttctaatttagtaggtatgaaggggaacttataatctgtacttcaaaccagttcccaggcaatgctgatgctgttgttcacagaaacacactttgagaaccattgttcctttcaaagtgtagcaatgattgaaggaaaacatccttcttaaytggcacttcatcactctggtattttaattgactaattaatttagcaaatcaacagagtctacttccggtgcttaaaattaggacagcatgtttccaagcctagagaaagactccaacatcaacacaactcaaatggaattatctacagcaggaggtcaaatgtgccattggaaagggggttaactaaattgtacttattatttttataactattattatgcttttttcttctaggaacttcagttacaatctggactaaaagccaatatagaggtccagggtggtctagctattgatatttcaggtgcaatggagtttagcttgtggtatcgtgagtctaaaacccgagtgaaawataggtaagtgtttatgcattatacatttatgaattacatataagactatatacagagaacttccgaaatatgttttgggaattaatcttctgacttttcaaaatctatgctttctatttggaattataaaacgatagagttggaagtgatcataggaaattattctgtctatagcttcttatgagcaggtcagtacctaatatgactcagccaagaattttcctgcttttaaagacatacatagacaggatgccctgtgaatcagatggttcatcttcttttggtattccaccaagagaagaaatttcactttaaggtaaactttcctcttttgttgtcttcagtggggaaaaataaaatagataatttcatctgtgcagaaactaactattaaatgttaagagtccttaagtcttttcatcagcattcctttttctaaataaaatactctaagctcctttaatttttctaatctacctgtgagatttaatgaaagtgttttactttgaatataaaacaatgtctttgaactagtgtgaagatgaaaattattagccttctgttacagaatttttaaaaaggaaatagaaatgcaactaattttaattttttgatatttaaaaacacattcaggcaaaagtgagatatgtgataaaatcaaatttttgattcatcttgagctatggatgaaggaactgagagcaatcaaacagtagcacatttaatgtgaagtgtgacccacagtgttaccaaaaggaamcacagaatgaaaaatgacactggtcatcaaaaggttcacaatataacttagggcttcccacataatcagtcatctttcacctctttccaaagtactttctagacagaagtttttccaaatgaaatggaattgaattctttgcaaagagaaatcaacaacagcaacaacaacaaaaagtaatttggattttttwaaaaagtacacagtatccttaagaatctacccttatccatattgtaaccaatctgtcttccatttccacttgttcatttgaaaaaaatatcttttaaacctttgctgaatataggacatcagaaggtactctaagtgattcagggattaaaacgacctctgacctatttttacactgatcataacagcagcaggggttttaatttrcrcagcaaaaattaatattcctgtcaaaacataagggcataaaactctcatttaattgtgaaagcagtttctcacagtttgatttaaagtccacaattcaattacagtagaagtaagtcttctgttgaaattatttatcctcttcatcattatccagggcacattccccagccaatgcaatctgtttatccagttatctagagcatcattaaaggacccaccatwtttttcctcctaggacctactgtacatgccccactgtaagaatgattttttgtaacacaatattttttcaaatatcttggcaatcaagggcttacgcctctagagactctttggagaaggtaatgaaatggaattaaaatagctgcctagaagccaacagagagatagttaacaaaaaactataagcatcgattgtcttcttggtgagtttagactccattttaatataacttgggtatttctgacctgctgagaggactgggttccaagaatgttttcattttggtctttgttatgcccatacaaaacaatgtagtatcttacagacactccccacatctgcaactgaaggcaggggagagctcaggggaagggcaaaccttccctgcccaatatctgagactcaccaggccctggttaccagcagaactctaagcacatccaggtcacctctgaatcccttaagtgtttccttccagtcactggcatcatacgttcagaccctgtaaagttacagctgttagtccaatwccattaaatataatatgaacaagttttttctttttttctcaaatgtttagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggtaagatgcagcgttcaggtcatgttccaggaccatccccagtgcaccaggaacttgcattcagtttagaacattcagtttcagaattaaaacraaacagtagaaacccagggaaagatgaattttctttaaatgagtagaagaataattgataaggccaaaaaaagtcagtttctgggataccaaaaaraaatctaatgactagttcatttgattctggagatagttatcatattctaatccagaaacaatttatccaggaaagaaaggcctatgatttaccataggagttgccacatagtttcataaaaaaaatcagatacacatttactgtctggtatcttcacaataaactgctggacaaaagatttcaaataaaacacctggcaatccatttaccatgtttaagggccaaaatgaattcgcaatttttaagtattccatatagcagcaacttgaccctgtttaagttttggctcaagtttcagagtttgggattctgaatttttttaaataatgcttttggtaaaatagttagtgttttaaaatacaaagatataatttccatgtaacatttgtgctgtgtcatttgaattttgtaaccattatttgtaacaatactatcacatagagctagaatgccttgagtctaggtagcactgaccctttcataatagttgacctacggtaagcataagggtcatttgtacagttaaaacagcaagccacatcttacatcatctccttttttaagtaggccaaaattgagcaccttcattattttactgacatttcatgattcatattaaaaaacgcattgattatataaaagtaaacgagtcagttgtattttcagagaataaaagattgtgctttatagttaaactattaagctgtcactaacttacattaagtkatatctagaatgaacctccacaaatgcattttaaaaaccccaaccttctaatggttgaaatgcagtgaccaccaacccacccacatgattaattggtttggttccacatttgccttgggcsagagctcttagaatgtttctctgtccgcattctctgcttaaatccagctgggcttgcctgttactcaaaaggagagtgctcccaaggtggggcttctggaatgaagggtgagacacagcacagcctgcaaagcttaatggcatcaccaaaaagctgaaatgaatttagtctttcattctagaaaaatgtatggcaggactcccatatcccaggcatttgaagtgtttctgttgatataaaaagaaatgagaagaaaatcacccattcatggagtagcctttgacactcatatcctttctcagattgctttggaacagaarcttcaagtacattcagtaacttggctggagaggtatagggtgacttaactgtgtgtgtaattctgttattgttgctgttgttgtacaggcaatttgagwaaaagtacgaaaggctgtccacaggcagaggttatgtctctcagaaaagaaaagaaagcgtattagcakgatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaagtaagacacaaacaaaccattttttttctctttttttggagttgggggcccagggagaagggacaagrcttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtscttattttccactaaacacagacacatgaaatgaaagtttagctagcccactatttgttgtaaattgaaaacgaagtgtgataaaataaatatgtagaaatcatattgaattccttttgtcttttgttacttccaacaccatatttctcattcctgccactttctgagcctagacacatacacagttaagcctctgcagcaatacaggtcaggccaggttctctagatgggagaccagacccatttgaaaaatgggccactgaaaatatcagcagtcagaacctcttaaggacgtgtgagcttgaaaacatgccataaccccagttttcataaagctctggactggcccctttactgtcatgttactaaaaaggaagaaaggaatcagaaactaaggtggtgggtggagcatggtatgtggtagcatcagccttggggaaaccactctgtaaagatgctgacgtcgcagggaaagtgagttggtctagggtactaagctgaagatgttgtggactcaggcgcttcagccctgtgaggtttaacaaatcacagccacctctgcaaaatgtaatcatttacttaacaatgatgactgtggtgctctgaatgttagtgttttgccatttcccaactgtttactgggctgctgagccaagtatctgcccacccagtggagaatggatgatcctgagcaactctaacatgctccaaagaaacaagaaagcagcagcataggacaaacagtaactcctttgtagataaacaagacagaaaatgaagaggggtagagtgatagtccacatttggaaataagatattggagccagaaaaataactttaaacctcatttgcagtcctctagttctgactacttctccattataaatgccagcatacagacacatttgtcttctgaaaagacatctatttgggaattgtatagccccctaatgtgaatctccaggcctctgtccagtcagatctttcctgcaagctttaagattagcgtggcttcttttcttctgtgaagtgttattgtcattccctggctcatgttgcagtcctgcctgtgacaagttgctccctgcttctctaaactgaccaccttcaagtaagtgttaaagctaacacttactgagtgcctattatatgcgaggtattttaaagccttttccgtacattaatttaatcttcataaaaactatatttaataggtagcattatttccatatgatagatcagcactaagagaaatataatatgagtcacataagcaatttggaatttctagtagccacattaaaaatgtaaaccaaaacaggcgaagtaaactgtaataatatattttatttaacccaaaatatccaaagtattatcgtatcaatatataagtaacataaaaattattaatgggaagctttacttttgtggggaagattaggtcttcaaaatgtggtatatatcttgtatataaagcacatttcagtttggatgagacacatttcaagtgttcagtagatgcatgtggctagaagctgctgtattgaatagtacaatattgggcacacaagacatttaatttgccccacagaagacactttctcacttagaaagtgaaagaaccaggactcaaatatgagtagtttcacctcagaacctgctctctgaacccattataggatgtttcccacatgcttttggttttaaagatttgctgccaaacgaatacagacagtaggttatgaaaatgagaaacatgtgacagcagcaataaagctaagagttgttgccctttctttttttttgagacagagtcttgctcggtcgcccaggctgcagtgcagcggcgcaatctcagctcactgcaacctcttcctcccaggttcatgccattctcccgcctcagcctcccgagtagcagggactgcaggcgcccgccatcatgcctggctaattttttgtgtttttagtagagacagggtctcaccgtgttagccaggatggtcttgatctcctgacctcgtgatctgcctgccttggcctcccaaagtgctgggattactggtgtaagccactgcgcccggcggacttgttgccctttctctgtggtcgttcagtctcctcctctgatggaatcagaagcccaccataatcaattgtagaacgcatccatcattccaaaaagaaacctgtacactttagctatcacttccaatgtacccatctcccagccctaggaaatcactagcctactttctgtgcctagattcattgtggacaattcatataaatgcactcatatatactatgtagtcttttgtgactggcttctttcacttagcattgtgttttcaagtttcgtacacgttgtagcatgtatgagcactttattcttttttatggtcaaataatattgcactatacagttatgccatgtgtttatccattcattagttaatggacatttggtttgtttccaccttctggatattatgaataattccgctatgaacatttgtgtacaaactttttggtgggcatgtgtttacatttctttatacttagcagtacaattggtgactcaaatggtaacactatatttaactttttgagaactgccagaattttctccaatgtaactgaaccattttacattcccaccagcagtgtataagggttctgatatttccacattctcaccaacacttattaatatacttctttttgattatagtcatcctagtgggtgtgaagttagcactatatttcgaataaataaaaaaatgtatttggctgggtatggcggcccacacctgtaatcccagcactttgggaggccaaggtgggatgattgcttgaggccaggagtttgagaccagcctgagtaacataggaagaccctcatctctacaaaaaataaataaataaaaaaattagctgggcttggtggcacatgcctgtagtcccacctactctgaggctgaggtcggggaatcgctcaagcccaggatgttgaggctgcagtgagtcgtgatggtgctaatgcactctagcctgaatgacagagcgagaccctgtctcaaaaaagaaaaaaaaagattcaagtccttgccctttttaaagttgaatatttttccttttatttttgaattgcaagaattagttatatattttcagtgtaagtcccttatcacatacataatttgcaaaaatcttctctcattctgttggtgtcttcactttcttgataacggcctttgaagtacaagagtttgtaattttgctgagatacaatttatctctactttttcttttttgtttgtttgttcttttggtgtcatatctaagaaaccattgccaaatccaaagtcacaaagatttaacactatgttttcttttaagaacttcatattttagctgttaaattagtccatcatggttaattttttatatagtgagaagtagaggatcaaaatttattcctttgtgtatggatttccagttgtcccatcattgactgttgaagaaacaactctgtccccattgaattattttggcatccacaaacatgaaggctcatttctggactgttagttttattccattaatctctatgttgatctttatgctagtaccgcactgccttgattactgttgctttgtagtaagttttgtacttgtgaagtgtgaatcgcatattttgttctttttaaagattgttttggcaattctgagtcccttaagttttcatatgaattttaggattagcctgtcaatttccacaaagccagcttggattcaaatggagattgtgttgaacctgtgcatcaaaaattaattatattgtctccaggtccatgaacacgaaacatctttccatttatacacatcttgaatttctttcaacagtgttttgtaattttcagagtataagctttgcacttttttcgttaaatttatttcaaatgttttattctttttgatgctattctgaacacatttgttttgtttcattttttcattgttcattgcaagtatataaaaatatagtttttttttgtataatatattgctcctgtaaaaacaaattatgttgcaacactgctgacctcatttattcattctatatcttttggtaatagattctttagaattttctatgtaaagaataatgtcatttttgaatagacatagttttacttctttctttcccatctgaatgtttttctttttttattttcttgactaattgccctggcaagaacctccagcacaatcttgaatagaagtggtgagagtggacatagcaaagatgataatgctggtgaaaaatgtggtggtggtgacagcagtgacagacactaataaccacgggacatgaaaggaaggcccaaattgtttggcagtagctctagttctattttcactaagtaatatacagttgttccttggtatctgtgggggattggttccaggacccctgtgggtactaaaatctgtggatgctcaatcccttatataatggcatagtatttgcatataaactacacacatgcttgagtatactttaaagcatctctagattacttataatacctaatacaatgtctaaacatcacttcattcacatggcttcaacttagtagtcaatgtggggcaaattcaagttttgctttttgaaactttatgaaatttttcttccgtatatttttgattctcagttagttgaatctatccatagatggagaactcatgcatatgaagtattgtaagttctgctgtgcttgaaaattaataaaagcttatttgaacgtttaaaacactttcaagatagtctagatgtctgactgcacagagaagagatacacaacttgaggtgcctgtaccagcactaaggatatgtttgagattcagattggttgaagcttcagtgttgtcaacttagtcaacttcctcccctagaaggaagcggggagagaaagggaataggacagggaggcctggcttagaaatccagttccactacctgctggatcttggacatgggattcaacctatctgccatttccaaaatgggtattataatctttatttcattgtgttgttttaaggattcatggagataatgcatgtaaagcatactgcccagcacatacttggtagcatttggttaatgtttttaattttggagatgtagtgagcaatatcttataactgatcagttttaataaaaaggagtttgtttgcactttatttctacctcttccttacaggtagttggagagcatagtagtaattttctctctaactctccagaattggtgcagaatggcatgaaaacctttcccatgcagcatccaggaaggtaggaggcaggggattgcagcagtgaggagatttggagtaagatactcctgcatacgtgaaatctcacctcttcttcttactactgctacataaaccttcaagcctctcagcttctacattgggaaaatgagcagcacctcataggttgttgtgaggatgaagtaaggtaataagcaagttcctggcgcataacaagcatttaataagtactcattaatactaacttttcatgtgcagtcttatacaatttctgagtaaagcaacattttatgttttgactcaatggagtgaatctattttctggacattcatccatgaacatcataagttttggaatggctaccagttttgtttatttatcatgaaaacactactttcacattataaaaaattattcctccattttgtaaaaacatgactttcatccatttctctgcatacctaaattgacctgagatttcactgatcctttctttaccatttttctttgcttttgtcctctgtaaatatgataattaccaagagtaaaagaataagtcttttcactagggggcatggaatgaatttaaaattcatccacaaaataagaaagttctagtagaaagtttttggagaaaatcttaagagaactctacatcataaataaaatggataggatttttgagaggaaagaaaataccagaagacaccactccagctcagtcattcttgtttaggacttgagcagaatgtcata

SEQ ID NO: 17769 - DNA, 53323 bp, Homo sapiens
tctatatataagatcatgttgtctgaaatcatagacaagttcttgtgatttggatgtcttttatttctttctcttgcccaattactctggcttggatttccagtactgtgctgcatagaagtggcaaaagtgaatatccttgccttgctcctgatcttacaggaaaagctttcaacctttcactattgactataatgttagctgtgggcttatgtatatggcctttattttgttgaagttactttctttccacacctgagggtattattccttcctattgcctgagggcactattccttctttaccaattgttatcataaaattatggtaaaatttgtcaaatgctttttctgcatatattgagatgattatatggcttttgtccttcattctgctaatgtgtgtatcacatttatagattttcttatgttgaaccatccttgcatcccaggggtaaattacacatgatcatggtgaataatccttttaatgtgatgttgttgctttgtagttactgtgagacttagataaaacatataatagttataacaggctattttaagctgataaaatttaacttcaaggataaaaaaactccacacttttactctccctccacattttataggtttttaatatttttcagactttatgtttttgatgttataatttacatcttttatattgtgtatctgttaacttattgtggttataattatttttaatagttttgtcttttaaccttcattctaaagatataagtgatttatacagcacaattataatattggaaaattctgaatttgactgtatttttatttttacctgtgacttttatactttcgtagattttcatgtaattaattaacatccctttctttcagcttgaagaattccctttaacatttcttgtaaggcaggtctcgtgttgatgaactacctcagcttttatttgtttgggaaagtctttatctcttctttatttctgaaggatgggactcttggttggcagttttttctctttcaacactttgaatatatcatctcactctctctgggcctagaagcattctgctgagaaatcttgtgatagccttattgcaattcttgtctgtgatatgcttcttttctcttgctgattttaggatcctgtctttgtctttgatttttgatagtttgattattatgtcttggtgtagtcttttttggattgaacctgactggagatttttaagcttcctgtacctgaatattaatattttatttcagatttgggaaattttcagctagcaatctttaaatatgctttctgacccccttttcctctattttctccttcttaaactactgtaatgtgaacattagctctcttttttaatttttaatttaatttttgtttttattttttgagatgcagtctcactctgtcacccaggctggagtgcagtggcatgatctcagctcactgcaacctttgccttctaggttgaagagattctgctgcctcagtctccccagtagctgggattacaggcatgtgccacaatccctggctaatttttttgtatttttagtagagactgggtttcaccatgttggtcaggctggtcttgactcctgacctcaggtgatccactcaccttggcctcccaaagcgctgggattatggcatgagccactgagtctggctgaatgttagctctcttgatgctgtcccataaatcttgtaggctttcatcatttcttttcattcttttttctcctctcactgtatattttcaaaaacctgtcttcagttcacagattctttcttctgcttgatcaagtctgctactggtgatttctactgcatttctcacttcattcattatatttttcagctccaatttcttttatgatttcaatctttctgttacatttcttatgttgtgcatttattgtttctctgatttcaccaaattgtttctctgtgtttgcttcaaagtaactgagcttctttaaaaacaattatcttgaatccattgtcaggccatttgtagtactccatttcttttgggtcagctactgggaaattattgtgtttcttaggtggtgatattttaatttgggttttcatgtttcttgctgccttacactgctgtctgagcatctggtggatctgccccaatttcaggctgtatgggctgactttggtggagaaataccttcttatgtggaataatgcgaggatgctggctgggtgggatgcaaaagttctgacttcagtaggggcaaagctgtgtggtctccatgcagatctgtcagctgaggttggtgttagtgaatactacagggatccttagaggccaacactgtgggtatctacagtggcaatgaggctgttgaggttttcaattgtgacaagtcctccatatctctttttttccccacctgggaagtcatgactgaggacatccctcttggaattaggtctaacttgcaggcctgctcctggtggtggtgacactggtgtctgatgaacagtgcccatggagtggccaagagccaaggcctgaagcatgggcatgcatggagggaccacagcaccagattcaattgtagcaatggtaccagtgcccaaggcacaggcatacttactatcacattgataatggtgtgtaaaatgcaggtacttataaagcagctaaggagccagggactttactgcatgcatacgcagagctacagtggctccaggatccagggtgtgggctagctctccttggtggctgagctggtgactagagcatggacaggcacagagaaaccttgactctaggacccagggtgttcactagctcactatagtggtggctctggtgttggaggtgtgggtgtgtgtagtacagcctcagagacagggtctggagcgcaggtgtgcacattactacagcagctctggagttgagaatatgggttacctttctacagtggctgaactagtgtctggagcaaagactttcacagagagaacttggcttggggttccagggtgagatctagttcacaacagcagtgactccagtgtctgagacatgaggaggtgcactgcagccacagagccacagtccagagtgtgaatatctgtagagcagccacaacttttggggatcaggaacacacatagacttgtgagaggtggtaaccctggccccagtcctggggcagtgcaacaatagctgcttcttggtgagggggtgtgaggggtagtgcaactgtgtttccctttttagcatcctgctatgggaatggctgttggacaaaagatgccagtgtcctctgtggagcaggacactgggggcctcagtggctctgtgtcacatgactgacacagatagcctacaaatttctttattcgtagctatctcctggtgtctcatatatgccagtctcaccggtgattcttctacatggatattctttcttttctccattgtgttgttccaaattctttaacaggctcttgagccccatcccccaactccccacccttgtgagggctattttggtttgtgtataactgtctatgtttgtttttttgttggggcataaggctgacatctcctactccaccatcttgctaatgtcacctgcataggaatctttttatgctttccttatattcactaaaatttaacaatatcaaacttaaaaacatatgatcaattgaacttattaatatcaaacttattataaataagaaactaccaggctgggcatggtggctcatgcctgtaatcccaacattttgggaggctgaggtgaaaggatcacttgagcccaggaattcaagaccagcctgggaaatatagagagaccctatctctagagatttttttttttaattagccagtagtgatggcacacatctatagtcccagctactcaggaggctgaggtgggagaattgcttgagcccaggaggtcaaggctggagcaagcagtaatcatgccactgcactccagcctgggccgcagagtgagaccctgtctcaaaaaaagaacctactagtctacataccacacttcctcatccccatctgagactatatatattttttctaacatgaggcaatgccaaaaagaggrgctggtgagtgaaagtaagaacagaaagacatggaggcaagtcttatagaataatagccaacacttaaacttacacttaacagcgtgataggtattgttccaaacacattaaattcatttaatggtccttacatgtctatgtatttggtgaytattatccttattattcacattgctgagtgtattattctgttctcatgatgctgatagagacatacccgagactggataacttattaaaaaaaaaaaggtttaatggactcacagttccacgtggatggggagtcctcacaatcatggtagaaagcaaaagacacgtcttacatggcagcagggaagagagagaaatgagaaccaaacaaaaggggtttccccttataaaaccatcagctctcatgcgacttattcactaccatgagaacagtatgggggaaaccacccccatgattcaatgatctaccaggtgcctcccacaacctgtgggaattatgggagctacaattccagatgagatttgggtggggacacagccaaaccacatcactgaggaaactgagttatagggagattagtaacgcccaacacagctggtaggtggtggagccaggcagtctgactctagggtctggactctgaactgcatcatgctgccaagaagttcctcattttttcctctctctaagtttcccttattcccctacagtcattccttcaacagcatttccttcaccatcttttctacttctactatataattaattttttcttcttggtcccaaattccaacgtgcaaatgcagccttatataccctaattcatctttacctttagactttcttccaatgtttctacttcattccattttaaatttatccatgagatgcctatttacaagctgtaaccatcatgaagtgaatgaagaataatacctactactgtacaatagaattccaagagtataaataggagttatggctttctgacttgaaactaaatacttgatacttgattttgctgtctgagatcaatctgaaaagtaataataatcactaacatttgttgagcatcaattgtgggccaagtgtcatttcaatcactctgtacatattaactcatttcatcctacaacaacccggtgaggcaagttctgttattctgttttacagttgaggaaacagaggcatagagagcttaagtagtttgcccagtagatagccagaagaggagccaggatgggtctcgggcagtttaacagcacagctgaagtcttaaccactatgccaacagctttttggtcctacacatcccatgggaagaggaaaataaaaaggtatctatttgtatacctttttatttctgatataagaagcagaattcctttcacatgacctatgtctatttaatacgtcattttgaaacttaccaataaaatttcccaagcgccagaaaactgttagtggctttttccatttctctctatttttttttgtgctactaattttgcttctttccctcagaaggctgccggaatagtaaacattcactgacatgtcataattactggaaaatgggcactggaaaatcacattgtaattaattcaaagcatgttttccaaatgtactactttaaattggagcttatatcataatccaaggaaacctttgtgtgtgtactgttcccacattgctcagcctgggatatccaggagtaattcaccttgcgcctgcctccagaccatcttccatggaagggggtgaccccttgcctcttggcaaccactatttctaagctgccaacattactcttgcattatcaacattctaacttcatgggaagggctgtggtgagtttctggaatgtgaataggaagttgtttttctaaacagcctgacactgaggggaggcagtgagactgtaagcagtctgggttgggcagaaggcagaaaaccagcagagtcacagaggagatggtgagtttatttttttctgcatgggaagtggttgaagtgagttgragtggtatggrgtaaagtcaggcaggtaaaggttcagaaagtgaggaacagcgatagccatggagttttatgttgaattgcctattagattttgtgagtacttttaaacttgctgtccactttgaccctcccaacacccttgtgagttgaggttgctatttctattttacaaataaagccatcgtggtttacagaggctgtgttttatctaagcttcactgttaggctacatgatgttgggatctggggcctgtcctctggctccgcagstgctgttcctcctactagaatttataggggmtctctgagaatagatcatggtaaacctgtcaccccattttccaagactgtacttctctctgggataaatgatggaataaatggaagactgggtaggtgccctgggacaagcttacaattgaatagtttctcatccccatccctcccatttctttctgtgagcctatgaatcttctgggactgatctggaatatccacatagtttccttttctgccctaagactcaatcttgttaatgactcagtttcttcttctataaaatggatatagtaataatactctatagtttcatcatgaggattaaataagattttgctgaaaagcatccagatctgagcctgacacatagtaagtgattagtaaatgttagccattattgttacaataaaaagaaaattcttaggaatagtggggtttaggattcagggaagatccaaggatagctaggcattttgaactcagcaatgttatatgctcatggataagatgcacgtggttaggctacttctaattcagggaagatccaaggatagctaggcattttgaactcagcaatgttatatgcacctagataaaatgcacatggttaagctacttccaattttcctcagactttccaagagtatcccacatagtcccagggtccgaaatcctgcagtctgtggctatggaggaaccaggcaggtctctgtttttgagcacctttctgtgggactccagaaaaaagtaccgcatacacctgattcatcctactgctttgctttactatagcacacttttcaagtacttataatgtgggtttctgtgttggggaaaacaggaataagagtatgataaagagaagaggaaggagtttgagcctgtcttaagtttgaaccacaatgacctaaggatatgaattacttttgtcctgtctttttgcatgtcatacttctgaattggttaacttaaatgagcagttattcctctcttccttctactctccttggcatcctcctctatttcaaaggtatgaacttattggatcagagagttctttgagattttgatgaaagttacaacttgtctttcccagatgaaagcaaaaacatcgacataaacaccaacctttagagacaaccacaggaggttcccagacctccatgtggatcccagggtaagaacccttctcgattgcctsctgggctttatgttcagaagcccctctcttggtaccctgaaattaggcttgagctctacagcgaagtgctaaggccccagccctggaatggtttttaatatttcaaagacaagacctcttccttttcctctgagcacatttggccccaaagattcagaaacctcaaactgcctgtgtaaattttgcttcaagttcagagagtggctttaattaacttttaggacctgagaaaatgaggataaggtttttctggtggggtattttcaatcasatagatctcagaggagtagctcttgattgggaacttatagttaaattgcactgatgtttgtcaaagttttagcgggctatggccgggctcagtggctcatgcctgtaatcccagcactttgggaggccgaggcgcatagatcacttgaagtcgagagttcaagagcagcctggccaacatggtgaaacaccatatttactaaacttacaaaaactggctgggcatgttggcatgtgcctgtaatcccagctactcaggaggctgaggcaggacaawctcttgaacccaggaggtggaggtggcagtgagttgagatcacaccactgaactccagcctgggtgacagagcaagacttgtctcaaaaacaaaacaaaaaaaaagttttagtgggctaaggagcaggtctggattttcgtccatttataccttttaaccaccttatgtggcttccagtccttactcttcttttcattacctgtttttcaaaatgcaactaaaatagttcagactctcctgggctagccaccagctcttagaatgtgcatcttcagagatctttaagtagaagcttattgatcaaatcctcaaaaatcaaaatgacttactacataaaaaactgtgtttagaaaaaaccctggacctaaacctagagagtaggcacacagtggttttataaatgacattcattatattgtcttcaaggtgtctaatctttttgattaaaaagtaaatcagaaacttcatgaagtcaaatacagagcaaatcctcactatttgtagagatataactcatctctgatccaatagactttttaaaaaattttaagtgtcgtactttatttttaatgctaatattttactcaaaataatggcaattggtagtctaaattaaatatatgcttggattctaagtgttgatgtcctgggtcccttcttgtctatattcataatttgctctttggcttagagacaacctcttttctcactgtatttctttttccacccctaagctgggctaccaatatctgtgccacaccactaacaccaccacygtccagaaacataagggaactaatgtattagctgtaatagcttgtaacatctgggctttgctaccaacaagttgtatagttctgcatcctcaacaactctcatattcacctcccctatttgcattcccactgatgccagaccaaaccwgtccctctttaactctcactgggaccattgcaatagcctcttcttttgcagtgcaatctccctgattgtaactcatttaaaaaaaaaaaagtatcgcactactctcacccctataatatcagcatttttggaggccaaagaaaaagtattgcttgagcccaggggctccaggccagcctgggcaatatagtgagaacttatctctacaaaaaattagccgggtgtggtgatgcatgcctgtagtcccagttactcaggaggctgagatgggaagatcacttgaggccaggaggtggaggtttcagtgaacccagatcatgccactgcacttcagcctgggcaacagagcaagaccctgtcccccagccccacaaaaaaaatcataccaccattaagtgcatgtgttcatgatacttctctgttcagaagtatcccttctgccaactggtatttgtgacccacaagatatggtctcaaactaccttttcagttaacctctaggatctcccaatcttcagcaggctggagtgcagtagtgccatctcagctcactgcaacctctgtctcctgggttcaagcgattctcctgtctcagcctyctgagtagctgggattasaggsatrhrccaccatgcccagctaatttttgtattttttagtggagttggtttcgccatgttggcaaggctggtcttgaacttctgacctcaagggatctgcctgccttggcctcataaagtgttgggattacagatgtgagccaccgtgcccagcttccgttggcttatcattgcacttagaataaaatctcatccccttgttttggatcccaaagcccgatgtgatctgtcactacccccggctcrtatttttctctccattgctcattccattctggccacactaatgtcttcatgttctttgaacacactgcagtttgcttccaccttaaggcctttgaaatagctttttcttcttcctttaatgctcttcttcctgcttctcactggctggtttcttgcagtcattcttctctccacttaaacattatctcattaawgaggtcttccctgacgttcctgaccaacatagtgacacagtcattctatcacataagtttcatttcctacctagcacttatggctatattctgttaatatttttcatgtttacttgtttagtactgttgtgtagttattagtatttgtttcattgtcttctctaccaatagaatgtgcattctatgaggactggaattatgtctgttttcaccattttatttgttcacttagctattatcactactgtaaaagtaatgcattcagttataattattatgtatttttccaacattttcttatttagcatatttttgtcttactttcagttattcctctgccattattcattcatatatttatccataaaatgtttattgagtattgagtatgtgccctaccatggctggggattcagacctgagtaagtaatagtccttgcccttgagaagcctctgtcagtagcttcctcagctgtatgctcacatgtttgttgcgcatttaaattgtggacctcctgctcaagagaatattcagaaacggagatgctgattagaggacattggaaacagatgaccataaggaggtcatctttacttcccaggaaagcagaagaatgagaagagaatagggccatggaggtgggaacctagagaaacacttacctctgcaagggaaggcagaggattgaggtagattcagaagaagactcagaaaagtttctcaaacattagagcagaagaacaacagaagagctaagggaagcattttaggcaaaaggaagtagtggtatttactgctacagaaaggtcaaggaagataagggtggaaagtcttcatttggtttggtaatgaggatgtcagcaatgaagtttgcagggacactttgataggatggtcgggcagtgggctggagagtaagggggaggcaaggaagttaagaaagtttagctataagaggaaggagagaaacaggcagatgtgggcaggaggacaaagggtcaagggagggacattgtttgattccgcctttctaaaagcacaaagctgtggtctacaatgtagacaaaaagaacaagatctcctttctgtggcactattcttgccaactttgtaagccacctggaacgtggcaagccatgggacacctactagcctctggtacctccttgtgtgaaaagttaggtcaaggcatttgcttcttccactttctctctgcttttctcttcaccctgcaatcattattagtttttttgcttgtttgtttgttttgttttttgagaaagagtctcactctgttgccaaggctggagtgtctcggctcactgccacctctgccttctgggttcaagcgattctcctgcctcagcctcccaagtagctgggactacagacatgtgccactatgcctggctaatttttgcatttttagtagagacgaggttttaccatgttgccaggctgttctcgaactcctgacctcaagtgatctgcccaccttggcctcccaaagtgctgrgattagaggcatgagccactgcaccagcccagttctttattaaagtaaaattaaagataatcatggtacttaatgaaggcttacacaggcacaggatgttattctaatgacccagtctctgactcctttccagcaacttccagttgaaccagccttccagagaacattaaagactagcagagcatgtggatgcttctagagaggaatttcctcttgttttagtatttaacttgcttagtaacacaggacagagcagcatcctgcagactataatgcagagtaggagcaggtatgagaaggcctgcccaccccaagcaggtttcagaggaaaactgttactcaaagaagatttttaaacatcatccattctccatacctccacacaaaatccctatcagttgccttacagttaacacagaatcttgaacttgggccacattaaacatggacagacttagtaggtcatgaaccatctgagattctctaaactactgcaagcatgcatttgttttgaagaaatctgaccacggcttttatcagattttcaaaattcataagccctggaagaataagaataactgtgttaaccctatgcacattcatgtgagcaagcttgggcaaatcatttacgctcactgagtctcagtggtggggagtggtggctgccccatcttaggcattcgaagtctgaaagacttcctgcagaacagcagataaatgctaagttggcttggaagtgacctttatgktctccyatagctctgaaataacctgtaagaggtgaatcttggtatttggtgatgcatagaaacagaaaagtatgtcagattaaagcaggggatgcacactgacttgcattttcctttcttagatgttgtgccttcatcaaaagcactgtaccagtcctctaaaaccttcaaatgtttaaaacaagttgtctcgctctctctcactttgttttatcttgtgtggtagagaatttgctgatgaaattttgcttaaaaaaagttcaaacaaacaaacaaacaggttaaaatgggaaacatctctttttggaaattttgtttaaaccaaatcttatttaaaagtttaaacaaacaagtcaaagcaggaaacagtgggtagggttggccactgtgatgggagactgggagcctcaccgactccttcgccctacacactcttgtgagctggccccaaagccagggaaatccctagaaatamkctgttcagggagaaaaccacttccacaggaagagtaccactaaatttaaaatcgttgcactccttctgcaatctgtctgaatagaggcaaagcccaggttcaaaggcaagcactcaggtccccttcatgaaggctgcagagttgtgctcttcagcagcaatatttttgctcctatacctccaaaaatatcctggaacactatgttacctcttacacctttctaagtggaaagctacaattttttatcccaaattttaaaagcaaaagaagattggattttccagtgtattacaaaaattagackgtaaaaataaaattgttacataatttcttaaagtttatccaatggaataaagtactagcatgatctgcaatcctcatcacttaaaagaccacaagcaggctcttaagaaattttatattattcatttttctctccttgaatagttatttctatcccacttctacagtatttagcctaagattacacattttaagcttaaagtattttcttgattattatacttctttgcaaaataaaaatataaaatttcaattttctacaactgtaagtctctatgtgttaaaatgtttttcttttctattgagttagcatkacaactactttcagtacacaattaaataaagtaaatatactrcaagttttgacaagtaacttaaamctttatatttaaattgctattaaagattcatctctaagacaggaggagctttccctcatttgttcatatatccatgaatgaatattacttatcaacaaaattagacaagtttggcatcaatattaytcccatatttcattttcaaggatttaaacattgagaaacttcattcatatgaataagtaaatggaattagaagttttattatagcaatgtctcaattccttgaagtccttccaagttatatgccccaaattatatagtgatttactatcaaaatktagtcagacttgacaacttaatcgggtgctccctcaaagctgatgaaaggaaataaatggaaatcactagacttgaaaacggatttgctgcaatatcatttacaatattcaaattcttaatacctataccaatatttcgaatcatctctggcatacgaatgtatttatatccaarggcaaagctctggaataaataagaaattagtaaaaggtayaatttttctcttataaagtggragaaaggtgtattttaggcagattgtttttaagaaagtatatatgtgaaagttgagaatctgaatacagatttaattaacactctctttgcttgtgaaccccttgggaagtcagccttatcctggtttgaagaattccacttcagcrtttggaatggtgcattttgaaatgtgataggaagaacagcttgtgacacaacacaattcagagaaagcagyggggttaggttcrcaccaaagggttatcgatcactctgcattttgtgcaaataaacagctgtaaatcataacgttatgatactctcagtgtttaatcataggtcctgcagagatcagcagcttataagaayacaaaatatgcctacttaccaaagtcaagattcagaagctcccagatgaaragttctaggcttatgagataactctactctctgggacacattaactggtttgagttgagttctccctggtatctggtcaggctgtagtcaaaagtgcatgaacacatgcacacacaygaccccacactgtcccatgcaccctactgggcgtgacacatacacaaccccacactgtcccatgcaccctacataatccatcactgggcgtgacacacacacacacacacacacacacacacacacaacctcacactgtcccatgcaccctacatcatccatcactgggtgtgacacacacatacacacaatcccacactgtcccatgcaccctacatcatccatcaccaggacatgatacatgaacacacacacaacaccacacagtcccatgcaccctacatcatccatcactggggtgtgacacaaacacacacacacacaactccacaccatcccatgcaccctacatcatccatcactggggcatgacacacgaacacacacacaaccccacacagtcccatgcaccctacatctcatcactggggtgtgacacacacacacacacacacacacacaactccacaccatcccatgcaccctacatcatccgtcactgtggcatgacacacacatacacacagaaccccacactgtcccatccaccctacattatccatcactgtggcatgacacacacacacacacacacacacacacacagaaccccacactgtcccatgcaccctacatcatccatcactggggcatgacacacgcatacatacacaactccacacagtcccatgcagcctacatcatccatcactgtggcatgacacatacacacacacacacacacacacacacacacacacacaaccccacaccgtcccatgcaccctacatcatccatcactggggcatgacacacgaacatacacacaaccgcacaccgtcccatgcacgctacatcatccatcactggggcatgacacacgaacacacacataacctcgcagcaaattgtcacagaccaaattgtggtctgaggcaatttgagatttctttacaggaaaggttttaggtagcagtctggctgggatagtgacaaaactgcaaatgcatagcaaatgcactgtttttatgttgatagtaatgttgagtggctttagaggggaactgatgtagcagctaggcttggtcatgtcgcatgctttatcatccaaaacagcaatgcagcatgggatttagaagcctggaggttaatgaaggttaaaaaaaaaaaaaaaaaaaagtacagtggaaagagctctttcttgtttcaaagtcaagctctgctactgtcattctgaacgtgttatttagatgccccaagcttcagtattttcatgtgcaacatgaggaagtcggacaagatgagcatcactagaacttagatgcccaaaaacattttttgttgtttttttgagacggagtcttgcactgtcgccccggatagagtgcagtggtgtgatctccgctcactgcaacctccgcctcccgggttcaagcgattctcctgcctcgacctcccaaggagctgggattacaagcacccgccaccacacctgtctaatttttttttaatgtacttttagtagagacagggtttcactatgttggccaggctggtcttgaattcctgacctcakgatccgcccacctcagcctcycraagtgctggsattacaggcatgagccactgtgcctggccccaaaaacattttaaaaatattcatagatttgatgaaatcccaacagaagagagttcatgagaaataatagttgctatagatccaaggggaacaagtttactgcatatattaagaaatattaaatatatacatacatatgtatattaaacattgaatagtattgtagatgtgtacagaaatgaaaaagcaagaagataaaacaaagatccatagtacaaaatagatggcatagcataacacaatttgttgatgctctgcacctcaaagtataggttagacattatttgtgtgggtcaggaagttctcatgtgactttctgttattcttgggtatgacataccacttcttaaaaagattgttttataataataatgacagccatattaatgtgtttagctttcttccatacacattaaaaatgtatcttaaaataaaaacattggtggcacaaactactcaataaacatttgttgaatgaatgaagaaatgaactctgtccccagccttgctacagtgtccatccagggtagaacttagaagcagggcaatgagaagcaagaaggaagcagagggcttgaaccactcttccagtggaaattggcacaattatacttcaacataatgattgttaactagaattatttttggccatgttggtggtgtatggatactaaaagaaagttttctcttcttgtttcaggccaactgccaaatagccatcttgtaccagagattccagagagtggtctttggaatttcccaactcctttgcttcagtgccctgatctctggtaaactttatgytaacttttcacttaggcctaagtaattagggtagagcccagatctatgtgtgagaaatttaaggattgtagccagttggtttgaggcatgggaaaactgtccaagtccagattgctggaagacaaatgtaccyaacgccatcatattggtagaaagggcataggaaagaacttaaaatgatatatccaggacgaatgtatccattaggcacagtagacacagacgcacaaaattttyaaagacccacacaygtctgaatttcttttataattattttctttgaagtcaaagaaaatgttttaatatatagtgatatattcatctttgtaccagtgcagttgcaaaatagaatttttaatatgttagcatggaggaagaagcctacataggcaaagttgcctgaagtctatgaaagtcatratgcagccctggctatatcagaatgaagtctttaaggcaaaacaatgccctggaaatgtcagcaagggaggtacaagcatgactaaccctcatgcaggcagcagaggagagggttggatagaaacaagcctttaaataaacaggaaagaaacccatttccaggcctgattgcttgctttgtacacctcttcatgtgggaaatggcctctcctgccccgggtggactcccayagactatgataagagtgctgtagtacctttatacttttgaaacgcacattctttagttcatttggtatcaaaaacacttgtgaaaaagggctgttctgagccctatcttaataagggagtattcagacatggaagaagtagagtagttaatgaaagacaaacagccaagaagaatggaaagactataagattgyagatcaggatatctgatttcccacccgggttctgccacaaacctactgtgtttcactcattcaacaagtatttattgaaggcctattaagtgctaaactctaggctcagtgctaaggatccaaagctaaaaagaaaacaccgtcggagatttacaacctggcagatgtagmctgtatcatagaaacagacattaccgtacatggcaatgagcacaatggaggcagggatgaggtgctgtgggagcctggaggaaggaacacagagtccacctgggaaagccatggagaataggtggagtaaagtttatcagacataagaagagaggacagccaggattgtggggagagcatgtgcaaattcaaggaagtaggaattctgttttgctgagaaagtacatacagtgggcaatgaggctggaccaactggtaggctccaggtcataaagcatgttattttccatgtgaagaggtagagcytgcccttaagacattttatatgtcatttaatctgagcttgggcaaattacttatgtctccttcttttataaaaggacaggagtaarttagatgacttcyagggtccctcctaactttgatatcttatgattccaaacctttaacatcaaggatcctcagaagatgacattttcctattctgacatcattcacacttttaagtgaaaggtggaaaccactctttttccttcaaacaactacattagacataaactagtcgttgttttgtgtattaatgttctggtcggaaattcatctgagtatgcagaagcatacttgggatcacggcctcttttttggtgaggggtactaacctggcactcmctctcctttactctagaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccrtcagcccctggcaagtggaatgatgagcactgcttgaagaaaaagcacgcattgtgttacacaggtagggccttctctactttgaaactttcctgttaaaaaaaaaaaaccctgccttctctggttggccaacataaccaccgagtcaacacaaagatacaaaggcaggacatgaaatcaaggggtaaattgttagtcaatcagtattattgagcaccttgaagaatataagatcagaattagagaaaactagctgcttaaaactagagggaaattttaatatcatccagctcacctgtctcatcttataamtgatgaaaaggacactcacgaggttttagtttctcaaggccgtggagcaggacagaagcaaagtgaggaccagaaaccagtctcccaaattttaggtgtagagcttttttttcacccctgtgtcttgtataacagagagtgtaaattggaaggaaatttagccctgcccctaggtgacacagctgtaactaatagctactgaatgtcagtatgctctaggcattgtgttattagtttatttagttcatgtgtcatttgctcatttaatattagtcaaatttagtcctcatgacaactccatcagtcaggtttttctattactcttactttgctgatgagggaaaggctcagagctattaagtaatctgcccagggttctaagctagttgatggtggagccagtttcacactcatgttgattccaaagttggtgttttttagccatgtaaactaccacattctttgctctacatttttatgagacaatttgagaatataaccaaggattgtaaatgctttatagtttctcttcaacaacaacatatctttagatccattgaactttggtgggagggtagtggtggggagtgggcaggaaaggaaagaagtaattgaaggtgaaatacttcgagtgtattttaattctcaactttaccagtgccagagtaagcagacattcctgaaagcttggtcttcctctagtcacgagcctagtgtcagagctgattccttctttctgatgttgcttccctgtccagaggggccggttctgtcctttgtagcacacgaacactgtgcctaaggatggtatggactgccccgagcaggaagtttctaagtactctgaagcttctttgataaatcatctgccatacatattctgaattctttagattttaaacacctctccctcagaagccctcaacagtacaggtatggaacagaatacacagaataaagcaagccttctacattgtccctcttctccccaagcctcctagctgaggcaaaacatatccatgaatgcattatcatataatcagatctactttataaataatgcatttatatataaataaattgattaattgagcatatattcatggatcaggatggacattaccaggatattagctcatcctactgctctcccagtcagctctctacccctttctgggctatgcctccctagaattatctcttatcagataaccttgactgccactagctgtttcaatatgccactacttccccttcacacccaaccttcaaaatccatttctgcaagacagtcttcctcaataaagcttgccaaaaaaattgcaagatagaaaaaagataaaaaattactggcataaatgatgacactcctctaacccacaacagtggtagagacatcactaattaatacaactttacctgaacacagatgggttttatctccaccaacacagtactctaagcagccactaccattgattgtcgttttgccatctragatgtaaaggatgtagagaagcatcaattatccatgggagatgagaaatagatatatttactgtaatatgaaattaagtttgattgttggaataattctccacatgtcaggaattattagacctcagagcaggctatcgaaaaaagatttattcattgaatcatcatgaataaatcatcttctccctggagatccaaaggaatagacaaattgctaacctatctattcaggaaaccctgaaatgggatagaatacagaacattgtctctttttttcccctagagttctgagatcccaaggaagctataattggggaaacatttgtatgctccaagaacatagggcaggcaggggttgctactgtaaggtattaagacattggtggggttaaggtcagggagcgaagtgaataggatgtggaccaaacctgtatccatttagctgctattgcctcctacatcttctctttatttgaacccttcccagtgtctcagtgcagcttcaccaaattcactggctgccayaggaacttcttcctatagaaccttgcatggtttatagaattttagtatctcagaattgagaggaaacatagagatcatgtagcacagcatatccacatatgacatatggatattcttttgtaatatacttccaagtgaaccagcatgtggacagggcttaagacagaggaagtaaccaccagaaaacagttcagccatagaacttacccccaactatgacctcattaataaaaacatctcagtgctttgaaagtatcaattctaatactaattctcatcaagtgcatataccctaaaatactttcttgcaggaaagaaaccatggcccttctctattctgtcacctgagtggcactatcttggtgaagaggacatggcagttcagccatagtcagtactctcttcgcctgctgtattcagactcatgaaacatcacctcataagattgtttgtcctttaccatgagtacgtcttaaacatctcatttggctcctctgtttctccactgtaggattctggacatagatttgaagcaaatgaaaggtgaaagggtttgggctctaacactgtgcaagctgagctcagagaagtaacttgcctaaggtcacatagcaagtaggcagcagagccaggattcatatcacacctgtgtgaccccacgccccacatctggtgcctaacctcaatgcagtaatacgtgacattgggcttccataataaaacaatgcttggtttgaaaaccacagcccattttgtaccacatagggtttctctgtccacacatctgtcattggctccatttgtccctctgtgtccacacacaacaataccctccttaggaaatactaaatgcagtatgaaatgggagccacgcaatactccagcaggcccctacaatgcttttcacaagggacaggttggctctctagaagatactgtgcttccctcttgtctggctagctcagtcctatctgagaggggatgagtctgtggtcaaaacgagaattcagcctttcctcacatctgtgaatgtccatgactctgacctttccatatctatgcagcctcctgccaggacatgtcctgcagcaaacaaggagagtgcctcgagaccatcgggaactacacctgctcctgttaccctggattctatgggccagaatgtgaatacggtgaggcttcctttttgttgatattattttggttttatgctagagatgatgccaagaagtaaataaatcatgttgaagtctctccagtgagaatagratggtaccagcccccctctatcatctgtctcctccactcagtgtccctagacacacactctaggtaaaaacattttattcttgggagaaaacattgactcataaatttcaaaaaagaaaagggaaagggaaaggaagcaaaaccaacagaactttcaggctaattttacttgtttgaagtaaaaacttgtgaaagaatgactatttcccaagatgcagccaatacaaagagaccaagtagagatggatagcttgggttaaaagtttagaaaattagagttaagagggttacacaaatagttacagctttcagcaaacatgacattsctgttaattctacatggaaaataaaaatcactattttgtctcctgcagtgagagagtgtggagaacttgagctccctcaacacrtgctcatgaactgcagccaycctctgggaaacttctcttttaactcgcagtgcagcttccactgcactgacgggtaccaagtaaatgggcccagcaagctggaatgcttggcttctggaatctggacaaataagcctccacagtgtttaggtatgtagaccttattcttttcatcctcactgacatagaattttgggggagaagaggacacaatgagctttctccattaaaaaatgtgagaaataatgaccatctaggttagatggaaaactctggttatcactgttaactgtcaaccagagtaacattaatttcaattttcatggtatttttttatgggtagagtgacttagtcagtttaattgttgattcgcaggcaaaaacattacaaagggacccctctttccctttgttaattgtaaagtaaacagagtacaatgatgaggacttaggggttaagaattattaatttgataattttacctaacttctctacatgaaaaacaagggtgtttgatctttccaagcagctattgaaaacaccatttaaccattctagtgcatcaacctgcctgccactttgggaaggtgtgactgctgcagaatttgaaggcttccaaggtgatggacaaaatttgtccaaggactcacactattattctgtggttggttttagctgcccagtgcccacccctgaagattcctgaacgaggaaacatgayctgccttcattctgcaaaagcattccagcatcagtctagctgcagcttcagttgtgaagagggatttgcattagttggacyggaagtggtgcaatgcacagcctcgggggtatggacagccccagccccagtgtgtaaaggtgagtttcaggtagttgggatgtataatgtccattgcacccagtccttacttagtgcatagatgaaattgaccagcttatggagaagctggcctgaattgccaaaatttaattctcttcctacctgccattcagctagattgggttcatctgagatgagaaaggaaaaaaattcctttctttccccaaacacaaatgcaggcagtttcagaatggcctcattcataatttccccataagattagaaagggtggcctctacatctataagtggacactagaagacctactgagacaggtttatagaagtatagggaatagaggacattaagaatacagcttggaggaatctttgtttttaacagactcagatcaccctgggaactggtaatccaagtctggacaaacatcattagggtctcttgacctttacatcttgctagctccacctgcatttcagaggtggttccaccattgctctctgtgtggcttttctcctttctcagtatctttctctttatccttggttattctctccagctgtgcagtgtcagcacctggaagcccccartgaaggaaccatggactgtgttcatccgctcactgcttttgcctatggctccagctgtaaatttgagtgccagcccggctacagagtgaggggcttggacrtgctccgctgcattgactctggacactggtctgcacccttgccaacctgtgagggtaggatttttcattagcaacctccattctgtccaagaaggaatcatggcatggtagagaggccaagggctctcagtgtcggggtgatctcttctaagttcttgcactagagcaagctcttcaacctccaggaaccatggttttctcatctgtgaaatggagctaagaattgcaaggtgcttgtgaggattaagtacataaaaagtatacaattaaatagcatgtataaagtacctagcatagagcttctgctctactgacatatccgaggtataggaccatgtcctatacttgagagggagttgggagcagcggctaaggtggctaaagagagtggttcaccatgtagtctttgagggtagcctttgacaaagaagcaaaggaaggaacactgcatcgaaaaagtgtgtgatgcaatcccaggcaattacataattccrccaaaatgaattctctgcaattgcctcacaccctcagtttataaggcggacagtggtaatgggagaataggaaatttacgatagattagtgaattcccagacctggatgacaagcccaaccctgctactatctagctatgagactttagagaagtcacttaacacttctgaacctcacttttcttgcctaaaacataagagagaagagagaaacactagaggattttggtgtttttgtttgtttgtttgtttgtttgtttrtttgtttgttttgagacasagtctcactctgtcgcccaggctgragtgcagtggcrcgatctcagctcastgcaacctcygcctcccargttcaarcgattctcctgcctcagcctcccgaatagctaggattacaggcaactttttgtatttttaatagagactagggtttcaccactttggccaggctggtctcaaactcccgacctcaagtgattcactcacatcagcctctcaaagtgctgggattataggtgtgagccattgtgctcagcyggatttttggttcttaaatgctctgagtctgtaaaaaccagaggtcaaagcccagagcaaagaggtagtctttacactttgaaaagtttcagaaatagcctggaaatraaatgctttatcaaggaagagcatgaggaaaccaatctttatcagaactgaggtcactcagggcttaattgtgctcaggaattcactttggctgcactcacttggcaactgaagtctgattaggatgacatcctgtgttctagagacaaagcccggtcaggatcattttacaggactaggtaacagtgtcaacaataagctatgctagtccagcttttttttttttccctataagtccagcattttcctgtatatactcttttcagrttcaatttcacagataatgtcaatatttaatgagcactttcaatgtacaaaacactctgctcagctccagaataaaactatgaatgactgagcccaacttcgaggagaccayggtataatggggaagaatgacaatcatgtatgaacagcgcaagaacagaggctgtgggagcacattgcaggggcttctacccttagttaaggtgggaagggagggcttcctaaggaaagggaagtctaagctgagacctgaagggcaggtgagagtgagtcaggccaagaggggcatgggaaggtgttccaggcagtctctcttttggaaaatggaggttttagggttctgaacacactgaaaatgtggacaggaaagatatagcatctaggaattttttctgaggaagaacccggcccttccattacctggctttagaagataccttttccacttagctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaaggtactgtaacagtggtaatgtttttctgtgtgtctcagctcgttagaggcatcagcatctgcactgagcattggcatgcctttctttatcagatattcactgagaacctactatgggccatgtcctttgtgcttgggaccagggatgagatgaaayggtgcgtgaagccagtcttaggcacatgtccactatagtatagtcaaggtgaggtttgcactgattgacacatatagggtgcattggaatgaagaagatggggcttgggggaataaatcatgcatgaggaatagcatgggatggggaagggtaatggacaaggtgtttagctcagtcctgtcacttcctgtccttaagctagtggtttagactctctgaggctcagtatcttctgtaaaatggggctactattatcagccttacctacctgcctcactagtagttgtgaattaatgtgtgtaaacgcaactttaaaactcttataggatttatagggaaaatgatgatgatgacatgttaccttataaatcacatgtctgtggtctgatttgacaaaatgatcctctttcaatatgttaggtttctaatcttttgctcttatactaaggcactcatggggggcgggtgtggtggttcacaaggattattattttttttacgaggagtacctcacactaaagtcatgttccagaagtgtaatattgacattttgtgttttcatttacggagacctctgagcaatctatgtgactcccctgggttcctaagtataccttgattttaaaatgaggcagtggtttgaaagcaggtcttgaagagatatttgtgcacccatgttcatagcactattaatcacaacagttaaaatgtggaagcaacccaaacacccatcaatggatgaaaggataagtaaaaagtattccacatacttacagtggaatattattcaaccttaaagaggaagtaaattctgacctctgctacaaacatgaatgaaccttgaagacattatgctaagtgaaataagccactatgaaaggacaaatactgtatgattccactcatatgaggaacttagagtagtcaaagtcatagagacagaaagtagaacggaggttgccaagggctcggcggaagagggaaatagggagttatggtttaatggatacggagtttcagtttgagatgatgaaaagagttttggagatgaataatggtgatggtggcacaataatatgaatgtgcttaataccactgaactgtacacttgatattggtgacatggtaaatggtaaattaaatttcatgctacgtatatctcactataataaaaaattgaacagcaaaaaaaaaaaaaaagaaaaaacaagaaggcaatagaatagatggctatacaccatgatgctgacacytagtctgagttatggaatgtattgtatatgttatctgggagaaaaagacacaatgagctctttgacacacttaaaacggatcataagggattattcaagccattgttgtctccaggaaggtaaatgtctaatcaagaaaagatagttggatattctcttaagtatccagagatgtggtctcactaacccccttcataggccttctgaatgtttcccactcctgaactcagtgtctgcatgtgacgcaaagccttaatgatattattactatctattactaccactgctactaatatagcagctaatgttcattgagcactttctatgatctcagtctaactctatgaggtagttacaattattactaccattttaaagatgagaagagacaacacatggaatatgtgtgctctcttcgtatatggttatttattttacatctttgagatcatggtgtatattataatttttactctgattttttatttaacatcatacattgagacctctctcctatctttacaagttaaaatatattatttttagtgacctttaacattcttttcatggatccaccatmattaatttccaccctcaattaatggcatttgtgtttgttttcaatattccgctcttacaaataatgtcttcacaaaaatctctaaatagattttttggtatgcatcttgattacatacttagcataaattcttgggtccaaaagcatgataacttaaaaattattgacacatgttgccaagatgytcaacaaaggtttagcatttcctaataaaatccttcatgtgccgttataattaaatgacactttttcttatcttctatgttaaacaagcccaattcaggaatccctgttcttgacactagaaagagttaatggtcaaaaatcaatgagtacatgtgtattactgtttctttattccttacttcctcatcccttagctttgcagtgccaggatctcccagttccaaatgaggcccrggtgaactgctcccaccccttcggtgcctttaggtaccagtcagtctgcagcttcacctgcaatgaaggcttgctcctggtgggagcaagtgtgctacagtgcttggctactggaaactggaattytgttcctccagaatgccaaggtaagagtgtattctttctaacatcatggaaataaattgtaggcagtatttttaaaggctggattttagaggtgacaactatgtaagatccaccttgaaatggactggaaaattcataaatactctcactcatcctcttgtcctataacccaaggatcccaaatgcaaatgcctccgggrgataggcagattacacaagtgtcaggatgtctggccatagacagtagggcatggcccttgctaactccttatcagggtctttacccagacctgaaggctcctgccacaaaccaggtaaactcttctcacctggccaaacatggcatctggaaagaagaccaggtgggaaaaaaattgcttcagagtggttgtcccaaggctggtctggcacttctaggaaccacagggtataatggtaaaatgggaggggcagaatttacaagtacccagttgcaaacactccaagatctgtataaaattggagaaatagacttagaataaggtgaagagtgatagaaaaaagagaaaaactaatctgtatactggaggttacgggattctcagaagaaagaaatgtgtggattcagtataaacattctatctgcattgtacttgatatacatacattttttgagacggagtctcactctgtcgcccaggctggagtgtaatggcacaatctcggcccactgcaacctccgcctcccgggttcaagcaattctcctgtctcagcttcccgagtagctgggactacaggtgcccrccactgcacccagctaatttttgtatttttggtagagatgaggtttcaccatcttagctaggctggtctcaaactcctgacctcaggtgatctgcctgactcggcctcccacagtgctggtattacaggtgtgagccactgctcccggccttgtacttgatatttaacaagccagtgtgctctgtcagtattgcaacatcttgtatgaacttgaacgggttctagtcatccatgtttgtgaattgaaggatagacgtatattttttatattccccaagctttttccccctcaatgtatccaattccttagttaacttttatagacaatgctgctttttaaacgcaagattttcatttataaaaathtgcagaaatataataaagaaatgaagaaatatcctcttaaatactcctatcctaaaatagacactgttaggcttctggtatgaattcttccaatattttctccgcttttcctcctatgcaattaatatttttatgatgtatatacaattttaacaataaagttgaatggrtaaaagactagacagttctacattatttgccatacctttcactttgtatagactttcaacatttgagtgaaagtgggcagatacatattttttactaaaaggaaaccactcactattcaggtcacacaaaagcataatcacatacacacacacacacmccccmcmcacacaccccattgttaagctaggtcaacagtaaatgaatgaatgaatgaatgaatgaatgaatgaacaaatggacaagcaaacagcagaattgaatgtccttcatcgccaggcaccagagaggatggcaagcccctggacttagggttgggtgcaccttcagagctgggtctggagagaacagggcggggctgtgaccttgccccttaagtgctcatcctggctacgttgaagtctggacatatcacaaagtccacacaactttggggaagttgtgggaagaactgggaatccctgaggacagtgatcacagtgattgaaactcttacaggcaagcctgggtggtgcagggcacagattacagttcattgctccatactgtcctgcctctgggtgtttcacagcaaggaggttgccactcaccacggcttcctgtgaccttccagttcccttctgcttttagttctttatttactctgaactttctcctcttgttgctgggtgcacatcaagtgaaatacccaaatgtgggctgggcaggaaggtaccatgcagwgtgcaatccactcgctgttgtaatacttctgagagagtgttatcagacaatttccctttttaatgtcctcccacccctccacatctacccctgctgtcagaaggcaaagccacagaagagctggaaatgggttctgtggtaccaacatcctcacccacaccctttcccccataagtccttgcagtttataggcttcttgagttgtgtcctctccagccccacatacacacttactacagaaatacttttcaactagaagaaaagaaccagatctttggacaagttgatcagattgaaaggaatgtagctagagaggggaaggaatgaagggaagagaaaggcgtagaaagtgttcttgaaacctcatgctgtttaagtcagtggctgaaaaatgaccctaggagcaaggacttcatgtctaaaacaccaaaagcaatggcaayaaaagccaaaattgacaaatgggatctaattaaactaaagagcttctgcacagcaaaagaaactaccatcagagtgaacaggcaacctacagaatgrgagaayatttttgcaatctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccatggtggaagtcagtgtggcaattcctcagggatctggaactagaaatgccatttgacctagccatcccatgactgggtatatacccaaaggattataaatcatgttgctaccaagacacatgcacaggtatgtttattgcggcactattcaaaatagcaaagacttggaaccaacccaaatgtccaacaatgatggactggattaagaaaatgtggcacatatgcaaggattttcctttttcccatttcgaagataaagcaactgaggctcagaaaggttattgtctagtgatagattgctagcaagtaacagagccaaaatttgggcgcagattccaccacttggttgggaaagggggaagaaagtattttcctccatttctgtgtttccaatcatttgtcattgttttctggtaaggtcattggggtgtttctgaagaaggtatcaagggagaaaccagttccacccctgtctagaagcaacaaaaatgagttgcaccactatcctcccaaacagagcaccagcttcctttaaaaatcacctctaaagctgtttgtgattgagcacttcaggatgtcaatcaactgtaagctgctgctattttacacctctacaatctctaactggtgatraagcatcatgaaattcaaacaatcacttttagccaaataccatcgttgtatattaatcacacacacacacacacacacacacacacasasacacasasmgagagagagagggagaaagagagagagagttacagagttcaggttgctgaattataaaatgatctcttcttttctcctctgccatgcccatgatagccattccctgcacacctttgctaagccctcagaatggaacaatgacctgtgttcaacctcttggaagttccagttataaatccacatgtcaattcatctgtgacragggatattctttgtctggaccagaaagattggattgtactcgatcgggacgctggacagactccccaccaatgtgtgaaggtaggctgtgggtctgtcctttcttatggctttaaagatgacatcagagaatggagaatcatcagggatttatataaaagtgttcttgagctgaagcaaacaacactctccacaacaatggtaatctagataaaaaagttctccctctctttaaataatattttaatagctttagttaaatattccacagtttcaagaacatcctggccaacatggtgaaaccccgtytctactaaaaatacaaaaaatagcygggcatggtggtgcaygcctgtagtcccagctactcgggaggctgaggcaggagaatcgcttgaacccaggaggyggaggttgcagtgagctgagattgtgccattgcactccagcctggtgacagagtgagactctgtctcaaaaaaaaattgcacagtttcaggaagtgctttcatgtcattatagcattcctgtttaccacaattctaaaataataaggaaaggcagtatcatctcattttatagataaggaagagacacaagcttaaagaggttaaataactcgtccagggtcacactgttagtaagtgaaaaggctcagctctatgtcactgaaagttttacttccttacagagtcttcttcagctacattcttcatttcttcattcctacattcaccttcaactgagcattactaaatcccagccacagaccttatttagggatgggtgagatttaaccctagcataactatgtgtgcacttccctcctctctccacttctatattgaatataagcttcttgaaggcaggagctgtgccttcttcatctttataccccctgcagcagctagacagaataaaaatgggtgtgtgtgacaaatatctgttgaattgaaggtgatcatttaccagtaaaatttactcaaacacaagctttggtaatttagtggaattctcaaaggcaggggccagatcttatctgtctttaattcccctgagacatctggctggcaaagtatctagtatattttatgttctaaaatagaagtgcactgaattaattaattcatagctcctgtttagttgcaaaaggtgctattgttctaatgtattgttcagtgtagagttagtaataatgagaccagtgataatggtaataattattgcttaatgtaggactacctatttcataagcatcatcacattcartccacacaaatgacccttaagttggttattactatgcccattttaaaggtgaagaarctgaggctttgagaggttaagtagctagcaaagttcatatagcttgaagtatggagacaggatgcaaacccaggcctagtctgattatagggctagtgttttgaccactgaactacactatcacccagtggcagagcttctgaatctcaggtaagtcacttgtgaatttactcttttccactccacagattgcagctataactgctaaatgaactttagaaatggcagtgcctggtgatcagatgagagaatatgttggtagaaatctattcgtgttacacaaaaacagctaaaatattatttattccttcctgtggaatgagcactagattaatatccaaagacttgtattgctctctctccaagtcatgtgccattaggaaagtcttgtcacacccttaggctcccgttttctcaattccaaaaggagaagagtggaccagaccatctttgaggtcgcttccctggtcaagaattctgtagggtgaaagacataaaatgctaccatctgctgtcaaaaagatatactacaagttccctgagaattctagaacatgtatggaggaaagcatttgggcttgtggtttttcactcattcatttattcctcactctcttattcatttattccattgacatttctcataagttctattttcccacattttaaggctaaagaatatttaaaaaaacctttaaaaatctcattcacattttaaatcatgtaggcaaccaacatggctgctaaatctgtaatctctaaagcccttgcttcccttcactactttccagcccccctttctctgcaggaggaggcatttgcctcccactttgcaggccccatccccactcactgtcaagacccaaccctgaccatgaacagcagctttaacccactatggcccttggaattatcaaccttgactgatcctgatcttgagccctggtttttgcatttgtgtttcttcttcgttctccaaatttatgctctaaatttaggcaaatggttcctcttattttcccatatgcctgaacccattaatttttaaccctcagcactgccccctagaaccccaattttcacatggtgttttgcagagtwctaggatacatcagatggactcaggggcctccaagtaagcagaggcagtgtggcaggtggagttctcaagctgtctcttcagagtgcaatgtgagatttcattttgggggatggctctaccgatagttccactttagttagaatgccggttccctgggccctctgggatgtggcctctgcctagttgttcctcagtatctgcagggggaattggttccaggactccctgcagataccagaatccccagatgcccaagtcacttatataaaatggcataatatttgcatataacctacatacattctcctttagacttttaaaccgtctttagattacgtataatacctaatgcaaagcctacacatcacttcatctgcatggattcaacatactcagcacatggcaaattcaagttttgctttttggaactttatataatttattttttttctgaatgtttttgatccacaacgagttgaatccgtagatgcagaacccttggatacagagagtcggttatttttcagccttgtctctgcctttgcccttcaggacctgaagtccttttcatgagcctaagcagtgcttgaggttcttgtgccaactttgatgatgccacctgcatgatggagtgcttgtacacagtttccgtatccctcctgtccctgcctgttggaccactttcatgatacagactgctgaattcctaatcccttaacactgtctgtcattgatcctctggtgaccatgtttggctgctgaacccaactcctaatgtctattttcactgcgtggggaggggtcctggttccaagtcccaacctcaactctgctcttctgccatgtgcctgcttactcacgtcctaaaatatggtgaactggtgccccctaaaactctggcccagctgacatctccatttttttcttcattcccccaacatttctctgaatctgtggggcttcctagttttattcctaaagtttgagtttacaatattcaactcagatacatttattattcatactatatcttctttccagaaaattattgagaaaactctatcaaactcaagtaaaatgatataatgaaaggaaacagataatttactaaatctatttgaaataatataaatcaatatgtttaagaattcagatgcaatcatgtatactttcttgatggactatagaagaacaccaatgaatacccatatgtgatagmactgccttggtagtcagtgaaaatagaacactaagcgtgcaataaatgcaaaccttatctgttttctatttttgtaattattcaggagtttttttttttttgccaaagttttagagtaggctcaagaatatgaccacttctcaaagttatgcacaaaagtcattcctgggtataactcttttcctgcatctgcactaatctccattccagcagcatccttgataactccacaaatgtcattcatcccatgtttgctgagtgcccaccatatgccggatctgggttaggcttccatgtaactcatctaggctgcccctcaaacaggtaaacccacttctttacatgatccagagccaaattcttagtatgtaagggtcaaggttaatttttacctgagagagttcagagacttttataaatatgaaagtctggatatgtaaccttggctgagcatgactgataagactgaaaccaaagcactatcccccaaatgaatttaatgctgtagtagttctcattttatactagggcccccttcggttaatttttaaaaacagtaattcctcttgtttcttttcaaaccaggtaggcataccttttagaatgcatttaaattaaattgtattcattactgtattcattcaattcataagtatttgtagaacccctcctatgtgtcaggccctgttctctgggatacagtgttcaaagaactgacaaggtccctgctttcctgcagctgacattatacatattcttcagtttaaagttgtaattctgggagattatgaaaaagttatttttgtgaaaatgttcacagatgacttcatgtctaggagttacaccagtagacatgtttcaaaaakgtttagtaaattgatttgatgtgtcagatatgaagttgttaattactcaacaatttgagagtactgaactgaaattcactgtgttattttggctatttgaatggattcatgcaataagaatccataatccttcaatgaatagcttgttactgaaaaatacatgggccagtatgtaaaagccaaatactgtacattggttttccatgagggagcatataggtcttgaagaggtttgtaaaaatcaaactatctaagtaaatgagacttatctgaccaaggtattgttktcagaatagccttagatttaaagaaagawtartcacttcatttgtctataacccaacatttattgataaataatagtcttatattagagaatyaatggggagaaargaataatgctaagaaaatatgtaactgcaataatttgtaaaaatacttttggggggaaattgtgaattaaaatttaaattcatttattcattcacttggcaagtggttactgagcactgcctcttgagatcctgggatggsagttatggaagactcaaggatgaatcattcttgggttttagacactttcccatccagtagaagagtgagggtatgacatgggacatgacarcacatcagttcagacaaaaagttgaagaattcagaggagaagagttcaggctgtggtgatcagcagagtcttcagagactttaygarttaaatcctggaggattagtgggattttaygycatraaagtggaaaaattctcaggggaatgtgagccaagaaccagaagcaataacacacaaagtcacttcagggaattccaagaaactaatctatcttgaccaggaggttttgagttttcctgtgttatctggatgggtggtattaaaatacaacagcaaaataaacaaaacaattagtgaggagattcaaatggaagaaatagtttgaggcagaaagcaatcattgcagttttaggtgtgttgaatttgagaagatggcrtgatatatgggagcaagtagtctcaggcaagaggaagggcggaaatgaaatcctggattgcacccattcaagtaagatagagggagctgcggcaggctacgaggtctctgaagcagagggtgtagagaaaatagggtgacwttgtaagttcttgagtatggctgyctaaatctttgacttctttgtcttcgtgacttgtacctatactcttctctgtaagcttaccatcctcccactgccctttgcagcaaatgacctacatgatatgttgtggaatgctgctgcctagcaaaatacctggaatataggtgcttaataaatattttttgaatatataagtgaatgaactttgtgtaacacagaacttctgaataaacttggagattgtgacactcttaatttgatactctagccatcaagtgcccagaactctttgccccagagcagggcagcctggattgttctgacacycgtggagaattcaatgttggctccacctgycatttctcttgtracaayggctttaagctggaggggcccaataatgtggaatgcacaactkctggaagatggtcagctactccrccaacctgcaaaggtaataatatgtacttgctaagacagttctacttttggaaatttattctacaacaacaaacaattatctagttcttatatgtgaactagataattgtatatattaccattatttgggtttagcaaacagctgaaggattttaaaatgtctaaggagtgacaggatatttttatgtttgtgaataaaaggtatattgattcttaagcaggaattttgtttcatggcttctttttttgaaagagctttgttgagtgaacggaatggtctccattaatttattgctgagagaaacagacaatactggggtagagtcactggtccagtttttcaaatctaggaattgaggtgcagagaggtcaatcatcatcttcctgccacatggcaagttaatgacaaagctggtgggatcattcaaatggaagaaatagtttgagacagaaagcaatcattgcagtaaatttcaactttcacattgacctttagtcagagaacagtaccatttcycaataaggcagggttgggcaggcagttggcccatgtatatttggctttctgctgaatttcttatatttctgtaccatttcttgcttctttttaaaatagcaacaacaatgactcctctgatttcttctctkggccaggagaatcatctcctcaaggatgmtttttaataattttcctcatctggttttctatctctgacactgayagtttttcttaacttccttaaatagctcttgcaggagcctcccttgttatgaagggagtgaaaagcagttattccagattagccttaactctgttaacgcttcttttaattgggaggtctctgaatkgaaacattttctcacaacagkcatagcatcacttcctactccagggktgcaatgtccagccctcaccactcctgggcagggaaccatgtactgtaggcatcatccgggramctttggttttaataccacttgttactttggctgcarcgctggattcacactcataggagacagcactctcagctgcagaccttcaggacaatggacagcagtaactccagcatgcagaggtaaggtgaaaaggagcaggcagttctgaacctgccttcctgcaagtactcaagctagccattgtgcctgtatgttgaagtctcacccaaccacaaccactactccaagtgtcatctcccttatgaaatccacaccaatccyattagaagtaatgtgtcacaggcatttcacttctgtccttcctcaygtcacaagctaaagctaatacacaagtactcagagacttaaaggaagaaacatttgyagatgtccaagatgtgttagaaaaatagrcatattaaatgtaaaacctgctatagaaattggtaaactagaagttgcatattatgtgacagtataaacattccatattttcataataatttgaacctaaataaaaagttaagccatacatgatatttcctgaagagctatcgycctacacataaagcattgagacctatgtttctttcatttttgtatcccccacaaaacatagcacagtgctttgcaaatgtcactactgataaataacatttatttgaattaaatytaatttcttgacctttamtttcytatccataaattagaaagaataacsctgaagttccctgaaaatgtagtytaaggaggatgacagtctacttctttcaaacttccagtgtccagatatgctgaacacttattaagtatttyaataaacacatactgacatgccagttgatcacaaatgtagtaataayatttagactaayagtattttaagaaccaaaattttgtaaatagtatatktggaggcaagatttatcawtgcattagcaggtatttgtcggatgctactatgtgtccatctttgcatcttggttctttggatatcacccttcgagagaatattttcatatatgtgctgttagaagagctactgtgaatattggaagtggctcatatcctttctgaccttttacattctgcctcatttattggcaatgttaggttacaaaagaaactataatctstttcacctccaatccacatgttgtttctcttgcattmtttcttttctgcagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcamctaccgtgccaacctgccaaggtacaattttcatgtgggttaagaagtcactttgatgtggaaaataacaaaatcagtgtttcttccctgtgtctttctcatagtggtcttgctttccatccccgggtttccccctgcttaataagtgtttcacaatgaatcaggcagaatctccttgccttataaagtagtggaaattaaacccagtgactgtgtaggtaatcacccctcctcttcagtgttcagtttgtgaaatgaaaccttttgcttcgttataatctctgtttaacagaccttgaagtttcaaaatgttttaaactgggagttatttcatgcagatttctaatttattatctcagaagacctttgcttaccacctaactctaaaaacctcctagcagatcttccttaattaaattccatctgtttgcaaggtatatttcagccccctattttttcccctcatagcttgtcctgactgccttttgttacataactgaatctttgccaaaaaattatgcacagtttattttatttgcctaaacttacatgtataggcttcttatgtctacaatttaatttcttttattgggaccttaccctaattcttttggaaattacagtttatatttaagtcttaggaataaattaaggccccacttttattttatttgcccatacttacatgtataggcttcttgtgtctacaatttaatttcttttattgggtcctcaccctgattcctttggaaattacagtctatatttaagccttaggaataaaataaggccccacttcccattctgttgcagtggatttatgaattccagatcttctttcatgttagcttgtcagcattcccaggacctttggtgatcctacttgatygcacatcttagagttcttgaaaactttctgggagagaaagactagtcttttgcataatacacttcttatgtcttgcatgtgtgtgtgtttgttttgtagcaggaccattgactatccaggaagccctgacttactttggtggagcggtggcttctacrataggtctgataatgggtgggacgctcctggctttgctaagaaagcgtttcagacaaaaaggtaaataggaaagagtcttctctttgcatcttggttacataaatcaaaagaaattgatttatgtaatttagggtggggaggcaaaaaccacaacttcagtagttcatgttggaaaacatttgcattaaaagaaaataaagccaagataagtgatcttgagaactgattgtccattagaatcacctagggaacttcctaaaaatatagatccttctatggggagacttggtagtgggtgtggaaatctgaatttttcaaaagctctctcccaaaattcaaatgaggctactttgcagttttgcatttggggcctctggtctaagtaccctaggctatcactaaagctaattagaaaggtgttatgcttcctgacttcactcatttcttcatgtagcagtcatttattcatcaactctgttagagtgtgagactcataatgatggtttctgatattaaggaaggaaaaatccagtaggggagacaggtgaaatcagtgccggtagtgaagtgtagtaagtgtgttaggacacaaatacaacctaggtattattagaacatagactagggatgcctaaaccagactggcaggtcagaaagcctttttcaagcttagctttgaagaatgagaggcatttagccaaggggaaaatggaaatagagttccatcagagaaaatggcatgtagaaagacatgaaagtgtaaaatcaatgagaagatggtatgtttcgcagttcagtgcatctgaatcaaaaggggattatggaggaggcaggagatgaagttaggggcagaagaagctgcccctgtattggtgacctggtgtgataagctaagagatttgctttttctcctgaaaatttgtaaagttgatgcaggatttaaacagagaagaccaaatagatgaaaactctctgtaagggaaactgtgttcatcagactgttcatcagaaaaagaactttagtctaggaattaaagatgggaacatcccatctcttaaggtttaaaacatcctttctcaatcttctccagacacttagcctgcctataagttcataaagttttgtttataacctaatggggctcttcttcatcactcctcatagaaagtaactgggggcatcagagagaccattaattgctcaaatcaaggtaatggaaagtggctatgttaaaatatctgaaagagatctcattgaatttctctattgttgacataggtctcaacacctattcttaactgctcagaggcaaaaccacgtgttccttactcttattctttctccatttacaatgctaccaaaacattgaggctgtttttccaaatttccttcatatactctcctgtgagtggctaagacaatagacaaaggtcaatactctgcttcaataccaaagagatgtactgagagctacagtgaatccctccatgcaaaatgtgtgcttgctcaaccaaacccagaaggcagaggcaagagctcctagaccttaatctctatgatcatgtaggaatcactctaatcttgatgtttcccccaagtcctttctttgactttgagacatttccagaggaccctctaacagtggagaaggacaaatggccactcatgccccaatatttttaataataaatacattcatttgttggggatgggagcttttttcctcagcttctcccaatttgattttaggctttgaagttttctatggccaaataagaggaaaatgctgcagccatagctgaaaattcaactatgagagtctgttatttggataaaaatatgctaccagggaggaaaaacatccactgttctgttggtttggattcatgtatgtgattagcttgctcagctaagggctgagggcaagtgacacaagatgccctcaaaagaaattgatttatgtatttactgaaaggaaggaggaagaaagtgacaggactctggagttaaatattgtcgaatgtttaatttagcctaaaacactttctacctttcagggagaaactgttcccaatattccccttataatgagccctcctgaaaatcagtctactggttttccccagtaatttctatccttaatgaccctctctttcatcttgttttttttttttaatcattcattcttgtcttcttgctgattttagatgatgggaaatgccccttgaatcctcacaggtaaggtagaaatgttttatgattgagtaaattttgctaccttaactttawaattcactgtaatatgtcagaatgattacatgcaatgcctgcctcctttttacaatgtcttttgcaatgtcttcttttctactctgaagtaaaatacacagataacaaatattctaattaaaatataaagtaggaataaaaygaaaagtaatttataataaaaacaagatgcaaaaacttaggcgctgtgccagtagatgcaatgaggtcatcagaagcgtgcaccttccacagaatcactaggaaagcaacgcccacgcaggtggactgatgggggaatgttgtattagtgactcaaagagcattagaactgtggccaacaccagcctaatttttcaacatggtgaacaactccggtaaagagtctgaaaacctgtgataattgtcctttgattcatatggcaattgcattttaaagatgcaaaaaaatgcttaatatttacatgtaaagtgcttgagttccaggctcagagatttttaacctgtatgaatatcgagcagatattccaaagttatgtgggatgttggacaattcttttgtgtcctgtaccccttgctatttataatctagcaatagttttcaaaaagggacagtatgcccccaagggtatttttttatttttgtaatgaacaagagttctactgacattgagtgggcaggaggcaggggtgctggatatcttttaaagacatttccgtcctggaggacatggaaatccttatatgaactctattgtcgtagacatccagcacccttgccccatacccactcaatatcggaagaactcttggttataaaaatcaaaaaacacccctaggggtcatattgcaccctttgaaaactatcgttagattatcaagtgttaatgccaagaattttgtaactacctcttgtcacctagaagaggttgcagcaacttagagggtataacaggtattcagtacataaagcatgaacaataacttagtgtgggtgcaaaatgcaatgcaaattacccagagctggtaagtgggatatcgaatatttctttggcatttatttttctttcctttctaaagcagaattccaagggtggatggtaatttgtggtttctggaaatactatgtgttggactgtgttgtcgagaactaagcagtatattgttgccatccttgtgtttctgttctttagccacctaggaacatatggagtttttacaaacgctgcatttgacccgagtccttaaggtaagatccctataaagatatttttgaaggaaatagaacactagggaaaaatggaagaytataaagcttaacttttctttacataatcatatattaaattttaagtatgtattaaattttcaggcatgaaggaaattgtgttggcagtaggacacaggtatgacaatggagttacaaaagagttcacaaaaggattttcatttcctccaggacagaaatgtcctaacaagacataacttatttcaggatgtgtaacatttccattattaactgctaggtggtgatgatgtggccttgcctgcaaagcagaagtcaggactgctgaaaaatgtttacgaactgttatggartcaattccctatgctacctgctggaaaaacaaaaataatctgatgctatccctctcccaaaaagtgggtagttgagtgtcctacaaaaagcctgaatggcagaatattcgaaatctagaaagaaaagattatgctgcgcctcagggtgtagatatgatgagyaatttttttctttcttttatttttttaaggaaatgataattatttaaatttctttggtctcatttccagagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaasaccaatattcaaatgcgtaattaaaagaattttccccaaatgccgtgttcctctattttatggtttgttcagtaaggtctgtatacatcacattgtttaccatcagtgtaataacacacaattatggttgtcctatttacacctcaaccattcattcagtcagcaaatatgtatcgcacaccctacactgcaagagaaaatcagagaaatggaaaaattcttcatcaccttaatattttacagggaagaacaaatgtgttttacatgttctttaaatcccatgtttaataaataggtcattgaaagttatatagtatttatctggaactgatgttaaaaaaaatagagagccaaaaattatagtagtcatcttgtctctgtaaaatgtaattmaataaatatgtcatgtacactgtatatacataagcaaacatgcaaataaaaaagcagcctactcaaaggttacaataatgttgcaacaattctggtagtaaccttgggatttagggacacagtgctttcaaaacgtttctctgatacactgccagtagcatctctgactgcttatttaaatgtcaatcagtaggctaggtgttctaggactttggtctcaaccctgtttcctgagtcagaatctacattttgtaaaagttcccctgggaattctgatggtctgccaactttgggagacactgataatattgtagataaagaagtgtaagcaactgttcagttagggagacaatagatacctgcatggaataacaaaaggtaattaacatgattatataatttgaatagtgttgtaatagttcataaaatggaaaagccaatttgagcccagaatctgggagataggcagaactctggactgtaaagaatggcccagcaaagaggaagaaaatgggcattctaagttggtgcaataatatcagcacaggagaaaagacagaatattggggggagtggggagggaggaagaggctgttgatgagcctgatatcattaacagagacctcatgtgaggtgccagattacaatttattgaatgtactgaatgcataaagcataagacagaaacctggagccatgcagatacagggaacccaggacaagtcattatgatgcctcagacaatataattcgcagattctctatcaatagcaaagtaagatttaaggtgctgtgaaacagtcagatccttcaagaaaaacaagaatacaaggggtcctggagacaggaaaatatgatcataataataaatttgtgattccttctttctctctttttctctttctttctttttctttctttcttttttttttttgatggagttttgctctcgttgcccaggctggagtaaaatggcatgatatcagctcactgcaaactccaccttccaggttcaagcaattctcttgcctcaatctctcgagtaggtgggattacaggtgtccaccacaacgcccggctaattttttatatttttagtagagaagggtttcaccatgttggccaggctggtcttgaactcctgacctcaggtgattcacccgccttggcctcccaaagtactgggattacaggcgtgagccactgcgcctagcctctgtgtgttaagtgctggaactatagtttacagtagcattttatcctcccaacataccctatcaggaaaaattattattgtcatccttatttcacagatgtcaaaactgaacagagaggtacagtaacttgcccaagacaacacagctagtaagtgaaactgaaatctggacaactgatttttttcagccaagctcttcaagcccgctgctatgctgcagcttagctggcgacaggcccttatcaaggcagaactgtgccttgatagaggccaggaaggcgattcagagcagtaggccttgtccatgtgtttgttccctgcttcttcaccacttgaaaatagtgtttcagtgcccagtaacagggcacaatactcttttcctcagattaaaaggggagccatctgcttaaggtggttgggtgccactgcactgcacagaaggttctccaagtgtgagcttggacccaggcaggcctcaggtcagtggtaacggacgactgcttccgtggtgttggcaggtggaaatggagggatacagctttgtccggctcatgaatccctgggcattgtcccgcctgctagagcctctgatctctgccccttcttcacctgcagtaaaacagtcactagtttggttgctctccctaatacctctggtcactgggagctgtgatctcaccaaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgrgcaccagctgggtaggctgggggagccaagggacagaagcggcacagctaaggcagttctacgtggctgctcagggcatcagttggagctaccgacctgagcccacaaactcaaggtaactcaggtgtggagtccgggtgggcttctctagagaggaaaatctatttcttttagagaacattccctttgcaatgtcatggctttttttttttttaacttcaggtaagtaaatataactaataggagagtatactgaattaaataaactgggcaaatgctaattttgcatccaacaatgtagtttatcattctgagggtttagaaagcaccctatttgattggttagatgctaccttcttttcaagtttattttcaatacagttttgttagtatgtttgtgttggcttatatattggttaattcaaaggcaccaggcacttgctccctcattagcccttcctgcaaactcctgttccagatttttagttgtatagtatttttatgagactcctagttacatattatttattccattgtctacatagcttcatcttctaaaactaaaaatgaacaccttgtgctttttgtcatataattttattgctgccttataaatgactttcaaaatatcatcagttcttgtatgtttttgtactttcaccttttttctgcttcatatttgacttatttatcctattgaatgtgactcttcatttttttttctctctgttcatcatgtcctgggatatggtttaccttggctacttaaaggcatatgtaactgagaggaggtttaattcagataaaatactatccttgagttgcaaactattttttctaattgaaatgttaaaaataagacttctcagaaattaactaaatcatacagtctattcaatatttccagttagttattttttaaatggtaaacctgctagtgtgactcactttttttccttacatcacacttcattatgaaagatgtgttcctcttttacaattacaaaaccaaagtaatctgccaaaaaataatgtaatattttgagatcttttagtgtataatattaacctttttaaaactctcattgtaactgggttattttggagggtattacataccatcttggtcttataataagaagagatccctccttctcaaaaataatcattttaaatatcgtacttcaaagtgataatctaggtcacacccacaccctttgggaactgccgtaagctaaaaccccaaggaaaataacagtccttctaacactaatcttgcctgctcatgagtagaatgcagacttggttgttggctttcttgtagcatgctgggttcatgcttgggagttttttctcttgtctgtagttagcgttgaaaataacaagcaaaataccggaggcagaaccagatagggcaaaggtctgattcacatggtgagtacacagggaaccatgactggtcattctgtcccctcatcctgtgggtaagtttccaaagttctggagattcgttcctctggtagcaattgttgagtcaaaaccatagaaacacaacccagacaaactgtcatattgtttaaccctaaatcatatcatttctctctagcattttcttatgaaaaatctaatccatatatctggctgcttaaactaagaacttgttctaacttgtcctgcccctagagctatgatactcactaggtgaatatcaacatagccaactccatcttttggcaaagtgtattttagcacaaagcagacatctatctacttatttcatataatattagcaggacaatgccttttaaaggtaaaatgtatctattattcttgctccaagtctaaggtgaacactttcaaaaatttccttagaaaacttgtttagtcactcacatgtatacaaagagatattgaagaaaagatatacatacattttccttctagggttctagctttatatgattttgtgattatgaacaaatcatctttaaacaatccttataaatgaaaaactcgtcgtacacattgtttgaattcatatgatctgtaactttttaatcagatagattattttccaatagaaattgttcagatcaaaatagacatacctcagtatgaatacacagcatacatagtaaaaacatgttaggaaacatctctctgttgaaattactccacgtaagagactgatattttttagtaaagattttacaccatcatctacatttctgtattaaagatctggggcaggggaggacaataacttttcaattgtactaaaaataaataaataaaaatggacttccacattagggacattagtatatagaatcctggaattcttaagttagaagaatgctaagagttcatttaattcatattcaacttccacgctttaaccttctacttttcccctttccctcagcaccaatgaccttaccaagtagttgtctaatttctacttgaatgcttccagtgatggagaatccactaccttctctatctagctattctaaaagtacttacgtgcctcctttaattctgcccccacatattaacacagtttctgtattccacatattacaatttgtgagcattactgtaactacagatttgtttttgctttctgagaaaacctgaagggtaaagactaactcttattacatttacaaaataatattactagctaacatggattgagtatttctagtgtgccagctctatgccttttgcacatatcaacttatttaaaattatacaacaattctgtgaaggagatttcagtattaatctcatttcatagttgtagaaactgaggcacaaatggatgaagtaaacttttcaaagtaaaacaataagaggtagatataggcttcaagtccagagatactgaattcacagcctgcaccctagccaccgcgctgtatagaagtcatggcatatgtgggtgctgttatgtcttgattatggctgggccactgtccccacattaggaagcaaaacaaagccactctgatcaactgatttagacatttgcaaggtattttctccaaattctctttccttttaccctcatctttgagtttaagacaaggataagactgatttgcctttagaggtacagaacaataacaacaacagcaaaaacaggaaagtaacccaccactcacaactctccctgttgtctgtcctctctctaattttatttaaaatcatgaatgcagtggtttcacattttttaatcttggttctgccacttatcaactgtatctcttggacaagttactgactctttccaaaacagttttttcatttgtttgtttccaatatgaatcccagggcttttaccccattagccatctctcacctctcaactagaaataaattccaccaaatcaatactttttcacaatgttccccagtagattaaaactatatttgattgatcagttgaaaaacagctcatatatttattcataaaggatttggtc

SEQ ID NO: 17770 - DNA, 23427 bp, Homo sapiens
aaagcggaaacttcaagataagatgctgccaaataggaagcaaaaagcacatgaaaaattcaagtctcagatcatcctggaagctcaagaagaattagtggaattacaaagtcctctggaatcagaggagaaaagagaataactaatatatacatatttgtgttaattctttagcagctattctctcttgcttttttttttattggtaagaattcttatacatttactttccatgtgtaagaattcaaaatgctactcaccctaaattttccttgtattttcccagcactttacaagtggggttctggccttccagttccgaagagaagtgtcacaatgatagtaaattttgatcaaaattctggtacctatagctgagcaccaaccacggggtcttactaacattttctccaagttaggtggccctaggccaatacatctaagtgtgataggatctggtcatcttacacattctgtattagaatcacctgagatactcatttaaagcccaaattcttgggcgccacccagacctgttgagtcagagcctctgagtatgagacctgaagatgtgcattttaggtgagttgtccaggtgattcctctttattctaaagtctgagaaccctacacttccccctgggtgtgggagaaaagagtgaggtagagcccggagctcctactcgactcagatattataagatgtctataaattccaagtgagtaaacatggctttctgggaaataaacttagaaccagacacattttcatcaaatatatttaggttttgatcaaacaaaaaatgccattctctactgtggtgatacacattttctttcacaattttgggaatgcaagaaataccatgtttgtattttgcagatagggtggaatctttattgggatttcctccctctacctaagactctgcaaaggtaacttagatgttagcagagtagagcttttttatgggagagagggaactaaggctttcaaaactaagcactcaggggtaaaataagccttcgcagaggtaagggaacagagtgcctcaggaaggcaggaggacaccactgcccctgcttcccggtcacgttcaccaaatataacttcactcctcgatagatgcttttgccacgtgtggttgtggccagtgctgctttccactaaacccaataatctcctgtccacagggtggccttggttaaaattctaacatttgtcttggggtccccaatctcttctttctggctatctctctgtctcccactccctttgccataaaagtgagaatgagtgggcctgggcacacagcaaaactggttaaagtctttgatgcctgattaaagggtgtggaggagaggacaagagacttccaggaagagacaataaagccaggaagggtgacacctcagagattaaatagcactggtggcagacaccggggtgtgcctgagtttgcaccgtcttctttcctcttttcattcccatccatgtagcggatgcttcccccatgcgagaaactgccaagagggtccatgtgaggcgaggcttgaaaaccggcaatccggtaacagctagctacatcttcagagcttgggagattcagtggagccttgaagcacctctaatcagcctgtttcttcggggtatattttggattatttgaagagggagatgatattcataatattcaacatgcccaactattcaaatcttacccaatttcctcttcaactccccctgatttgcccccaccctcaaaaaacaagcaattgcctcttatgaaatcctgataggaaaaagcaggtgaagaagctatagtctggttgtaatcccactcccacgcagcgctggcccagggcctctccacgagaggaaagctgggtctgtctatggccccttcagcagcccaggtagccagaggggagcccatcagctcccagtatccatgtacctgatttgcagtgacaacctcgggggcagggacacagaaaatactgtgggagaatgcaggtaattgtaaggatgaatggattttgaataacatacctctggttaaaacaagtacatatattatatacatataaattatatacatacatgtacatattgtaaaccaaaaagtaactgaagcatatctcaacagattagaggtttattttgtcccaggtaaaagaaacacaaatcactgtaggatctgtgacctgcgctttttccaaagagagttttgggaacttccatctttagaggggaaagagcaagcaggaggggaagaaaataaacgaaagatgggttggcaatgagacaagtgtttacattgtggcaaggctctgtaacactcagtgagtctacactttacatgtaaaaagaagggactagagggaaattatgcatggatctcatgctcagtacatctacattttatataagataaagtaagcatgtgaaattacaggtatttgggaacaaaaggaaggcagtttttgcatgactcatttcccaagcttaactttccctttggcatagtgaatttgaggtctcaagattctattcttctttcacagtattttacatatatttatatataatatatataaaaatatctatatttatatataaaatataaaaatatctatatttatatataaaatataaaaatatctatatatataaaatatataaatatatataaataatatatatattccacatatataatatattgtaattatatatatatactctacatatattatatattatatatagtctacatttaagttactgttactcacctatctcttccactcctcatttctcttatccttcgaatattgggatctctccctgaagctttctcaatttagaaataatcagtttagaatttagaataatcagtttgccctttgaccttagagaaaatttgcttttgaatcaggaacttctgggaactgtggcttagggatcaactttacctaggcatggctccacctgccttgcttgttttttcctttgtccactttctccctgcctatgcaccggggatccagggtctgttctcactgcatcctctccctactgctcactgtccctggggtcccttccagcccccatgtctcagaacccaggacacagttatctcagtggagagctgtgatggtcaaggatgtctcaggaagaagagggcaagaagagtacaggaaacttgggtagaacaaggaatctcggggcataacaacaaaagaaatcatggtttggagtagcaggtaagggagtgggctctggatatcaactgcctggtttcaacccttagctctgtgcttttgaatgagataaaatccccagattctcaatttcctcatctgtaaaatggggataataggagtacctatttcataggctgttgtacggattgaataatcaataggtgaacatacaaaatgctcagaatatggcctggcacatagtaagcactcaataaatgttagagattataattgggggtccaggacatatatatgtaagtaaaatagaaacttcatcaccactggggctatttttagatatctttgaactaattttaaaaaggggaagagataaactataaacttagttatgaaaaattcgcaataataaagttagttatctagggatgttaacgactaatttctattagcaatataattattaggtactttattgatatcgaagataaattgttttttaagatttggctactctatacatttgaccatgctttttaaaaatagcagattatgtattcatactttattaaaaataaaatacatacagataatgtattaacccaacttgacattctgccctaaaatctaaataaacattatatgagtgattactcttctgaatttattgaagcaacaaccacattgagctaagtaaagtgggataaagaattggaataatgtcagtatctggatcatgtaagagagtggtaaggtggagggaataaattctatgctttttgataggggttgaattaaattcgttaattaagttatttttttctaatcagttgtcttttttggaatttttcttctcttttcttgttttttttttgggtcttgacatctttatgaacacagaaagaccagtgctaacaagtaaagagaaaaacgaggcttttaccactactcgttcaggtctgctgacagtacatttttagatagacctcctattttgaaaggctgtagatatagaatattagcttgacttgagctctgaaaacctacagaatatggaaattaaaatgatccccatttactgttaccatcatttagatagggtaagatgcagagatggggaatgtatacaatcacccagaagaaatgtcaaaatgaagagcaggaatataggataccacatacatctccttctgttgcatttggaaacaaatttcttttcttttctttttctttttttctttttttttgagatggagtcttgctctgtcgcccaggctggagtgcaatggtgtgatttcagctcactgcaacctctgcctcctgggttcaagcgattctcttgcatcaggctccccagtagctgggattacaggcatgcgccactacaccccggctaatttttgtatttttagtagagacagggtttcaccatattggccaggctggtctggaactcctgacctcaggtgatccacccacctcagcctcccaaagtgctgggattacaggcatgagccatcatgcctggcctagagacaagtttctttaaactgtattcttgttactataaaggtgaaaaaaagggaaattgaaaaaaactttaaaatcctgaaaataataatgaaggatataaaaattatcccaaatcctgccatccagagttagtcactgttaacattgtggaagaatttttattctttgcacattaacatttcaaaaattttaaacaaaattttgaccaattaaatatatatatatagttttccgttttattttttttcttttcttttctttttttttttttttttttaagacagagtttcactcgtttcccaggctggagtgcactggcgtgatcttggctcactgcaacctccacttcccgggttcaagcgattctcctgcctcagcctcccgagtagctgggattacaggcatgcgccaccatgcccagctaattttgtatttttagtagagatggcgtttctccatgttggtcaggctggtcttgaactcccggcctcaggtgatccgcctgcctcggcctcccaaagtggtgggattacaggcgtgagccactgtgcctggcctcctttttatttttttcactgaacaaaccatgaaactttcccagatgtaaatatctatttcccatttttctttttttaaaataaggcattattttaaccatttgagtgttagatattatttttagataatattttaatttaggcataactgccgtgcaaaatctgaagattaatatctaccttgtgagtcattcctctgtgagacagtgcatgttaaatatgttgaattggcaggtgaaaaaggaagaaaaaatgagtagtgattggttatccacagctatgaatgagaaattgaaggtagtagactatggatgacaaacctattcttggtttccttctgtttctgaaattctaattactaccacaactacatgagagacactactaacaagcaaagttttacaactttttaaagacatagactttatgttattataattaaaaatcatgcatttttgtcatattaataaaattgcatatacgatataaaggcatggacaaaggtgaagtagcttcaagagacagagtttctgacatcattgtaattttaagcatcgtggatattcccgggaaagtttttggatgccattggggatttcctctttactggatgtggacaatatcctcctattattcacaggaagcaatccctcctataaaagggcctcagccgaagtagtgttcagctgttcttggctgacttcacatcaaaactcctatrctgacctgagacagaggcagcagtgatacccacctgagagatcctgtgtttgaacaactgcttcccaaaacggtaagtgcagaacgctttataagggcagcctcgggccatgaaacacagatatgcaaaaggccttctaataaaaaccacatctgtacaagctcttattgtattgtagctaaaacctgtcttttctctttgacctaaatratgaaagtcttaaaatttgtttatttatttgattaaactctgaaataaagattattgcactagtgkcctttgcccaaaatcttaggatgctgccttaaacatcatggtagaataatgtaactagctacccacgatttccttctttaattcattttgtgttttatctccccaggaaagtatttcaagcctaaacctttgggtkaaaagaactcttgaagtcatgattgcttcacagtttctctcagctctcactttgggtaagtcagtgycattagaccaagatttctcattctcgcactatagatatttcagactgaaatatccttgcttgtctggggctgtcctgcacaggatatmtggcagcatccttgacctctacctgcaatgtgttcttccctgggcttggggtcatttactttacctcttggtgtctccctttccttaagtgtaaagtgtggatcataatgacctayttcccagatgcattgtgaggattmaatagcatggttcatggaaagtacctcatacagtgcttcttggtgcatactaagtgctcrataaagcttagttattctgattattattctactacaaaatgggtatactataatgttgtgagtgagtgtggataargtaccyagtgggtggcagtcacaaaagagataaacaataagtcgctgtttcttcatacgtacytcttacttttgaaaagatgagaaaagtctgggccatgtcacaaacattgccaaaaataagacaataaaaagcacagttgtcagagttaaaccacaacagtaccaaactctaccatttcttttctttttctcccactagtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacrgargaagccaagaactgggctccaggtgaacccaacaataggcaaaaagatgaggactgcgtggagatctacatcaagagagaaaaagatgtgggcatgtggaatgatgagaggtgsagcaagaagaagcttgccctatgctacacaggtagggagtttgcggcagcagtgggaggtagtttcagtgtgtgggcatcttggcaaatttacagcatgcaaaaactgctctctattgtggtcattttatgttccaaaagattctgtttaactgctaaagtttctctcttttgctgttttgtgtgaatgtgggcaagaatatgtggatatgtatatatatacacacacacacatatatacacacacacatatatgtgtgtgtgtatatatatatagcctacagcatttatatacattttatatatatacatacacacatatacacacatatatgtgtgtatgtatatatataaaatatatataaatactgtaggcaaatatgtagttctttacatataaaaatgcacacacacaatacatattttaattacttgtttatttgtggtaggggaactgtcttcagagtttgtgaagaagtaaattttctacggtaggtgccagccacagctatacattagcatcaaggtttaggataggtgggcctgaaactcagatttggaactttgtaaaacacttcagttaaagtctatggcactctgtaggactgctgatgtctctgttgcacactgttgattctaaaatcaaaggcactcagtataagcacagtaatagtcctccycatcatgctttgtattttccgtagctgcctgtaccaatacatcctgcmgtggccacggtgaatgtgtagagaccatcaataattacacttgcaagtgtgaccctggcttcagtggactcaagtgtgagcaaagtaagtctggttctygcctctttcttcacttgagatggtagcaccatctcacgtcctagctggcattagagtcaggtctgcatgccttcccttccctggtgcagatggtgtcatatggtgatcgtgagctgagactatgaagtcagaccctgctgggtttgagtcctagattcaccagttatttattttggcaccttgacaagatagtttaactctctatgtcagttttctcattgtaaaatgaggataataatagtgtgaacttcataggctcatggttacatggtgcctggcacacaggacacattcaataaactgtaattctgtgtccctgcgaggaacatgtactcacctcatctaggtggtaacaagacgttgcagtagaaatgagtgagttacagagtccagggtatcttggttcatgctctggcctctggctctgtaatgactagccgtgtagcatggagcaagtcgcttgaatgaaatgaggtctcagttcctaaatttgtacattaagagagttagatgagcttctctccaagattccttagcacagcgttgtgcagtagagcttttgtgataatggaaatgttccatagctgtgttttccagtgtgtacctatgagccacatgtggttattgagtacttgaaatgtggctggtgacactgaggaactgaattttaaatgtyatttgatttcaacgaattcaagtagccacmgatagtggctactatagtagacagtgcagcattagggttttaaaatttgtaatgtattctagtacttaaatttgaaatatagcttkgtgaatggttctcatcctggttggaagcttactgtagtatttttagcagttgtgagaaaagtaacaagaaatttgttgtggtacctaagtttgctgtgtttgttcatataatttgaacagttttgaggtaaacacaattacactactctccccatatcactcaatatttcttttttatggttgtcatcactgcttttttgttgttgttgttatggatcagcattttcttgaataaaagaaaaggggtagaattacagtcaattttacaaattccattagaaattttataaatttttaaactaaaaaaaaaaaaaaccaaactgtagttctagtttycagtgttcttatctgttaaaggtgagagatgagcagaactgatttgggtttctttttcagttgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatggtaaatccctctgagaatgcacagaacgttctgtaactcatccctcattgcttctgttttttgattcaacttacattttcaaaacttcagggaaagttttttttttgtttttgtttttaatacaatttgttctctcagccaatgtatattgccaacccagtacctgcttgggttgagagaggtttttttattctatgcttgaaatgggtgtttctgaggctctggtgatttgtaagggagaccataaaacaataaagctctagaaatctcaatggatttctcatcttgtttccctgtttaacttttccaagccatgggactaacttaagaccatgatagtcaagcagtcttagtatctctttttctctcttaattttatctttctgaaccagaggccaaaaaaagaaaaatcagttcttcaggctctgatgggctaaaataaatgaatagcctacgtatgtcagtactagtcataactcctaatctggaatstattttttttaaatttttacctcacgtaaatgataacatagattagagaccactcagcataggcaaagtggaaatcagaaaagatagaatatccatgaaaaagaataaaagcttttattctggctgtgcatgtccctaagaattgacataggactttggratctaccctttgaaggcagcttcctcactctgttaggcacccagctcaataggaagtgaaaagatcattcttctgtaaaattcatggtgctctttmaaatcctcagtggttgagtgtgatgctgtgacaaayccagccaatgggttcgtggaatgtttccmaaaccctggaagcttcccatggaacacaacctgtacatttgactgtgaagaaggatttgaactaatgggagcccagagccttcagtgtacctcatctgggaaytgggacaacragaagccaacgtgtaaargtagagttgttccacatggagacttactgtgaacattctttctctcaacccatactggaaatgggcaagctaattctaggccgtgctaatatcaatgcrtatatttgttacagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaaggtaagcttgagatccttcgatttatactttcttaaagaacaaccatcttcaaacttggacagtgaaaaaaaaaaccaatacccactttaactatagaaatcagatttgatgagcaaccctcgtatctttgagattcatttaaaagaactaatgtttggccagggaaaggatcatatgtgttaagaatgaattctttgctgtttttttttaactgtgatgtgctgataaaactttgtagacattagcatggaatagacagaattcttaatctaaaggaatcatattagaaaattcggaaagcagaataatgagaacatgatttgaatgtaaaactctcatcacacctgtcttctgaaatggctcataattagcagtgatgagactgtttcaagcatggtgtcagctacagagatagtattgatgcatatataagcagtaaattttaattcactttaaagtgagagcaaggatattgaaaacaagcagtttttactatcaggcactggccttgtcctagccaaagccagcacagaatgatttccagtagcaaaacataacacaaaaaccaaactgcaaaacagacaaattttataggggtgctttcttttctttctttttggcaccatctataaacatccatgacccatatgttgtcctcagactgcgtgaaatctttccttggaccataatttattttgtgtgttagaagaacagtgctcaggaactaatgttctgrttaattagtcttttaattagtgccatgatcagtgagggggctgaaattcaaagaaaacacagccatcttcccatttgtccagggaattataaagaatcttcagttctccaagtgttgcttgaatgaactgggttcactcaacaaacrccaagtactctctagttccactgcaatattttctgaccatcattttgatgtctcagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaaysagaagcccacatgtgaaggtacagtctttgtttttattttattttaagatraaaagaactattgaagagcttgggaacttggttaccttgggaaacgtawtgctggagatgcaaacaaacttctaaagtgctctctcgtgygttccagctgtgagatgcgatgctgtccaccagcccccgaagggtttggtgaggtgtgctcattcccctattggagaattcacctacaagtcctcttgtgccttcagctgtgaggagggatttgaattayatggatcaactcaacttgagtgcacatctcagggacaatggacagaagaggttccttcctgccaaggtagaattgagtgcagacttttttagggtacaggtcaaatacttcataaagtttctgaacctagattgccccaaaggggtttggtcctaatttcctacatgctgaaaactaagtagcgcttacacwttacattcattgttgacttttaagcaagttttggaagttttccagtagatttttctgaaactctgcctgtgtacctaacatttgcagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaaggtgatgcattgattgatggtggttgtctggtgattaaaaagaaaaagggggagctatcttgttacagtaatcaactattcattatatccaaaccagaaagttcgcccaggttgacaagttgtgaatattaagttgtatggggatagagaaaaaacagaagttgcatgttgatggaaagggtagaattctgacaactggaaaaaggagacagagagaggagaggagaaaggggaaatggaaaacaagagggagtgagagcaagagagcaagcaagtgcagtgtttattaaccaaggtgtggtgtggtattgtgaacgagcttggcaagttagagttctgcctgccaatggtggaaatagcttcaaaggtggcttggagcagatctcaaaggcctgtaatgccacatctctgcttcttgtattaaactagatagctcttctgctcctagtaatgaatgtacagaaaaaaggccaaagggacaggacggagagactttaacatcaattyttcctcatgacctttcttcgtctcttacttccttagctcccactgagtccaacattcccttggtagctggactttctgcygctggactctccctcctgacattagcaccatttytcctctggcttcggaaatgcttacggaaaggtgaggaagtttatgaatgtacttcaaaaatgtttttgaaaatacatttctttctcattgayaagtcatggtcttgcttactgatttaaacaataattagaatctggataaaatgcagtataattaagcagaagtattaagaaaagagttagtagtacaactcagtgtgggaagtgtttcaggaaataaaaatgttagtcgtgcctaatattgtacaactccagggggtgctattcatgttgaattatatgatgcctcccggaattgtgcaatggaastgccatgatgagcactctaaggaaaatggataaaattcttcctaaggagatttatttggagtacaggcttaaatttgagagtctctcataaggaatatggaagcacatctgactacactcatggtttgtttggcttacatgtttaagagtacttaaaacatttttgagttaagttctgacgtttacaaaataggaaatctcacatttaaattaagactttggacttctcatgaaaaattgggagctgaattgggcaagatgaccccgtagctatttgctggcattaggaagctgctatgccctttggatggctgtgcactttgcattttaccctagatgccacagagccatgcttgtgctctgattattacagaggccctgaagcatcgagtttgcaacacttgatgaattaagtcatattgtatctggatttaatatatccttaaaagtcatttagtctgaattaatggttgtttgtcttttcttttgcagcaaagaaatttgttcctgccaggtaagttgcattcttatacaaagcatgccattgaacattccacatatttttctctcttcatgttggaagacagtgctttacctagtgttctcatgtattccacagcagctgccaaagccttgaatcagayggaagctaccaaaagccttcytacatcctttaagttcaaaagaatcaggtaagacttgtaaatcacaaatggttatgagagaggtatcttctctacatgctctgtttctccttgaaccctccaaacttgccaatatcttagggagggagcaggggagaaatcatcacctgggtattgttctggaaagttgctttattttttgtagaaggagaggaaagaaacrgatctagctttattgtgtaatttcatttatgatagataataataatgaagatagctgacccttacattgcacttattatattctgggaatttttctaagctaggaactctgagataggggctggtactatatttcttatcttttctttttactttttttttttttaattttgagatggagtctcattctgttgcctagactggagtgcagtggcatgatcttggctcactgcaacctccacctcctgcgttcaagcaattctcctgcctcagcctcctgagtagctgggattacmggkgccygccaccayrcccrgctaatttttgtatttttagtagagattttgtattttttcgtcatgttggccaggctgatcttgaactcctgatccacccgccttggcctctcaaagtrctgggattacaggcgtgagccactgggcctggcctgttactttatttcttatcacacagatgaagaaaatgagacagagaagttaagtaaattgtctgaaatctcaaagctagtaagtggtgtagccaggattcaaactctggcagtctggttctaaaatttgtgttcttaactactccgacctgctttgagagaatttggaaaggtcaagtccctctgaatactttttaaaaaattaaaataactttttttgtgtgtgcggttttaagtttacagaaaaattgagcagaaagcacaaagagttccaacatatctccccaccaccccttcaattccccctgttattaacatcttatattagtgttacaactgatgggccaatattgatacattattattcattaatgtccacaggctacattagaattcactctgtgctgtgttgtatattctgtaggttttgacagaggtataatatgtagacatcatcactgtcctaactgaatagaattcgatgttcctacatggtctatcctagtgagagtgtctgtgttagaaggtacattttgttgtcatgatcagtatgcagaatattaagtgttctgatgacatgcatgtttatatttacagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtytgtatattgtcagatattttttcagaaatatgtggtktccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatrtgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacracaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgtttatctctgtgttaagtctctttcttagaaattttatttagataaaactcactttccataaaacgcaccctttaaaaatgtatgtgattgtacagctatcaccattgtttaactccagaagatttctatcaccctgataaaacattatttctcagtgtgtctgtgagagtatttccaaagagattagtatttaattggtagactaagaggattgccttcaccaatgtgggtggccatgatccaacccattgaggccctatgtagagcaaaaagagtgaattcactgtctttttaagctgggacacccatcttctcctgccttccaacactggcactcttggttctagggcctttggactttgaagtattccactggctttcctggttctcagctcgtagacagcaggccatgggacttctcagcttccataattgtgtgagacaatttctataaaaaataccacacccccacaccccaacacacacacgcacacacgcacacacacacacacacaccattggttctgtttctctggagaactccaactaatacatgtcccttcacgagaactggctacttacactaggtctcctctttaatgccctcataatccatatgtctcttccttcctttaattgtaataaataattatagattattacttgcacaattgtttgtttaatgtctgtcttccccactaaactctaagttccttaggggtagggaaaaattaccttgttcattgctgtattcccagaacctagcacattcctgatacagagtggacatccaacaaatatttattgaatgaataaatcaatgcatgggtgaatgaatgcatattttggctcataataagaagtagaatcacttttcacaaatggaatgagtggtctcagaaggctagactttaaaacctagttatgtatcaactgcccccactactgccagtttgcaatttaatatatctatctctcaaaagtccagcaattatttcaatccccatttacagaaatggggcttgtaggaatcattgtgagggctaaaggtcaatagaaataaaagggaaaaaattttttaaaaaaggaggtgtaaaaatagcacaagaggaagtaataagagagaaaaaggaaagatactaaaagaaaaaatattgagatgcatagagtaaacagtacagatgctacagaagggaaagatctagttttgtattcactcacctgggagcttaaaacatccacacaagtgctgggcatggtgactcacgcctgtaatcccagcactttgggaggtggaggcgggtggatcacgaggtcaagagatcaagaccatcctggccaacatggcgaaaccccaactctactaaaaatacaaaaattagctgggcatagtggtgcgtgcctatagtcccagctactcaagaggctgaggcagaagaatcgcttgagcctgggaggcggagtttgcagtgagcagagatcacgccactgcactccagcctggcgacagagcgagactctgtctcagaaaaaaaaaaaaaaaaaaaaaaaatccacacaagcgtacatgctaatgtgcacacacatacacagagagatatattcctaaaccctaacccacaggtaatttgccctgaagataatgaaaattaagcttcagggcccattacttagataaacctttaaattacaagggcctgggtcctaggaatgtgtttacatggtaatacatctttgtaagatctataaaagcaagacgcttttacgttccttttctcaaagagagacctcaaattatataaaccttggaccctgaaaaactcctgaatgttcctgaaccaacccaaaatattctgattcagtaggattgggagcgaatgttgcgtgtatatttttttgtttttttaatgttaccaagtgatttggatgcacaaccaggtttggaaattactgaaaaaggactataggctgattagtttaaagtgtccctgatgtctatgtggtatttctggagctttgccaccgttgattgggtcatataccatataacactatgtagtttgggaaaagtggacaatgggtaacattcatttgcacagtgcggtgatggtcacatccccccgtgttgagtaattagctatccatctgtatgtactggctgtagcaatatagttcttttcaacaagaaataaagagaattcagacacaacattcacagttgtaaatatcaagaaaacagaataaattcattaaacaaaaatccaattttggaagcaagatatatctgccaacagtgtaactgtccaatgggttccttttgtttgctgcccagataaaggtgatttatcaagatgggaactgcaatagagaaagaatttaattcatgcagagccagccaaatgggagaccggggttttgttattactgaaatcagcctcccccaaaattctaaggctaagatttttcaaggataatttggcaggcagaggaatggttgctgctgattggttgggatgcaatcatagcggtgtggaaaatggtccttgtgcatgttaagtctgcttctgggtggagccacaggacttgttgatgggtccaggtagagccaccagttgaaatgtaagaatctgaaaagacatctcaaaaggccaatcagattctatgatagtgctgttatctgcaggagtaattggcgatgttgcaaatcttgtgacctccggaataacagttggtaattgtttacatctacaccttagcagaattcaggctcctctcatcctcctaacctttcattggtggtcttttattagttttacaaaggcagtttagttttggagaagggctattatcatttaaactataaactaaatttctgccaaagatagcttggcccaagctcaggaattattaagggcagtctggaaggtaaaggcaagatgggggttgattatttcagatctctttcactgtcataattttctcactattataatttttgtcaaggcagttttaatagtgcagcatagacttgaaataaataaggagaaaccaggtggggcatagtggctcatgcctataatctcagcactttgggaggctgaggcaggtggatcacctgaggttaggagttcgagaccagcttggccaacatggcaaaaccccttctctaataaaaatacaaaatcttagccaggcgtagtggcatgcacctgtagtcccagctactcgggaggctgagacatgagaatcacttgaaccagggagatggaggctgcagtgagccgagatcataccactgcactccagcctgggcaacagagtgagaccctgtctcaaaaaaaaaaaaaaaaaagaaacaaataaacaaacaaacaagtaaggagaaacctgatggttagaaataaggaaatgtttaatggcctggaggttcaatgaggtagaagtaaaaagcattgcaatgagatacttgagcaatacacttgcaagaataggagacagtggttaaagagtgaagtgtttgaacatgtgactttagagacggtacagtcttaggtgttgtcgaggttgaggctgtgcctagggaaggaggtagctcaagtctagtggaggaaaatgtcattggagagctgaggatctgggctgtggtattggttgtgccatggatggtgaagtcccgtaagactatgagaagtgcttacagggaaaggaagatcaggaactaggtgccaaagccaatcttgcatgaggagttgagaggtcactacaatgaggacagtgagatggtttatctcagtgtcacaagcttcaaagaagcagagttattttatttcttctttgtgtgtgtgtgtgtgtgtgttttacaagagggcagatgaataaacatatataagaggcactcattataaaggagaagattgcccctgccttccaaccctgaagtatgtgctgtgtggagaataaatattgtcatcttgagagatctgcaggggaagtgatgtcctagggaggcagtcgggctaatgacaaagcaaggaggtaggagaaaagtttgaacaggaaactggaagattgaggggagtttggtgatggtgaagacaggaatcccagagatggcaaggaagcatttgggatgaaaatcaaggttgggtcaggagagaacagtttaggtgaactgtgtaggagatagatgacagacagtaagaggggcttacatgccaaatgtaaggaaatgtgagccatggtgatttgtcctgataggattgtggaggtaggtgggcagttagttagttctctactgcacattccttttacccatgataaactgatagcaactgcagtgagtgcagccttggttggcagcaatgagcaaataaatcttgcggtcatctgtaatggaggcgtaggctagggaagggttgggtagtggtcctttgaccatcccttggacccagggatgctgctttcaatggcattcactggtacttccctcatgtctcatggcaggcaaacggttcttcagcactgggtcctctctccagggttttgtgatggttttataatgctcaccaactcgatctagttctaccttttgagggccacaaaacagtctaataaccactcttttccttaccacccatcaaatggctgttaatatatctccatgacctttcctattccaaatcttcttttggctgaatgtacattaaatatttttttttattgaggtgaagttcacacaacataaaacaaccatcttaaagtgtacaatccagtgacgtttatcgcattgtataaccaccatctctgatatggtttggatccgtgttctcactcaaatctcatgtcaaattgtaatccccagtgttggaggtggggcctggtgggaggtgatttgatcatgagggtggggtttctcatgaatgatttagtaccatcctcttggtactgtcttcatgatagtgaatgagttctcacaagatctggctgtttaaaagtgactgtcacctccccacatccctctcttgctcctgcttttgctatgtgatatgcctgctcccctttcaccttctgccatgattgtaagcttcctgaggccttaccagaagctgagcagatatcggcaccatgcttcctgtaaagcttgcagaagtgtaagccaattaaacatcttttctttataaattaccaagtctcaggtaattctttataacaatgcaagaatggcctaacaaaatgtctatctagttccaaaatatttttatcagaagaaaactctgtaccctataagcagttagtccccatttcttcctcagcccctgggaacctctaatctactttctgtctctatggatttacctcttctatatgtttcatataaatggaatcagacaacatgtaaccttttgtatctggcttcttttggaacaggaattaaaagaaattaaataatgtgtaagcggaaactcagttgtatgtaacaaaacccaactccccctgagaaagagaaagagctggagccctttaaaaattaactgcctgtttttctgtggctagtgagacttacctctcctcctttcccaggcattgtgaagaccctgtttctctagctgtgcagctgcaaggtcactagacagataaactcaagtcgcaaaacatgtttcttcttgaaaagtaagaaatgatgtaatgcatgtctcaattaattgaataactgtctttatttctcacttctgtagtatgcttccccctgcacagatacccctctctcccaccccacaaaatgcttaaaaggtaacttaactctttgttcagggctcagtcctttggatgttaatctgacttggccagtgcacctaaataataaatatcctcctgaaccccatcggtctctctgatttcttaaaaaatcccgcaatatttccactaccaaaatttgttgacacattggatatgacttgtgaaaaaaaagagaggtgtctcagttaactccaaaagttttggtc
